United States Patent 11,446,398 (REGULATED BIOCIRCUIT SYSTEMS) - sequence listing, part 71

SEQ ID NO: 171127 - DNA, 3983 bp, Homo sapiens
  Payload ID: 13671
  Gene Symbol: PPP1R9A
  Gene Name: protein phosphatase 1, regulatory subunit 9A
  Uniprot ID: Q9ULJ8
  ENST ID: ENST00000289495
  CDS Start-End: 32-3922
tgaacattggcttttcacccctgaagtgaaaatgttgaaaactgagtcttcaggtgaacgaaccactctcagaagtgcctctcctcacaggaatgcatatcgaactgagtttcaggcactgaaaagtacctttgacaaacccaagtcagatggggaacaaaaaacaaaagaaggtgagggctcccagcagagcagggggaggaaatatggctccaatgtcaacagaattaaaaacctatttatgcagatgggtatggaacccaacgagaatgctgcagtcattgccaaaacaagggggaaaggtggacattcatctcctcagagaagaatgaagcccaaagaatttctggaaaaaacagatggctcagttgttaagttggagtcttctgtttctgaacgaattagtagatttgacactatgtacgatggcccttcatattccaagttcactgagactcgaaagatgtttgagagaagtgtgcatgaatcaggacagaacaaccgctattccccaaagaaagagaaagctggagggagtgaacctcaggatgaatggggaggttccaagtccaacagaggcagtactgattccttggacagccttagctcccgaactgaggctgtctccccaactgtgagtcaactgagtgcagtatttgagaacactgattctcccagtgccatcatttctgagaaggctgaaaacaatgaatactcagtgactgggcattatcccttgaatttaccatctgttactgttacaaatcttgacacatttggtcacctgaaggattctaattcctggcctccttcaaacaagcgaggtgttgatacagaggatgctcacaagagtaatgcaactccagtaccagaagtggcttctaaaagtacctctctagcttcgatacctggtgaagagatccagcagagcaaggaacccgaggactccacatctaatcaacagactcccgacagcattgacaaagatggtcctgaagaaccttgtgctgaaagtaaggcaatgccaaagtccgaaatcccttcaccacaaagccaactgttagaagatgctgaagctaatttggttggaagggaggcagcaaagcaacagaggaaagaacttgcaggtggtgatttcacctctcctgatgcttctgcatccagttgtggaaaagaagtacctgaagattcaaataattttgatggttcccatgtgtacatgcacagtgactataatgtgtatagggtgagatccaggtataattcagactggggagagacaggcactgagcaggatgaggaggaagatagtgatgagaacagttactatcagcctgatatggagtactcggaaattgttggattgccagaagaagaagaaatcccagcaaataggaaaattaagtttagtagtgctcctattaaggttttcaacacatactccaatgaagactatgacaggagaaatgacgaagttgaccctgtggctgcttcagctgagtatgaacttgaaaaacgtgtagaaaagctggaacttttcccagtggagctagagaaagatgaggatggtcttggtataagtattattggaatgggtgttggagcagatgctggacttgaaaagctgggaatattcgtcaagacagtaacagaaggtggtgctgctcaacgggatggcagaatacaagtcaatgaccagattgtggaagtggatggaatcagcttggtgggtgtgacacagaattttgcagcaacagttctcagaaacaccaagggcaacgtcagatttgttattgggcgggaaaaaccaggacaagtgagcgaggttgcccagttgataagccagacactggaacaggagaggcgccagagagagctgctggaacagcactatgcccagtatgatgccgacgatgacgagacaggagaatatgccacagatgaagaagaagatgaggtaggacctgtccttcctggcagcgacatggccattgaagtctttgagctgcctgagaatgaggacatgttttccccatcagaactggacacaagcaagctcagtcacaagttcaaagagttgcaaatcaaacatgcagttacagaagcagagattcaaaaattgaagaccaagctgcaggcagcagaaaatgagaaagtgaggtgggaactagaaaaaacccaactccaacaaaacatagaagagaataaggaaagaatgttgaagttggaaagctactggattgaggcccaaacattatgccacacagtgaatgagcatctcaaagagactcaaagccagtatcaggccttggaaaagaaatacaacaaggcaaagaagttgatcaaggattttcaacaaaaagagcttgatttcatcaaaagacaggaagcagaaagaaagaaaatagaagatttggaaaaagctcatcttgtggaagtgcaaggcctccaagtgcggattagagatttggaagctgaggtattcaggctactgaagcaaaatgggactcaagttaacaataataacaacatctttgagagaagaacatctcttggtgaagtctctaaaggggataccatggagaacttggatggcaagcagacatcttgccaagatggcctaagtcaagacttgaatgaagcagtcccagagacagagcgcctggattcaaaagcactgaaaactcgagcccagctctctgtgaagaacagacgccagagaccctctaggacaagactgtatgatagtgttagttccacagatggggaggacagtctagagagaaagggtttgagaacgtcttctccagaatcagattctggtgttccacccctcaccccggtggatagcaatgtgcccttctcgtctgaccacatagctgaatttcaagaagaaccactggacccagaaatggggcctctctcctctatgtggggagacacttcactgttttctacttcaaagtctgatcatgatgtggaagaatctccttgccatcaccaaaccaccaacaagaaaatattacgagaaaaagatgatgccaaagatcccaaatcactaagggcatccagttcattggcggtgcaaggaggaaaaattaagcggaagtttgtggatctgggggcgcctttgcgaaggaattccagcaagggaaagaagtggaaagaaaaagaaaaagaagccagtaggttttctgcaggtagcaggatcttcagaggcagactggaaaactggacacccaagccatgttcaacagctcagacctccactcgttccccttgcatgcctttctcatggtttaatgacagccggaaaggatcctattccttcaggaacctgcctgcgcctacaagttcccttcagccttctcctgagactctaatttcagataaaaaggggtccaagaattttaccttcaatgatgacttcagtcccagcagtaccagttcagcagacctcagcggcttaggagcagaacctaaaacaccagggctctctcagtccttagcactgtcatcagatgagatccttgatgatggacagtctcccaaacacagtcagtgtcagaatcgggccgttcaggaatggagtgtgcagcaggtttctcactggttaatgagcctaaatctggagcagtatgtatctgaattcagtgcccaaaacatcactggagaacagctcctgcagttggatggaaataaacttaaggctcttggaatgacagcatcccaggaccgagcagtggtcaaaaagaaactcaaggaaatgaagatgtctctagagaaggctcggaaggcccaagagaaaatggaaaaacaaagagaaaagctaaggagaaaggagcaagagcaaatgcagaggaagtccaaaaagacagaaaagatgacgtcaactacagccgagggtgctggtgagcagtaacacataccctcttacagatgatggagatgctccaagagaagtccccacctcttcctgccct

SEQ ID NO: 171128 - DNA, 9689 bp, Homo sapiens
  Payload ID: 13671
  Gene Symbol: PPP1R9A
  Gene Name: protein phosphatase 1, regulatory subunit 9A
  Uniprot ID: Q9ULJ8
  ENST ID: ENST00000340694
  CDS Start-End: 283-3579
ctctcccgggattttgctgccgggctccctctctctgcggccctagagttaatcccatcagccgagatgaacctctagtcttgctttgaaaaaatcattctgtgtaactcttgactgtgactaagttcctaatacacctgttgggacgatcactgacaccgtataccatttgagaggtacttttcttgacccaatactggtgattagagaagagaggtatcttggtttttggtttttttctttgatcattatgaacattggcttttcacccctgaagtgaaaatgttgaaaactgagtcttcaggtgaacgaaccactctcagaagtgcctctcctcacaggaatgcatatcgaactgagtttcaggcactgaaaagtacctttgacaaacccaagtcagatggggaacaaaaaacaaaagaaggtgagggctcccagcagagcagggggaggaaatatggctccaatgtcaacagaattaaaaacctatttatgcagatgggtatggaacccaacgagaatgctgcagtcattgccaaaacaagggggaaaggtggacattcatctcctcagagaagaatgaagcccaaagaatttctggaaaaaacagatggctcagttgttaagttggagtcttctgtttctgaacgaattagtagatttgacactatgtacgatggcccttcatattccaagttcactgagactcgaaagatgtttgagagaagtgtgcatgaatcaggacagaacaaccgctattccccaaagaaagagaaagctggagggagtgaacctcaggatgaatggggaggttccaagtccaacagaggcagtactgattccttggacagccttagctcccgaactgaggctgtctccccaactgtgagtcaactgagtgcagtatttgagaacactgattctcccagtgccatcatttctgagaaggctgaaaacaatgaatactcagtgactgggcattatcccttgaatttaccatctgttactgttacaaatcttgacacatttggtcacctgaaggattctaattcctggcctccttcaaacaagcgaggtgttgatacagaggatgctcacaagagtaatgcaactccagtaccagaagtggcttctaaaagtacctctctagcttcgatacctggtgaagagatccagcagagcaaggaacccgaggactccacatctaatcaacagactcccgacagcattgacaaagatggtcctgaagaaccttgtgctgaaagtaaggcaatgccaaagtccgaaatcccttcaccacaaagccaactgttagaagatgctgaagctaatttggttggaagggaggcagcaaagcaacagaggaaagaacttgcaggtggtgatttcacctctcctgatgcttctgcatccagttgtggaaaagaagtacctgaagattcaaataattttgatggttcccatgtgtacatgcacagtgactataatgtgtatagggtgagatccaggtataattcagactggggagagacaggcactgagcaggatgaggaggaagatagtgatgagaacagttactatcagcctgatatggagtactcggaaattgttggattgccagaagaagaagaaatcccagcaaataggaaaattaagtttagtagtgctcctattaaggttttcaacacatactccaatgaagactatgacaggagaaatgacgaagttgaccctgtggctgcttcagctgagtatgaacttgaaaaacgtgtagaaaagctggaacttttcccagtggagctagagaaagatgaggatggtcttggtataagtattattggaatgggtgttggagcagatgctggacttgaaaagctgggaatattcgtcaagacagtaacagaaggtggtgctgctcaacgggatggcagaatacaagtcaatgaccagattgtggaagtggatggaatcagcttggtgggtgtgacacagaattttgcagcaacagttctcagaaacaccaagggcaacgtcagatttgttattgggcgggaaaaaccaggacaagtgagcgaggttgcccagttgataagccagacactggaacaggagaggcgccagagagagctgctggaacagcactatgcccagtatgatgccgacgatgacgagacaggagaatatgccacagatgaagaagaagatgaggtaggacctgtccttcctggcagcgacatggccattgaagtctttgagctgcctgagaatgaggacatgttttccccatcagaactggacacaagcaagctcagtcacaagttcaaagagttgcaaatcaaacatgcagttacagaagcagagattcaaaaattgaagaccaagctgcaggcagcagaaaatgagaaagtgaggtgggaactagaaaaaacccaactccaacaaaacatagaagagaataaggaaagaatgttgaagttggaaagctactggattgaggcccaaacattatgccacacagtgaatgagcatctcaaagagactcaaagccagtatcaggccttggaaaagaaatacaacaaggcaaagaagttgatcaaggattttcaacaaaaagagcttgatttcatcaaaagacaggaagcagaaagaaagaaaatagaagatttggaaaaagctcatcttgtggaagtgcaaggcctccaagtgcggattagagatttggaagctgaggtattcaggctactgaagcaaaatgggactcaagttaacaataataacaacatctttgagagaagaacatctcttggtgaagtctctaaaggggataccatggagaacttggatggcaagcagacatcttgccaagatggcctaagtcaagacttgaatgaagcagtcccagagacagagcgcctggattcaaaagcactgaaaactcgagcccagctctctgtgaagaacagacgccagagaccctctaggacaagactgtatgatagtgttagttccacagatggggaggacagtctagagagaaagaattttaccttcaatgatgacttcagtcccagcagtaccagttcagcagacctcagcggcttaggagcagaacctaaaacaccagggctctctcagtccttagcactgtcatcagatgagagcctggatatgatagatgacgagatccttgatgatggacagtctcccaaacacagtcagtgtcagaatcgggccgttcaggaatggagtgtgcagcaggtttctcactggttaatgagcctaaatctggagcagtatgtatctgaattcagtgcccaaaacatcactggagaacagctcctgcagttggatggaaataaacttaaggctcttggaatgacagcatcccaggaccgagcagtggtcaaaaagaaactcaaggaaatgaagatgtctctagagaaggctcggaaggcccaagagaaaatggaaaaacaaagagaaaagctaaggagaaaggagcaagagcaaatgcagaggaagtccaaaaagacagaaaagatgacgtcaactacagccgagggtgctggtgagcagtaacacataccctcttacagatgatggagatgctccaagagaagtccccacctcttcctgccctgctctcctccagaggatgaaaaagaaactaaatgataagggtaatgcggctctaggccggctgaggaactgtgtgttgaataactgcattttctgcaatagaatgcactcttaattttaactactaaaataatcccaagccacctttggttcattaacaaaccagagatttcatttaagtagctgtgttttgctcttctctaacttaccaacatcttgtgttgtgttgggtgtgttttgtcacttggagaactagtgtgaccccacccaagagcatgacacaccctggtgttgttaatggagcgccgtgaattttcagtgtgggatcctgaaatggcaattgcacatgtctgcatggcagagagcaccctgccatgagatctgagaccagtacttaacttctaggactgcaacacctactccaatgtgtgggaaagatttgctcttaattctcagtctggacagtgagaccaccccgctgtggaaacatgggtgctctgctctgtagttacctactaagggaaaaggcaagcaagtcattctgcttgctaggcatcaaaaagaaagaaaataaattatagctatttgttaaccactgaaaaaagcaaaagccttaagaatgtggatgtgggtattaccttggggttctgagggtaatatttatcctctagatacggctgaacaagaaagaaaaaaatcagacattaatgcagccatgggatattgggatctgttgaccttgctactgctgtgtgttcagcatttcagcaacactggcaaacacaacacagttcctcttccccctacctaacccaagaaattgaacaggaaattgatttttaaggaaaccaccattttcaggtttcctctcctggggaacattctggctggtcttcagcctgcctatgtcacaatcaggaactcatcacatattttctactcaagatttcccaggtgggctcagttagtattttaacaaatgtacttttaagaaaaatagaaataccagttagaggaaactgtcagttaacattttagagagattttgaatggtttttccgaaccattcctttccatacttcaaagattctcaattttacagaaaaagtttgtttaaggcagtgcataggtatactttagtagtggaggaacttatactaattttaagccagcattaaggatttccatgtttcaccaaactaagtcaagtgcaggagactggggcagaagaaggagaaaataaactcgttttgagaaatttcatgtgatgagggttttttgttttttatgctcatgtatctggttctctttgctgcgttgactctaaaaatgaggttatccactttccaaaggacaagtttcagaataagacttgaggccacatgaattcttggacagtattttacttcttttactttatgggaatctctgctctgttcccagcatctcgtatcttccactagaagtattccatatttagagcctcggcaaggcttttgagtgtaacagattaagggaactcccttgtagccccatcttgtattttaataacagtgtgatttttttttatctgaaaatctgaattcagaaattatctaaactggacatttttaattctgttttacccccaaggcctgttttcttttcattgccagagtattgtcggttatgcgtcagctcttttgtcattaggtacagacccttcattcaatcctcagaaacgttgacatgaagtaacattgtgttttacagttatcaaagtcaccattatgtttttctgtctgtcttcattaggggtatgataatgaaactgccgtattggatactctattaatgtcttgagatgtctggtgctttgttattttttcacatcatgagaaataagaagccactattaatgagtgatacaatttggcaaaacttttcaaatactaaaacactaaattagtaaaaatctggtaatattagtgcttgctattgtaaatttttgccatttttgcttatctttgggaaaaaagtgacctggatcacactggaagtttcactgtattcaagagtagaaatagaaggatgattatcttaagttatgtttacactttggtaatatttgaaaatggatgtatatactggaaatgtctgtaagtgtcttgtttttgcacctaatttatgatctattatattgcattttcttaaatatcttagaagtatttttctttataactttgtatattgaatgtttagataaatgtccaactgacaatgttataaatcaaattcttattcctaaaatcatttagtattataagtattttgattttttaagttaaattatagtaattttaggccgaagtgagttattttaacattaccacttaaaacggatgaaattgtaaaagtcatttggtttgattgccccacaaagcataagatgtaaactgattaagggtatgaaagcaaagtgaaagacctcagatcttgtgcacattttgttttcctattatttcttttattgactgtagtgcatgatacctaatcaaggctccaatgtcttgcacaattcctactttaatgctagtggttttcagtgtccttacaatttaacacagaattgttatttcatcaaccttaaaaactgcagtttttattatcagaaaatgaacaaaaagggaatatctggttgctatgaactgattccctaaaggagagctcagtatgattctaacaatagccaaaagtgttttggggtataggttatgctttgttgggagggaatgtgtggtgaggaggccaagctgcagacagaaagcattgtatgagctgtatctgggtcagggtttcccattaaaggatgttagttttataacagattactttgtttaagaccatctcccttcaagtaactcacagtttatgtaatactaatctcattctttttttacctgaatcaggaattttctgcagaatgttaagttagggaagaaacctcatttcatccattctaacactcctgatgaagtccccctttagtttcatgacaataaagctgttctgtggctatcatcctttagctgggattgacaattgatttcacaccctcaacatcacaagctttttttaacccacagcagttcatgattgcagtatgataggtactaaagccaaactcagctttcaactggcacaaaatgggactgtcaccttttgctccattgttgttggaaacaaagtggcaagagggaaaatgaggaaccagatttacctttgccactatctgtgaccctgtaatcatcactagcctgaaatcttaaaatatcccagtcccaagctacaaaaatggtcacaggtggtttgatctagcacctcggccgttagagtttgtgctgaagacaaatttgtctgggttcattgtgcaccagaattagcatgtgcttgaaaattgcattttataaaagggaaatgaaaatttgcatttatatagatactctgattcatgtttaagtgttaaaggttatgcagactaaacttcaagaggagatccagtgtttaacaatagtgttctagaggattctaaaggaagctgccccagcagccctgagagaaccatctatactttggatatgttgtagccccatcattacactgagatatttccatttgagtaactaaaggtactcctgacagagctggagatgaggggcattttggtgggcagtggtcactagggttcacgtcacctacttaatgcaaagaccttagtggtctcagaatgaaaaggtaaaatggaagagaaaagcacagtcctttcctgtcttttcaaatttactttttattaaggatgtacctgtgcactattctaaagctaagcatttaaggataaagtccagaaataaaatgtccatattttcttttcttttctttttttttttttttttctgtcatctgtcacccagactggactgcagtggtgccatcatgtcttactgcagcctcaaactcctgggctcaagtggtcctcctgcttcagcttcccaagtagctgggactacaggcatgtgccaccacccccagccaaaacatccatattttctattagaatggtttacattatgatgggggatggggagctgggggagggctgtacattcccaaaagaaagtagtgttataggaaatccaaatgcgcttcagtgattcactcctgaaaagcagcctgggtatgttggcagattttgtttgcatttgtcttgcgtatttaaagtctcaggaaatctagtcttggtccaaaacactggagaaaaaaataacaccagacaaaacacatttgagtaacttgaagtagcagcatagaataggcccaactaagaagttggaggggcaaagagaaagccgacagaatcagcttctcctggaaagtgaaagcatcaagttctatttatggtagacagagggtccttatttgcttgtccgtggtgtctatgtgggcctattgagggaatggtagttacttgaaggttcacatatgtaagcgtgtggacccagcacagtctgtgacctgattccagatcctcaagagtggagaaggaaagaaatatgatgatttcctatgcttgaccctaacccaaccccaaaactgctagggattcaacagtgagtaagatgtatgcaataagagaacagataacttctcaacaatgtgcatgccgtttgtgtagatgttcagaactacatatgtgtgaatatcactcccaccttacacacgcacacacactgcaatcacatggcattaaaaaatatattgtgtatggaacttggcgaggtcagtcaggacctggagctgtaatcatagccttattgccacttcttgcgttgtgtatacattgaatggctcatagattttaagagatttttttattgtaagtatttctactaaatgcacttatccttctatatgtttatatattttggtaaaattgatttatcagatacttggtattttagtaagaaaatttcctcaaatatttggctaatgctttgatgtcaagattgcatattgctgagttggagctcagaagaaatgtatgcagctaaaaattgcactgtgtgttcttgtgaatttgctcacaattctaaaatgacataattggtggctgtgatgcttacagtcactgcctactggctctcttatgatgaatgttgccatcatatgatcatttatttactttttgtgcaagcaatggcattttggttgttgccaaaaacaacacaagtggttgggagtgtatgttgttggaaggtgtacacttctgtttctttcagctgtattatttatacacccaggttttctgttaaggatgtaatcattcattcaagaaagaacaattggcaagaaataattaaattaccttaaaaagaattaagaggcactccagccagataacacctcccaacaacatgaaatttagttagtgcttagtgaaattccttaaatatatatgtatatgttttcttcaacattatttaatataactactgcttttatattttttaatggtgttgcaaccacttgtacacctgctacaccttactgacaaaactgggcagctgaaaataaaagagaataaattctattccactgtaagaagttgatttcttttcagctttctttgtatatcagtaaagaacacgaattgtttgaaaataattttaagtctgataagtatggatagcatgttacctaagcttttaatttgtacattttgatgtctgatcatttgcatggaagagacaatagtgccacgtctgaattgttctcttgtgcttggttaatatgtacttctctagattgttcaaaaagtttcaaatgacattccttactctttggttttcagaggcattcaagcaaaatatcacagtggtcttttgttttctgaccaatctaacaatacctgtgattaaatttaatttgttagtgtaaataaatttcttgccaatgagtattattgttgttagacaacgaatgcaataaaaagaaatactgaggtctgttgaagc

SEQ ID NO: 171129 - DNA, 512 bp, Homo sapiens
  Payload ID: 13671
  Gene Symbol: PPP1R9A
  Gene Name: protein phosphatase 1, regulatory subunit 9A
  ENST ID: ENST00000422324
  CDS Start-End: 389-512
gcggccgccgcagccgccctacgcgctgcgccgtgaggagcgggttgcggtgtacccagcgggccggcgccgagccgagccgccgcgtccaccgtggggcggggggcgcctgcgaggagggggtgggagccgcggcggcccgaccctccccgcccgcggcgctcccgctcggatgaacctctagtcttgctttgaaaaaatcattctgtgtaactcttgactgtgactaagttcctaatacacctgttgggacgatcactgacaccgtataccatttgagaggtacttttcttgacccaatactggtgattagagaagagaggtatcttggtttttggtttttttctttgatcattatgaacattggcttttcacccctgaagtgaaaatgttgaaaactgagtcttcaggtgaacgaaccactctcagaagtgcctctcctcacaggaatgcatatcgaactgagtttcaggcactgaaaagtacctttgacaaacccaagtcagatgggg

SEQ ID NO: 171130 - DNA, 9928 bp, Homo sapiens
  Payload ID: 13671
  Gene Symbol: PPP1R9A
  Gene Name: protein phosphatase 1, regulatory subunit 9A
  Uniprot ID: Q9ULJ8
  ENST ID: ENST00000433881
  CDS Start-End: 533-3829
attatcagtgggatctattgtttcctggcacattgggaggaaaaacaaagggatttattttcattaccctgtaattttttttcttttctatttttttaaatgtggccagggagctcgtctctctccgtgtcacagtgggatccgcctggcagccgccgggagctgcagccaatgtgttaggacttcaggtgcttcttggcacaaagctagactgcgacctcctaccatagcgcttggcgtcacctgctctcccggtcctgccccagggccgagggattgcgtcccgaaccgggcttgggaatcggctgcctctcaaatgaacctctagtcttgctttgaaaaaatcattctgtgtaactcttgactgtgactaagttcctaatacacctgttgggacgatcactgacaccgtataccatttgagaggtacttttcttgacccaatactggtgattagagaagagaggtatcttggtttttggtttttttctttgatcattatgaacattggcttttcacccctgaagtgaaaatgttgaaaactgagtcttcaggtgaacgaaccactctcagaagtgcctctcctcacaggaatgcatatcgaactgagtttcaggcactgaaaagtacctttgacaaacccaagtcagatggggaacaaaaaacaaaagaaggtgagggctcccagcagagcagggggaggaaatatggctccaatgtcaacagaattaaaaacctatttatgcagatgggtatggaacccaacgagaatgctgcagtcattgccaaaacaagggggaaaggtggacattcatctcctcagagaagaatgaagcccaaagaatttctggaaaaaacagatggctcagttgttaagttggagtcttctgtttctgaacgaattagtagatttgacactatgtacgatggcccttcatattccaagttcactgagactcgaaagatgtttgagagaagtgtgcatgaatcaggacagaacaaccgctattccccaaagaaagagaaagctggagggagtgaacctcaggatgaatggggaggttccaagtccaacagaggcagtactgattccttggacagccttagctcccgaactgaggctgtctccccaactgtgagtcaactgagtgcagtatttgagaacactgattctcccagtgccatcatttctgagaaggctgaaaacaatgaatactcagtgactgggcattatcccttgaatttaccatctgttactgttacaaatcttgacacatttggtcacctgaaggattctaattcctggcctccttcaaacaagcgaggtgttgatacagaggatgctcacaagagtaatgcaactccagtaccagaagtggcttctaaaagtacctctctagcttcgatacctggtgaagagatccagcagagcaaggaacccgaggactccacatctaatcaacagactcccgacagcattgacaaagatggtcctgaagaaccttgtgctgaaagtaaggcaatgccaaagtccgaaatcccttcaccacaaagccaactgttagaagatgctgaagctaatttggttggaagggaggcagcaaagcaacagaggaaagaacttgcaggtggtgatttcacctctcctgatgcttctgcatccagttgtggaaaagaagtacctgaagattcaaataattttgatggttcccatgtgtacatgcacagtgactataatgtgtatagggtgagatccaggtataattcagactggggagagacaggcactgagcaggatgaggaggaagatagtgatgagaacagttactatcagcctgatatggagtactcggaaattgttggattgccagaagaagaagaaatcccagcaaataggaaaattaagtttagtagtgctcctattaaggttttcaacacatactccaatgaagactatgacaggagaaatgacgaagttgaccctgtggctgcttcagctgagtatgaacttgaaaaacgtgtagaaaagctggaacttttcccagtggagctagagaaagatgaggatggtcttggtataagtattattggaatgggtgttggagcagatgctggacttgaaaagctgggaatattcgtcaagacagtaacagaaggtggtgctgctcaacgggatggcagaatacaagtcaatgaccagattgtggaagtggatggaatcagcttggtgggtgtgacacagaattttgcagcaacagttctcagaaacaccaagggcaacgtcagatttgttattgggcgggaaaaaccaggacaagtgagcgaggttgcccagttgataagccagacactggaacaggagaggcgccagagagagctgctggaacagcactatgcccagtatgatgccgacgatgacgagacaggagaatatgccacagatgaagaagaagatgaggtaggacctgtccttcctggcagcgacatggccattgaagtctttgagctgcctgagaatgaggacatgttttccccatcagaactggacacaagcaagctcagtcacaagttcaaagagttgcaaatcaaacatgcagttacagaagcagagattcaaaaattgaagaccaagctgcaggcagcagaaaatgagaaagtgaggtgggaactagaaaaaacccaactccaacaaaacatagaagagaataaggaaagaatgttgaagttggaaagctactggattgaggcccaaacattatgccacacagtgaatgagcatctcaaagagactcaaagccagtatcaggccttggaaaagaaatacaacaaggcaaagaagttgatcaaggattttcaacaaaaagagcttgatttcatcaaaagacaggaagcagaaagaaagaaaatagaagatttggaaaaagctcatcttgtggaagtgcaaggcctccaagtgcggattagagatttggaagctgaggtattcaggctactgaagcaaaatgggactcaagttaacaataataacaacatctttgagagaagaacatctcttggtgaagtctctaaaggggataccatggagaacttggatggcaagcagacatcttgccaagatggcctaagtcaagacttgaatgaagcagtcccagagacagagcgcctggattcaaaagcactgaaaactcgagcccagctctctgtgaagaacagacgccagagaccctctaggacaagactgtatgatagtgttagttccacagatggggaggacagtctagagagaaagaattttaccttcaatgatgacttcagtcccagcagtaccagttcagcagacctcagcggcttaggagcagaacctaaaacaccagggctctctcagtccttagcactgtcatcagatgagagcctggatatgatagatgacgagatccttgatgatggacagtctcccaaacacagtcagtgtcagaatcgggccgttcaggaatggagtgtgcagcaggtttctcactggttaatgagcctaaatctggagcagtatgtatctgaattcagtgcccaaaacatcactggagaacagctcctgcagttggatggaaataaacttaaggctcttggaatgacagcatcccaggaccgagcagtggtcaaaaagaaactcaaggaaatgaagatgtctctagagaaggctcggaaggcccaagagaaaatggaaaaacaaagagaaaagctaaggagaaaggagcaagagcaaatgcagaggaagtccaaaaagacagaaaagatgacgtcaactacagccgagggtgctggtgagcagtaacacataccctcttacagatgatggagatgctccaagagaagtccccacctcttcctgccctgctctcctccagaggatgaaaaagaaactaaatgataagggtaatgcggctctaggccggctgaggaactgtgtgttgaataactgcattttctgcaatagaatgcactcttaattttaactactaaaataatcccaagccacctttggttcattaacaaaccagagatttcatttaagtagctgtgttttgctcttctctaacttaccaacatcttgtgttgtgttgggtgtgttttgtcacttggagaactagtgtgaccccacccaagagcatgacacaccctggtgttgttaatggagcgccgtgaattttcagtgtgggatcctgaaatggcaattgcacatgtctgcatggcagagagcaccctgccatgagatctgagaccagtacttaacttctaggactgcaacacctactccaatgtgtgggaaagatttgctcttaattctcagtctggacagtgagaccaccccgctgtggaaacatgggtgctctgctctgtagttacctactaagggaaaaggcaagcaagtcattctgcttgctaggcatcaaaaagaaagaaaataaattatagctatttgttaaccactgaaaaaagcaaaagccttaagaatgtggatgtgggtattaccttggggttctgagggtaatatttatcctctagatacggctgaacaagaaagaaaaaaatcagacattaatgcagccatgggatattgggatctgttgaccttgctactgctgtgtgttcagcatttcagcaacactggcaaacacaacacagttcctcttccccctacctaacccaagaaattgaacaggaaattgatttttaaggaaaccaccattttcaggtttcctctcctggggaacattctggctggtcttcagcctgcctatgtcacaatcaggaactcatcacatattttctactcaagatttcccaggtgggctcagttagtattttaacaaatgtacttttaagaaaaatagaaataccagttagaggaaactgtcagttaacattttagagagattttgaatggtttttccgaaccattcctttccatacttcaaagattctcaattttacagaaaaagtttgtttaaggcagtgcataggtatactttagtagtggaggaacttatactaattttaagccagcattaaggatttccatgtttcaccaaactaagtcaagtgcaggagactggggcagaagaaggagaaaataaactcgttttgagaaatttcatgtgatgagggttttttgttttttatgctcatgtatctggttctctttgctgcgttgactctaaaaatgaggttatccactttccaaaggacaagtttcagaataagacttgaggccacatgaattcttggacagtattttacttcttttactttatgggaatctctgctctgttcccagcatctcgtatcttccactagaagtattccatatttagagcctcggcaaggcttttgagtgtaacagattaagggaactcccttgtagccccatcttgtattttaataacagtgtgatttttttttatctgaaaatctgaattcagaaattatctaaactggacatttttaattctgttttacccccaaggcctgttttcttttcattgccagagtattgtcggttatgcgtcagctcttttgtcattaggtacagacccttcattcaatcctcagaaacgttgacatgaagtaacattgtgttttacagttatcaaagtcaccattatgtttttctgtctgtcttcattaggggtatgataatgaaactgccgtattggatactctattaatgtcttgagatgtctggtgctttgttattttttcacatcatgagaaataagaagccactattaatgagtgatacaatttggcaaaacttttcaaatactaaaacactaaattagtaaaaatctggtaatattagtgcttgctattgtaaatttttgccatttttgcttatctttgggaaaaaagtgacctggatcacactggaagtttcactgtattcaagagtagaaatagaaggatgattatcttaagttatgtttacactttggtaatatttgaaaatggatgtatatactggaaatgtctgtaagtgtcttgtttttgcacctaatttatgatctattatattgcattttcttaaatatcttagaagtatttttctttataactttgtatattgaatgtttagataaatgtccaactgacaatgttataaatcaaattcttattcctaaaatcatttagtattataagtattttgattttttaagttaaattatagtaattttaggccgaagtgagttattttaacattaccacttaaaacggatgaaattgtaaaagtcatttggtttgattgccccacaaagcataagatgtaaactgattaagggtatgaaagcaaagtgaaagacctcagatcttgtgcacattttgttttcctattatttcttttattgactgtagtgcatgatacctaatcaaggctccaatgtcttgcacaattcctactttaatgctagtggttttcagtgtccttacaatttaacacagaattgttatttcatcaaccttaaaaactgcagtttttattatcagaaaatgaacaaaaagggaatatctggttgctatgaactgattccctaaaggagagctcagtatgattctaacaatagccaaaagtgttttggggtataggttatgctttgttgggagggaatgtgtggtgaggaggccaagctgcagacagaaagcattgtatgagctgtatctgggtcagggtttcccattaaaggatgttagttttataacagattactttgtttaagaccatctcccttcaagtaactcacagtttatgtaatactaatctcattctttttttacctgaatcaggaattttctgcagaatgttaagttagggaagaaacctcatttcatccattctaacactcctgatgaagtccccctttagtttcatgacaataaagctgttctgtggctatcatcctttagctgggattgacaattgatttcacaccctcaacatcacaagctttttttaacccacagcagttcatgattgcagtatgataggtactaaagccaaactcagctttcaactggcacaaaatgggactgtcaccttttgctccattgttgttggaaacaaagtggcaagagggaaaatgaggaaccagatttacctttgccactatctgtgaccctgtaatcatcactagcctgaaatcttaaaatatcccagtcccaagctacaaaaatggtcacaggtggtttgatctagcacctcggccgttagagtttgtgctgaagacaaatttgtctgggttcattgtgcaccagaattagcatgtgcttgaaaattgcattttataaaagggaaatgaaaatttgcatttatatagatactctgattcatgtttaagtgttaaaggttatgcagactaaacttcaagaggagatccagtgtttaacaatagtgttctagaggattctaaaggaagctgccccagcagccctgagagaaccatctatactttggatatgttgtagccccatcattacactgagatatttccatttgagtaactaaaggtactcctgacagagctggagatgaggggcattttggtgggcagtggtcactagggttcacgtcacctacttaatgcaaagaccttagtggtctcagaatgaaaaggtaaaatggaagagaaaagcacagtcctttcctgtcttttcaaatttactttttattaaggatgtacctgtgcactattctaaagctaagcatttaaggataaagtccagaaataaaatgtccatattttcttttcttttctttttttttttttttttctgtcatctgtcacccagactggactgcagtggtgccatcatgtcttactgcagcctcaaactcctgggctcaagtggtcctcctgcttcagcttcccaagtagctgggactacaggcatgtgccaccacccccagccaaaacatccatattttctattagaatggtttacattatgatgggggatggggagctgggggagggctgtacattcccaaaagaaagtagtgttataggaaatccaaatgcgcttcagtgattcactcctgaaaagcagcctgggtatgttggcagattttgtttgcatttgtcttgcgtatttaaagtctcaggaaatctagtcttggtccaaaacactggagaaaaaaataacaccagacaaaacacatttgagtaacttgaagtagcagcatagaataggcccaactaagaagttggaggggcaaagagaaagccgacagaatcagcttctcctggaaagtgaaagcatcaagttctatttatggtagacagagggtccttatttgcttgtccgtggtgtctatgtgggcctattgagggaatggtagttacttgaaggttcacatatgtaagcgtgtggacccagcacagtctgtgacctgattccagatcctcaagagtggagaaggaaagaaatatgatgatttcctatgcttgaccctaacccaaccccaaaactgctagggattcaacagtgagtaagatgtatgcaataagagaacagataacttctcaacaatgtgcatgccgtttgtgtagatgttcagaactacatatgtgtgaatatcactcccaccttacacacgcacacacactgcaatcacatggcattaaaaaatatattgtgtatggaacttggcgaggtcagtcaggacctggagctgtaatcatagccttattgccacttcttgcgttgtgtatacattgaatggctcatagattttaagagatttttttattgtaagtatttctactaaatgcacttatccttctatatgtttatatattttggtaaaattgatttatcagatacttggtattttagtaagaaaatttcctcaaatatttggctaatgctttgatgtcaagattgcatattgctgagttggagctcagaagaaatgtatgcagctaaaaattgcactgtgtgttcttgtgaatttgctcacaattctaaaatgacataattggtggctgtgatgcttacagtcactgcctactggctctcttatgatgaatgttgccatcatatgatcatttatttactttttgtgcaagcaatggcattttggttgttgccaaaaacaacacaagtggttgggagtgtatgttgttggaaggtgtacacttctgtttctttcagctgtattatttatacacccaggttttctgttaaggatgtaatcattcattcaagaaagaacaattggcaagaaataattaaattaccttaaaaagaattaagaggcactccagccagataacacctcccaacaacatgaaatttagttagtgcttagtgaaattccttaaatatatatgtatatgttttcttcaacattatttaatataactactgcttttatattttttaatggtgttgcaaccacttgtacacctgctacaccttactgacaaaactgggcagctgaaaataaaagagaataaattctattccactgtaagaagttgatttcttttcagctttctttgtatatcagtaaagaacacgaattgtttgaaaataattttaagtctgataagtatggatagcatgttacctaagcttttaatttgtacattttgatgtctgatcatttgcatggaagagacaatagtgccacgtctgaattgttctcttgtgcttggttaatatgtacttctctagattgttcaaaaagtttcaaatgacattccttactctttggttttcagaggcattcaagcaaaatatcacagtggtcttttgttttctgaccaatctaacaatacctgtgattaaatttaatttgttagtgtaaataaatttcttgccaatgagtattattgttgttagacaacgaatgcaataaaaagaaatactgagg

SEQ ID NO: 171131 - DNA, 10090 bp, Homo sapiens
  Payload ID: 13671
  Gene Symbol: PPP1R9A
  Gene Name: protein phosphatase 1, regulatory subunit 9A
  Uniprot ID: Q9ULJ8
  ENST ID: ENST00000456331
  CDS Start-End: 217-3978
atgaacctctagtcttgctttgaaaaaatcattctgtgtaactcttgactgtgactaagttcctaatacacctgttgggacgatcactgacaccgtataccatttgagaggtacttttcttgacccaatactggtgattagagaagagaggtatcttggtttttggtttttttctttgatcattatgaacattggcttttcacccctgaagtgaaaatgttgaaaactgagtcttcaggtgaacgaaccactctcagaagtgcctctcctcacaggaatgcatatcgaactgagtttcaggcactgaaaagtacctttgacaaacccaagtcagatggggaacaaaaaacaaaagaaggtgagggctcccagcagagcagggggaggaaatatggctccaatgtcaacagaattaaaaacctatttatgcagatgggtatggaacccaacgagaatgctgcagtcattgccaaaacaagggggaaaggtggacattcatctcctcagagaagaatgaagcccaaagaatttctggaaaaaacagatggctcagttgttaagttggagtcttctgtttctgaacgaattagtagatttgacactatgtacgatggcccttcatattccaagttcactgagactcgaaagatgtttgagagaagtgtgcatgaatcaggacagaacaaccgctattccccaaagaaagagaaagctggagggagtgaacctcaggatgaatggggaggttccaagtccaacagaggcagtactgattccttggacagccttagctcccgaactgaggctgtctccccaactgtgagtcaactgagtgcagtatttgagaacactgattctcccagtgccatcatttctgagaaggctgaaaacaatgaatactcagtgactgggcattatcccttgaatttaccatctgttactgttacaaatcttgacacatttggtcacctgaaggattctaattcctggcctccttcaaacaagcgaggtgttgatacagaggatgctcacaagagtaatgcaactccagtaccagaagtggcttctaaaagtacctctctagcttcgatacctggtgaagagatccagcagagcaaggaacccgaggactccacatctaatcaacagactcccgacagcattgacaaagatggtcctgaagaaccttgtgctgaaagtaaggcaatgccaaagtccgaaatcccttcaccacaaagccaactgttagaagatgctgaagctaatttggttggaagggaggcagcaaagcaacagaggaaagaacttgcaggtggtgatttcacctctcctgatgcttctgcatccagttgtggaaaagaagtacctgaagattcaaataattttgatggttcccatgtgtacatgcacagtgactataatgtgtatagggtgagatccaggtataattcagactggggagagacaggcactgagcaggatgaggaggaagatagtgatgagaacagttactatcagcctgatatggagtactcggaaattgttggattgccagaagaagaagaaatcccagcaaataggaaaattaagtttagtagtgctcctattaaggttttcaacacatactccaatgaagactatgacaggagaaatgacgaagttgaccctgtggctgcttcagctgagtatgaacttgaaaaacgtgtagaaaagctggaacttttcccagtggagctagagaaagatgaggatggtcttggtataagtattattggaatgggtgttggagcagatgctggacttgaaaagctgggaatattcgtcaagacagtaacagaaggtggtgctgctcaacgggatggcagaatacaagtcaatgaccagattgtggaagtggatggaatcagcttggtgggtgtgacacagaattttgcagcaacagttctcagaaacaccaagggcaacgtcagatttgttattgggcgggaaaaaccaggacaagtgagcgaggttgcccagttgataagccagacactggaacaggagaggcgccagagagagctgctggaacagcactatgcccagtatgatgccgacgatgacgagacaggagaatatgccacagatgaagaagaagatgaggtaggacctgtccttcctggcagcgacatggccattgaagtctttgagctgcctgagaatgaggacatgttttccccatcagaactggacacaagcaagctcagtcacaagttcaaagagttgcaaatcaaacatgcagttacagaagcagagattcaaaaattgaagaccaagctgcaggcagcagaaaatgagaaagtgaggtgggaactagaaaaaacccaactccaacaaaacatagaagagaataaggaaagaatgttgaagttggaaagctactggattgaggcccaaacattatgccacacagtgaatgagcatctcaaagagactcaaagccagtatcaggccttggaaaagaaatacaacaaggcaaagaagttgatcaaggattttcaacaaaaagagcttgatttcatcaaaagacaggaagcagaaagaaagaaaatagaagatttggaaaaagctcatcttgtggaagtgcaaggcctccaagtgcggattagagatttggaagctgaggtattcaggctactgaagcaaaatgggactcaagttaacaataataacaacatctttgagagaagaacatctcttggtgaagtctctaaaggggataccatggagaacttggatggcaagcagacatcttgccaagatggcctaagtcaagacttgaatgaagcagtcccagagacagagcgcctggattcaaaagcactgaaaactcgagcccagctctctgtgaagaacagacgccagagaccctctaggacaagactgtatgatagtgttagttccacagatggggaggacagtctagagagaaagccatcaaacagtttctataaccacatgcatattaccaaattacttccacctaagggtttgagaacgtcttctccagaatcagattctggtgttccacccctcaccccggtggatagcaatgtgcccttctcgtctgaccacatagctgaatttcaagaagaaccactggacccagaaatggggcctctctcctctatgtggggagacacttcactgttttctacttcaaagtctgatcatgatgtggaagaatctccttgccatcaccaaaccaccaacaagaaaatattacgagaaaaagatgatgccaaagatcccaaatcactaagggcatccagttcattggcggtgcaaggaggaaaaattaagcggaagtttgtggatctgggggcgcctttgcgaaggaattccagcaagggaaagaagtggaaagaaaaagaaaaagaagccagtaggttttctgcaggtagcaggatcttcagaggcagactggaaaactggacacccaagccatgttcaacagctcagacctccactcgttccccttgcatgcctttctcatggtttaatgacagccggaaaggatcctattccttcaggaacctgcctgcgcctacaagttcccttcagccttctcctgagactctaatttcagataaaaaggggtccaagaattttaccttcaatgatgacttcagtcccagcagtaccagttcagcagacctcagcggcttaggagcagaacctaaaacaccagggctctctcagtccttagcactgtcatcagatgaggctcttggaatgacagcatcccaggaccgagcagtggtcaaaaagaaactcaaggaaatgaagatgtctctagagaaggctcggaaggcccaagagaaaatggaaaaacaaagagaaaagctaaggagaaaggagcaagagcaaatgcagaggaagtccaaaaagacagaaaagatgacgtcaactacagccgagggtgctggtgagcagtaacacataccctcttacagatgatggagatgctccaagagaagtccccacctcttcctgccctgctctcctccagaggatgaaaaagaaactaaatgataagggtaatgcggctctaggccggctgaggaactgtgtgttgaataactgcattttctgcaatagaatgcactcttaattttaactactaaaataatcccaagccacctttggttcattaacaaaccagagatttcatttaagtagctgtgttttgctcttctctaacttaccaacatcttgtgttgtgttgggtgtgttttgtcacttggagaactagtgtgaccccacccaagagcatgacacaccctggtgttgttaatggagcgccgtgaattttcagtgtgggatcctgaaatggcaattgcacatgtctgcatggcagagagcaccctgccatgagatctgagaccagtacttaacttctaggactgcaacacctactccaatgtgtgggaaagatttgctcttaattctcagtctggacagtgagaccaccccgctgtggaaacatgggtgctctgctctgtagttacctactaagggaaaaggcaagcaagtcattctgcttgctaggcatcaaaaagaaagaaaataaattatagctatttgttaaccactgaaaaaagcaaaagccttaagaatgtggatgtgggtattaccttggggttctgagggtaatatttatcctctagatacggctgaacaagaaagaaaaaaatcagacattaatgcagccatgggatattgggatctgttgaccttgctactgctgtgtgttcagcatttcagcaacactggcaaacacaacacagttcctcttccccctacctaacccaagaaattgaacaggaaattgatttttaaggaaaccaccattttcaggtttcctctcctggggaacattctggctggtcttcagcctgcctatgtcacaatcaggaactcatcacatattttctactcaagatttcccaggtgggctcagttagtattttaacaaatgtacttttaagaaaaatagaaataccagttagaggaaactgtcagttaacattttagagagattttgaatggtttttccgaaccattcctttccatacttcaaagattctcaattttacagaaaaagtttgtttaaggcagtgcataggtatactttagtagtggaggaacttatactaattttaagccagcattaaggatttccatgtttcaccaaactaagtcaagtgcaggagactggggcagaagaaggagaaaataaactcgttttgagaaatttcatgtgatgagggttttttgttttttatgctcatgtatctggttctctttgctgcgttgactctaaaaatgaggttatccactttccaaaggacaagtttcagaataagacttgaggccacatgaattcttggacagtattttacttcttttactttatgggaatctctgctctgttcccagcatctcgtatcttccactagaagtattccatatttagagcctcggcaaggcttttgagtgtaacagattaagggaactcccttgtagccccatcttgtattttaataacagtgtgatttttttttatctgaaaatctgaattcagaaattatctaaactggacatttttaattctgttttacccccaaggcctgttttcttttcattgccagagtattgtcggttatgcgtcagctcttttgtcattaggtacagacccttcattcaatcctcagaaacgttgacatgaagtaacattgtgttttacagttatcaaagtcaccattatgtttttctgtctgtcttcattaggggtatgataatgaaactgccgtattggatactctattaatgtcttgagatgtctggtgctttgttattttttcacatcatgagaaataagaagccactattaatgagtgatacaatttggcaaaacttttcaaatactaaaacactaaattagtaaaaatctggtaatattagtgcttgctattgtaaatttttgccatttttgcttatctttgggaaaaaagtgacctggatcacactggaagtttcactgtattcaagagtagaaatagaaggatgattatcttaagttatgtttacactttggtaatatttgaaaatggatgtatatactggaaatgtctgtaagtgtcttgtttttgcacctaatttatgatctattatattgcattttcttaaatatcttagaagtatttttctttataactttgtatattgaatgtttagataaatgtccaactgacaatgttataaatcaaattcttattcctaaaatcatttagtattataagtattttgattttttaagttaaattatagtaattttaggccgaagtgagttattttaacattaccacttaaaacggatgaaattgtaaaagtcatttggtttgattgccccacaaagcataagatgtaaactgattaagggtatgaaagcaaagtgaaagacctcagatcttgtgcacattttgttttcctattatttcttttattgactgtagtgcatgatacctaatcaaggctccaatgtcttgcacaattcctactttaatgctagtggttttcagtgtccttacaatttaacacagaattgttatttcatcaaccttaaaaactgcagtttttattatcagaaaatgaacaaaaagggaatatctggttgctatgaactgattccctaaaggagagctcagtatgattctaacaatagccaaaagtgttttggggtataggttatgctttgttgggagggaatgtgtggtgaggaggccaagctgcagacagaaagcattgtatgagctgtatctgggtcagggtttcccattaaaggatgttagttttataacagattactttgtttaagaccatctcccttcaagtaactcacagtttatgtaatactaatctcattctttttttacctgaatcaggaattttctgcagaatgttaagttagggaagaaacctcatttcatccattctaacactcctgatgaagtccccctttagtttcatgacaataaagctgttctgtggctatcatcctttagctgggattgacaattgatttcacaccctcaacatcacaagctttttttaacccacagcagttcatgattgcagtatgataggtactaaagccaaactcagctttcaactggcacaaaatgggactgtcaccttttgctccattgttgttggaaacaaagtggcaagagggaaaatgaggaaccagatttacctttgccactatctgtgaccctgtaatcatcactagcctgaaatcttaaaatatcccagtcccaagctacaaaaatggtcacaggtggtttgatctagcacctcggccgttagagtttgtgctgaagacaaatttgtctgggttcattgtgcaccagaattagcatgtgcttgaaaattgcattttataaaagggaaatgaaaatttgcatttatatagatactctgattcatgtttaagtgttaaaggttatgcagactaaacttcaagaggagatccagtgtttaacaatagtgttctagaggattctaaaggaagctgccccagcagccctgagagaaccatctatactttggatatgttgtagccccatcattacactgagatatttccatttgagtaactaaaggtactcctgacagagctggagatgaggggcattttggtgggcagtggtcactagggttcacgtcacctacttaatgcaaagaccttagtggtctcagaatgaaaaggtaaaatggaagagaaaagcacagtcctttcctgtcttttcaaatttactttttattaaggatgtacctgtgcactattctaaagctaagcatttaaggataaagtccagaaataaaatgtccatattttcttttcttttctttttttttttttttttctgtcatctgtcacccagactggactgcagtggtgccatcatgtcttactgcagcctcaaactcctgggctcaagtggtcctcctgcttcagcttcccaagtagctgggactacaggcatgtgccaccacccccagccaaaacatccatattttctattagaatggtttacattatgatgggggatggggagctgggggagggctgtacattcccaaaagaaagtagtgttataggaaatccaaatgcgcttcagtgattcactcctgaaaagcagcctgggtatgttggcagattttgtttgcatttgtcttgcgtatttaaagtctcaggaaatctagtcttggtccaaaacactggagaaaaaaataacaccagacaaaacacatttgagtaacttgaagtagcagcatagaataggcccaactaagaagttggaggggcaaagagaaagccgacagaatcagcttctcctggaaagtgaaagcatcaagttctatttatggtagacagagggtccttatttgcttgtccgtggtgtctatgtgggcctattgagggaatggtagttacttgaaggttcacatatgtaagcgtgtggacccagcacagtctgtgacctgattccagatcctcaagagtggagaaggaaagaaatatgatgatttcctatgcttgaccctaacccaaccccaaaactgctagggattcaacagtgagtaagatgtatgcaataagagaacagataacttctcaacaatgtgcatgccgtttgtgtagatgttcagaactacatatgtgtgaatatcactcccaccttacacacgcacacacactgcaatcacatggcattaaaaaatatattgtgtatggaacttggcgaggtcagtcaggacctggagctgtaatcatagccttattgccacttcttgcgttgtgtatacattgaatggctcatagattttaagagatttttttattgtaagtatttctactaaatgcacttatccttctatatgtttatatattttggtaaaattgatttatcagatacttggtattttagtaagaaaatttcctcaaatatttggctaatgctttgatgtcaagattgcatattgctgagttggagctcagaagaaatgtatgcagctaaaaattgcactgtgtgttcttgtgaatttgctcacaattctaaaatgacataattggtggctgtgatgcttacagtcactgcctactggctctcttatgatgaatgttgccatcatatgatcatttatttactttttgtgcaagcaatggcattttggttgttgccaaaaacaacacaagtggttgggagtgtatgttgttggaaggtgtacacttctgtttctttcagctgtattatttatacacccaggttttctgttaaggatgtaatcattcattcaagaaagaacaattggcaagaaataattaaattaccttaaaaagaattaagaggcactccagccagataacacctcccaacaacatgaaatttagttagtgcttagtgaaattccttaaatatatatgtatatgttttcttcaacattatttaatataactactgcttttatattttttaatggtgttgcaaccacttgtacacctgctacaccttactgacaaaactgggcagctgaaaataaaagagaataaattctattccactgtaagaagttgatttcttttcagctttctttgtatatcagtaaagaacacgaattgtttgaaaataattttaagtctgataagtatggatagcatgttacctaagcttttaatttgtacattttgatgtctgatcatttgcatggaagagacaatagtgccacgtctgaattgttctcttgtgcttggttaatatgtacttctctagattgttcaaaaagtttcaaatgacattccttactctttggttttcagaggcattcaagcaaaatatcacagtggtcttttgttttctgaccaatctaacaatacctgtgattaaatttaatttgttagtgtaaataaatttcttgccaatgagtattattgttgttagacaacgaatgcaataaaaagaaatactgaggtctgttgaagcaa

SEQ ID NO: 171132 - DNA, 5369 bp, Homo sapiens
  Payload ID: 13671
  Gene Symbol: PPP1R9A
  Gene Name: protein phosphatase 1, regulatory subunit 9A
  Uniprot ID: Q9ULJ8
  ENST ID: ENST00000433360
  CDS Start-End: 283-4407
ctctcccgggattttgctgccgggctccctctctctgcggccctagagttaatcccatcagccgagatgaacctctagtcttgctttgaaaaaatcattctgtgtaactcttgactgtgactaagttcctaatacacctgttgggacgatcactgacaccgtataccatttgagaggtacttttcttgacccaatactggtgattagagaagagaggtatcttggtttttggtttttttctttgatcattatgaacattggcttttcacccctgaagtgaaaatgttgaaaactgagtcttcaggtgaacgaaccactctcagaagtgcctctcctcacaggaatgcatatcgaactgagtttcaggcactgaaaagtacctttgacaaacccaagtcagatggggaacaaaaaacaaaagaaggtgagggctcccagcagagcagggggaggaaatatggctccaatgtcaacagaattaaaaacctatttatgcagatgggtatggaacccaacgagaatgctgcagtcattgccaaaacaagggggaaaggtggacattcatctcctcagagaagaatgaagcccaaagaatttctggaaaaaacagatggctcagttgttaagttggagtcttctgtttctgaacgaattagtagatttgacactatgtacgatggcccttcatattccaagttcactgagactcgaaagatgtttgagagaagtgtgcatgaatcaggacagaacaaccgctattccccaaagaaagagaaagctggagggagtgaacctcaggatgaatggggaggttccaagtccaacagaggcagtactgattccttggacagccttagctcccgaactgaggctgtctccccaactgtgagtcaactgagtgcagtatttgagaacactgattctcccagtgccatcatttctgagaaggctgaaaacaatgaatactcagtgactgggcattatcccttgaatttaccatctgttactgttacaaatcttgacacatttggtcacctgaaggattctaattcctggcctccttcaaacaagcgaggtgttgatacagaggatgctcacaagagtaatgcaactccagtaccagaagtggcttctaaaagtacctctctagcttcgatacctggtgaagagatccagcagagcaaggaacccgaggactccacatctaatcaacagactcccgacagcattgacaaagatggtcctgaagaaccttgtgctgaaagtaaggcaatgccaaagtccgaaatcccttcaccacaaagccaactgttagaagatgctgaagctaatttggttggaagggaggcagcaaagcaacagaggaaagaacttgcaggtggtgatttcacctctcctgatgcttctgcatccagttgtggaaaagaagtacctgaagattcaaataattttgatggttcccatgtgtacatgcacagtgactataatgtgtatagggtgagatccaggtataattcagactggggagagacaggcactgagcaggatgaggaggaagatagtgatgagaacagttactatcagcctgatatggagtactcggaaattgttggattgccagaagaagaagaaatcccagcaaataggaaaattaagtttagtagtgctcctattaaggttttcaacacatactccaatgaagactatgacaggagaaatgacgaagttgaccctgtggctgcttcagctgagtatgaacttgaaaaacgtgtagaaaagctggaacttttcccagtggagctagagaaagatgaggatggtcttggtataagtattattggaatgggtgttggagcagatgctggacttgaaaagctgggaatattcgtcaagacagtaacagaaggtggtgctgctcaacgggatggcagaatacaagtcaatgaccagattgtggaagtggatggaatcagcttggtgggtgtgacacagaattttgcagcaacagttctcagaaacaccaagggcaacgtcagatttgttattgggcgggaaaaaccaggacaagtgagcgaggttgcccagttgataagccagacactggaacaggagaggcgccagagagagctgctggaacagcactatgcccagtatgatgccgacgatgacgagaacactgtggctgaattgcaaggaatgtctggcaactgcaataacaataacaactattttcttaagacaggagaatatgccacagatgaagaagaagatgaggtaggacctgtccttcctggcagcgacatggccattgaagtctttgagctgcctgagaatgaggacatgttttccccatcagaactggacacaagcaagctcagtcacaagttcaaagagttgcaaatcaaacatgcagttacagaagcagagattcaaaaattgaagaccaagctgcaggcagcagaaaatgagaaagtgaggtgggaactagaaaaaacccaactccaacaaaacatagaagagaataaggaaagaatgttgaagttggaaagctactggattgaggcccaaacattatgccacacagtgaatgagcatctcaaagagactcaaagccagtatcaggccttggaaaagaaatacaacaaggcaaagaagttgatcaaggattttcaacaaaaagagcttgatttcatcaaaagacaggaagcagaaagaaagaaaatagaagatttggaaaaagctcatcttgtggaagtgcaaggcctccaagtgcggattagagatttggaagctgaggtattcaggctactgaagcaaaatgggactcaagttaacaataataacaacatctttgagagaagaacatctcttggtgaagtctctaaaggggataccatggagaacttggatggcaagcagacatcttgccaagatggcctaagtcaagacttgaatgaagcagtcccagagacagagcgcctggattcaaaagcactgaaaactcgagcccagctctctgtgaagaacagacgccagagaccctctaggacaagactgtatgatagtgttagttccacagatggggaggacagtctagagagaaagccatcaaacagtttctataaccacatgcatattaccaaattacttccacctaagggtttgagaacgtcttctccagaatcagattctggtgttccacccctcaccccggtggatagcaatgtgcccttctcgtctgaccacatagctgaatttcaagaagaaccactggacccagaaatggggcctctctcctctatgtggggagacacttcactgttttctacttcaaagtctgatcatgatgtggaagaatctccttgccatcaccaaaccaccaacaagaaaatattacgagaaaaagatgatgccaaagatcccaaatcactaagggcatccagttcattggcggtgcaaggaggaaaaattaagcggaagtttgtggatctgggggcgcctttgcgaaggaattccagcaagggaaagaagtggaaagaaaaagaaaaagaagccagtaggttttctgcaggtagcaggatcttcagaggcagactggaaaactggacacccaagccatgttcaacagctcagacctccactcgttccccttgcatgcctttctcatggtttaatgacagccggaaaggatcctattccttcaggaacctgcctgcgcctacaagttcccttcagccttctcctgagactctaatttcagataaaaaggggtccaaggtagaaaacacatggattacaaaagcaaacaagagaaacccaaatccctcctcttcttcaatctttggaaggcattctcaacttatgtctgtagtctggatccaagaaaccaataattttaccttcaatgatgacttcagtcccagcagtaccagttcagcagacctcagcggcttaggagcagaacctaaaacaccagggctctctcagtccttagcactgtcatcagatgagatccttgatgatggacagtctcccaaacacagtcagtgtcagaatcgggccgttcaggaatggagtgtgcagcaggtttctcactggttaatgagcctaaatctggagcagtatgtatctgaattcagtgcccaaaacatcactggagaacagctcctgcagttggatggaaataaacttaaggctcttggaatgacagcatcccaggaccgagcagtggtcaaaaagaaactcaaggaaatgaagatgtctctagagaaggctcggaaggcccaagagaaaatggaaaaacaaagagaaaagctaaggagaaaggagcaagagcaaatgcagaggaagtccaaaaagacagaaaagatgacgtcaactacagccgagggtgctggtgagcagtaacacataccctcttacagatgatggagatgctccaagagaagtccccacctcttcctgccctgctctcctccagaggatgaaaaagaaactaaatgataagggtaatgcggctctaggccggctgaggaactgtgtgttgaataactgcattttctgcaatagaatgcactcttaattttaactactaaaataatcccaagccacctttggttcattaacaaaccagagatttcatttaagtagctgtgttttgctcttctctaacttaccaacatcttgtgttgtgttgggtgtgttttgtcacttggagaactagtgtgaccccacccaagagcatgacacaccctggtgttgttaatggagcgccgtgaattttcagtgtgggatcctgaaatggcaattgcacatgtctgcatggcagagagcaccctgccatgagatctgagaccagtacttaacttctaggactgcaacacctactccaatgtgtgggaaagatttgctcttaattctcagtctggacagtgagaccaccccgctgtggaaacatgggtgctctgctctgtagttacctactaagggaaaaggcaagcaagtcattctgcttgctaggcatcaaaaagaaagaaaataaattatagctatttgttaaccactgaaaaaagcaaaagccttaagaatgtggatgtgggtattaccttggggttctgagggtaatatttatcctctagatacggctgaacaagaaagaaaaaaatcagacattaatgcagccatgggatattgggatctgttgaccttgctactgctgtgtgttcagcatttcagcaacactggcaaacacaacacagttcctcttccccctacctaacccaagaaattgaacaggaaattgatttttaaggaaaccaccattttcaggtttcctctcctggggaacattctggctggtcttcagcctg

SEQ ID NO: 171133 - DNA, 555 bp, Homo sapiens
  Payload ID: 13671
  Gene Symbol: PPP1R9A
  Gene Name: protein phosphatase 1, regulatory subunit 9A
  ENST ID: ENST00000413325
  CDS Start-End: 337-555
actgagcctttagaaaagggcggggttcgggggggagtgagctgaaaaactctccctagacaggaaaggtagaagacctcctcatccctttctctttggcagtgagatcttaaggtcaagatgaacctctagtcttgctttgaaaaaatcattctgtgtaactcttgactgtgactaagttcctaatacacctgttgggacgatcactgacaccgtataccatttgagaggtacttttcttgacccaatactggtgattagagaagagaggtatcttggtttttggtttttttctttgatcattatgaacattggcttttcacccctgaagtgaaaatgttgaaaactgagtcttcaggtgaacgaaccactctcagaagtgcctctcctcacaggaatgcatatcgaactgagtttcaggcactgaaaagtacctttgacaaacccaagtcagatggggaacaaaaaacaaaagaaggtgagggctcccagcagagcagggggaggaaatatggctccaatgtcaacagaattaaaaacctatttatgcagatg

SEQ ID NO: 171134 - DNA, 4058 bp, Homo sapiens
  Payload ID: 13671
  Gene Symbol: PPP1R9A
  Gene Name: protein phosphatase 1, regulatory subunit 9A
  Uniprot ID: Q9ULJ8
  ENST ID: ENST00000424654
  CDS Start-End: 245-4006
ggccctagagttaatcccatcagccgagatgaacctctagtcttgctttgaaaaaatcattctgtgtaactcttgactgtgactaagttcctaatacacctgttgggacgatcactgacaccgtataccatttgagaggtacttttcttgacccaatactggtgattagagaagagaggtatcttggtttttggtttttttctttgatcattatgaacattggcttttcacccctgaagtgaaaatgttgaaaactgagtcttcaggtgaacgaaccactctcagaagtgcctctcctcacaggaatgcatatcgaactgagtttcaggcactgaaaagtacctttgacaaacccaagtcagatggggaacaaaaaacaaaagaaggtgagggctcccagcagagcagggggaggaaatatggctccaatgtcaacagaattaaaaacctatttatgcagatgggtatggaacccaacgagaatgctgcagtcattgccaaaacaagggggaaaggtggacattcatctcctcagagaagaatgaagcccaaagaatttctggaaaaaacagatggctcagttgttaagttggagtcttctgtttctgaacgaattagtagatttgacactatgtacgatggcccttcatattccaagttcactgagactcgaaagatgtttgagagaagtgtgcatgaatcaggacagaacaaccgctattccccaaagaaagagaaagctggagggagtgaacctcaggatgaatggggaggttccaagtccaacagaggcagtactgattccttggacagccttagctcccgaactgaggctgtctccccaactgtgagtcaactgagtgcagtatttgagaacactgattctcccagtgccatcatttctgagaaggctgaaaacaatgaatactcagtgactgggcattatcccttgaatttaccatctgttactgttacaaatcttgacacatttggtcacctgaaggattctaattcctggcctccttcaaacaagcgaggtgttgatacagaggatgctcacaagagtaatgcaactccagtaccagaagtggcttctaaaagtacctctctagcttcgatacctggtgaagagatccagcagagcaaggaacccgaggactccacatctaatcaacagactcccgacagcattgacaaagatggtcctgaagaaccttgtgctgaaagtaaggcaatgccaaagtccgaaatcccttcaccacaaagccaactgttagaagatgctgaagctaatttggttggaagggaggcagcaaagcaacagaggaaagaacttgcaggtggtgatttcacctctcctgatgcttctgcatccagttgtggaaaagaagtacctgaagattcaaataattttgatggttcccatgtgtacatgcacagtgactataatgtgtatagggtgagatccaggtataattcagactggggagagacaggcactgagcaggatgaggaggaagatagtgatgagaacagttactatcagcctgatatggagtactcggaaattgttggattgccagaagaagaagaaatcccagcaaataggaaaattaagtttagtagtgctcctattaaggttttcaacacatactccaatgaagactatgacaggagaaatgacgaagttgaccctgtggctgcttcagctgagtatgaacttgaaaaacgtgtagaaaagctggaacttttcccagtggagctagagaaagatgaggatggtcttggtataagtattattggaatgggtgttggagcagatgctggacttgaaaagctgggaatattcgtcaagacagtaacagaaggtggtgctgctcaacgggatggcagaatacaagtcaatgaccagattgtggaagtggatggaatcagcttggtgggtgtgacacagaattttgcagcaacagttctcagaaacaccaagggcaacgtcagatttgttattgggcgggaaaaaccaggacaagtgagcgaggttgcccagttgataagccagacactggaacaggagaggcgccagagagagctgctggaacagcactatgcccagtatgatgccgacgatgacgagacaggagaatatgccacagatgaagaagaagatgaggtaggacctgtccttcctggcagcgacatggccattgaagtctttgagctgcctgagaatgaggacatgttttccccatcagaactggacacaagcaagctcagtcacaagttcaaagagttgcaaatcaaacatgcagttacagaagcagagattcaaaaattgaagaccaagctgcaggcagcagaaaatgagaaagtgaggtgggaactagaaaaaacccaactccaacaaaacatagaagagaataaggaaagaatgttgaagttggaaagctactggattgaggcccaaacattatgccacacagtgaatgagcatctcaaagagactcaaagccagtatcaggccttggaaaagaaatacaacaaggcaaagaagttgatcaaggattttcaacaaaaagagcttgatttcatcaaaagacaggaagcagaaagaaagaaaatagaagatttggaaaaagctcatcttgtggaagtgcaaggcctccaagtgcggattagagatttggaagctgaggtattcaggctactgaagcaaaatgggactcaagttaacaataataacaacatctttgagagaagaacatctcttggtgaagtctctaaaggggataccatggagaacttggatggcaagcagacatcttgccaagatggcctaagtcaagacttgaatgaagcagtcccagagacagagcgcctggattcaaaagcactgaaaactcgagcccagctctctgtgaagaacagacgccagagaccctctaggacaagactgtatgatagtgttagttccacagatggggaggacagtctagagagaaagccatcaaacagtttctataaccacatgcatattaccaaattacttccacctaagggtttgagaacgtcttctccagaatcagattctggtgttccacccctcaccccggtggatagcaatgtgcccttctcgtctgaccacatagctgaatttcaagaagaaccactggacccagaaatggggcctctctcctctatgtggggagacacttcactgttttctacttcaaagtctgatcatgatgtggaagaatctccttgccatcaccaaaccaccaacaagaaaatattacgagaaaaagatgatgccaaagatcccaaatcactaagggcatccagttcattggcggtgcaaggaggaaaaattaagcggaagtttgtggatctgggggcgcctttgcgaaggaattccagcaagggaaagaagtggaaagaaaaagaaaaagaagccagtaggttttctgcaggtagcaggatcttcagaggcagactggaaaactggacacccaagccatgttcaacagctcagacctccactcgttccccttgcatgcctttctcatggtttaatgacagccggaaaggatcctattccttcaggaacctgcctgcgcctacaagttcccttcagccttctcctgagactctaatttcagataaaaaggggtccaagaattttaccttcaatgatgacttcagtcccagcagtaccagttcagcagacctcagcggcttaggagcagaacctaaaacaccagggctctctcagtccttagcactgtcatcagatgaggctcttggaatgacagcatcccaggaccgagcagtggtcaaaaagaaactcaaggaaatgaagatgtctctagagaaggctcggaaggcccaagagaaaatggaaaaacaaagagaaaagctaaggagaaaggagcaagagcaaatgcagaggaagtccaaaaagacagaaaagatgacgtcaactacagccgagggtgctggtgagcagtaacacataccctcttacagatgatggagatgctccaagagaagtccccacctct

SEQ ID NO: 171135 - DNA, 4167 bp, Homo sapiens
  Payload ID: 13672
  Gene Symbol: PPP1R9B
  Gene Name: protein phosphatase 1, regulatory subunit 9B
  ENST ID: ENST00000612501
  CDS Start-End: 118-2571
aaaaggccttcggggtttcttttatcggggggagggggcggtggtcccgacttggccagccgcctgttgaagcgggggagcggggagcaggggcatgcgaacccggctccccccaccatgatgaagacggagccacgggggcccgggggtcccctccggagcgcctccccgcaccgcagcgcctacgaggcgggcatccaggcgctgaagccgcccgacgcgcccgggcccgacgaggcacccaagggggcccaccacaagaaatatggctccaacgtccaccgcatcaaaagtatgttcctgcagatgggcacgacggcggggccctcgggcgaggcgggcggcggcgcgggcctggccgaggccccacgggcgtccgagcgcggcgtgcgcctgtcgctgccgcgggccagcagcctgaacgagaacgtggaccacagcgccctgctgaagctgggcaccagcgtgtcggagcgcgtgagccgcttcgactccaagcccgcgccctccgcgcagcctgcgccgccgccgcacccgccgtcccggctgcaggagacgcggaagctgttcgaacggagcgccccagcggccgcaggcggcgacaaggaggccgcggcgcggcggctgctgaggcaggagcgcgccggcctgcaggaccggaagctggacgtcgtggtgcgcttcaacggcagcaccgaggcgctggacaagctggacgctgacgccgtgtcccccacggtcagccagctcagcgccgtcttcgagaaggccgactcgaggaccggcctccaccgcgggcccgggctccccagggccgcaggggttccccaggtcaactcgaagctggtcagcaagcggtcccgggtgttccagcccccgccgccgccgccgcccgccccgtcgggggatgccccggccgagaaagagcgatgccccgcagggcagcagcccccgcagcaccgagtggcccctgcccggccgccccccaagccccgggaggtgcgcaagattaagccggtggaggtggaggagagcggggagtcggaggccgagtcggcgcccggggaggtgatccaggccgaggttacggtccacgcggccctggagaatggcagcaccgtggcaactgcagccagccccgcgcccgaggagccaaaggcccaagcggccccggagaaggaggcggcggcggtagcgccgccagagaggggggtgggcaatggccgggccccggacgtggcccctgaggaggtagatgaatccaagaaggaggacttctcggaggcggacttggtggacgtgagcgcctacagtgggctcggggaggactctgcgggcagtgccctggaggaggacgacgaagacgacgaggaggatggggagcccccctacgagcccgagtcggggtgcgtggagatcccggggctgtcggaggaggaggacccagccccgagccggaagatccatttcagcacggcgcccatccaagtgttcagcacttactccaacgaggattacgatcgtcgcaacgaggatgtggatcccatggcagcctctgctgagtacgagctggagaagcgtgtggagaggttggagctgttccctgtggagctggagaaggactccgagggcctgggcatcagcatcatcggcatgggcgccggggcagacatgggcctggagaagctgggtatcttcgtcaagaccgtgacggagggtggtgcggcccatcgggatggcaggatccaggtgaatgatctcctggtggaggtggatggaacaagtctggtgggagtgacccagagcttcgcggcgtctgtgctccggaacaccaagggccgagtgcggtttatgattggccgggagcggccgggagagcagagcgaagtggcccagctaattcagcagactttggaacaggagcgatggcagcgggagatgatggagcagagatacgcccagtatggggaggatgacgaggagacgggagagtatgccactgacgaggatgaggagctgagccccacgttcccgggtggtgagatggccatcgaggtgtttgagctagcggagaacgaggatgcactgtcccctgtggacatggagcccgagaagctggtgcacaagttcaaggagctccagatcaagcatgcggtcactgaggcagagatccagcagctgaaaagaaagctgcagagcctggagcaggagaaggggcgctggcgggtggagaaggcgcagttggagcagagtgtggaggagaacaaggagcgcatggagaaactggaaggctactggggtgaggcccagagcctgtgccaggctgtggacgagcacctgcgggagactcaggcgcagtaccaggccctggagcgcaagtacagcaaggccaagcgcctcatcaaggactaccagcagaaggagatcgagttcctgaaaaaggagactgcacagcgtcgggttctggaggagtcggagctggccagaaaggaggagatggacaagctcctggacaagatctcagaactggaaggaaacttgcaaacactgaggaattccaattctacttaacaggaatcattccatgactggacaataattaacccccctcccattgtcctccctcccctgtcctcaacaccccacccctcccccttccagcctggggacaggtgccccgactccccccacccctccaccccacctcccccagcttcagggaccagagggctcatatcacaggcccccttaagatggcctgggcagacagaggtggctagaagggcagcctctttcttgccccatggggctgaggcacagaggccgagggctgccgagggctggcctggtggtcgacggacacaagcacctgcagatcaaactgccagactttacacactccagcttttgtctctggactggaacggggctggggctctcccagcatctgccaactgggggctgctccctgcccatggggcacctgggtggcccctgggcctcttgacttgagattctaccttctcggcccttccctctccccccatcattgtgccgtctctgttgcattctgaccctcccgcctggggggtgggggcgttgcctcaacacctcccccatccctgttccctgtcctgggagggatagagtccaccccagagcccggaggctgggcctggccctggccctgcactgatttctcatgtgtccttcgggaaaagggggagtgagagtgggaaaaagggagagttcaggacacctggtccccagctccccattgcctggggcagcagccctcaatttctccttgtgcctcccctcttccaggtgccaaatagccataacctcgtcttggaactgttatgtggcctctctggggtccaggtttcctggtcaagcctgggaatgccagggaggaaagggggtctggctacagcgaccctggtcttaggcaaggggaacatttctccctggagagtcaggtcctatcctgtgctgccctgtctgcccagcccagggcgatgcctggaagcctactgacattgcagggagtcagcctcgcccccaccccctactggttttccaatgttttgactggagggcaaaattttactactactcatctttttggagaccagggctgccctgctggcagcctgccttctaagtgaaatcgactctgtttccccactttaaccccaaattggggcttggaccaagggaggtgagaccacctcccccaggtcccctcccctttcaaaatccatctcattttgccacttcatgcccctgccctaactgggtttttgttcattttttaaaaacagaccacccatcccatccgttttggcttcttgtcccctgtaaatagaccatgacttcgatcagtatttcttgtccccaccccttcctatccccagatgtgcccccatcccctgaaggagctggctgtctcagtcctgggctcgcgcacttcaccccggcagatggagggggcggaaccgggtgggcggggccgcttcgggctgcttgggccagcggccacccctgcccagccgtcgggagggccgcatctctgtatataatatatatatgtatgtattgttcccggttttgtacggaccatgccctctgtcaggtcgtccccataaaagcagcccccagagc

SEQ ID NO: 171136 - DNA, 4649 bp, Homo sapiens
  Payload ID: 13673
  Gene Symbol: PPP2CA
  Gene Name: protein phosphatase 2, catalytic subunit, alpha isozyme
  Uniprot ID: P67775
  ENST ID: ENST00000481195
  CDS Start-End: 282-1211
cttttcccctccgctccccgccgcctcctgacgccgggcgtgacgtcaccacgcccggcggccgccattacagagagccgagctctggagcctcagcgagcggaggaggaggcgcagcggccgacggccgagtactgcggtgagagccagcgggccagcgccagcctcaacagccgccagaagtacacgaggaaccggcggcggcgtgtgcgtgtaggcccgtgtgcgggcggcggcgcgggagcagcgcggagcggcagccggctggggcgggtggcatcatggacgagaaggtgttcaccaaggagctggaccagtggatcgagcagctgaacgagtgcaagcagctgtccgagtcccaggtcaagagcctctgcgagaaggctaaagaaatcctgacaaaagaatccaacgtgcaagaggttcgatgtccagttactgtctgtggagatgtgcatgggcaatttcatgatctcatggaactgtttagaattggtggcaaatcaccagatacaaattacttgtttatgggagattatgttgacagaggatattattcagttgaaacagttacactgcttgtagctcttaaggttcgttaccgtgaacgcatcaccattcttcgagggaatcatgagagcagacagatcacacaagtttatggtttctatgatgaatgtttaagaaaatatggaaatgcaaatgtttggaaatattttacagatctttttgactatcttcctctcactgccttggtggatgggcagatcttctgtctacatggtggtctctcgccatctatagatacactggatcatatcagagcacttgatcgcctacaagaagttccccatgagggtccaatgtgtgacttgctgtggtcagatccagatgaccgtggtggttggggtatatctcctcgaggagctggttacacctttgggcaagatatttctgagacatttaatcatgccaatggcctcacgttggtgtctagagctcaccagctagtgatggagggatataactggtgccatgaccggaatgtagtaacgattttcagtgctccaaactattgttatcgttgtggtaaccaagctgcaatcatggaacttgacgatactctaaaatactctttcttgcagtttgacccagcacctcgtagaggcgagccacatgttactcgtcgtaccccagactacttcctgtaatgaaattttaaacttgtacagtattgccatgaaccatatatcgacctaatggaaatgggaagagcaacagtaactccaaagtgtcagaaaatagttaacattcaaaaaacttgttttcacatggaccaaaagatgtgccatataaaaatacaaagcctcttgtcatcaacagccgtgaccactttagaatgaaccagttcattgcatgctgaagcgacattgttggtcaagaaaccagtttctggcatagcgctatttgtagttacttttgctttctctgagagactgcagataataagatgtaaacattaacacctcgtgaatacaatttaacttccatttagctatagctttactcagcatgactgtagataaggatagcagcaaacaatcattggagcttaatgaacatttttaaaaataattaccaaggcctcccttctacttgtgagttttgaaattgttctttttattttcagggataccgtttaatttaattatatgatttgtctgcactcagtttattccctactcaaatctcagccccatgttgttctttgttattgtcagaacctggtgagttgttttgaacagaactgttttttccccttcctgtaagacgatgtgactgcacaagagcactgcagtgtttttcataataaacttgtgaactaagaactgagaaggtcaaattttaattgtatcaatgggcaagactggtgctgtttattaaaaaagttaaatcaattgagtaaattttagaatttgtagacttgtaggtaaaataaaaatcaagggcactacataacctctctggtaactccttgacattcttcagattaacttcaggatttatttgtatttcacatattacaatttgtcacattgttggtgtgcactttgtgggttcttcctgcatattaacttgtttgtaagaaaggaaatctgtgctgcttcagtaagacttaattgtaaaaccatataacttgagatttaagtctttgggttttgttttaataaaacagcatgttttcaggtagagcttaaactaaatgatgtgtttacttagtgcagtttctggttatgaatattatattgctatgtgtatattatatggactctttaaaatgattgacagattggcaaattcttaaatctttgtacattgttgagtcatatgttcttagagttaaatttgtctcagataagaaagtgttaaagcattagcctgtgtcaagttctttgagtgatactagtgaaaccaaatagaaaactattgttggatcatgatttagtcttatgtacattcacccgaagacaaaaatggtacttaaagtggcagtgttcaacatttaatgagtttttccccttttatccttcgaataggattagatgtttaaaaaaaagttcttctgtgggaactaatatttgatattttaacctaccagagtaaacaggaacacttaatcatacttgtgagtgtagtaaataaaagttttcttgctttgtgctgtgttgaatctggaaccaacagggaagttatagcatatcccctttctaaaatgcttgaggaacacatacataccgaatgtcttttctgatctaattgatagtatttttagtggcttgtggagttaattttccaaagcaaaaggccattagggtttctacatttcatttcatttcattcttttctttcacaagaaatacattctctgtgtgtctttttgttgctctgtcactctatgccctttctctccgactgaacaaatagcttatccatgtgcagtggttttaatacccaaacaatctagacaccaagcagctattttttccggtcctgtgatatcagaattgaccaaggaatacgtatattgtaattgacacgtggtggtatcttccaggtacaaattctctaaattttgtggttagcagaatgggacttgtgataagaatagcttggttttagcataactagggtttaaaataattgtttaattatagagactgaccgggctttggccatctaaactggaaagtgttagtaccctaccttcttttgaaaatggctatggtaaggaaaatgtgttagtaaattatgtattttcttgaaaaatacataattatggttggatgggaatcactaagttgggtgttaactgatgtctcaattagtaacattaggattttcattaataaacctaaaaagctttccctaagaacaggcctggcacagtggctcatgcctgtaatcccagcactttgggagaccagggtgggtggatcccttgaggtcaggagttgaagagcagcctggccaacatggcaaaaccccatctctacaaaaaatatgaaaatcagccgggcttggtggcataccatagtcccagctacttgggaggctgaggtgagaggatcgcctgagcccaggagatggaggttgcagtgggctgagattgtgccactgtactccagtctgggtgacagagccagaccctgtctcaaaaataaagaggattctgagtttgtatagtgagggcttgcagaaattttgaaacttattttgtaagtttacaatgaatttgtacatgatgtgctcatgtcttgggttgagtatcctagacatgattttttcatttgctgcatattaaacatttgttggttgtagtcggtatttcttaaatagaagtttgtcaatattagattagtttcaagaaggacttagctcaggaaaaggatagttatttctgtggttctcagctttgatgcctacagagattctgatttaaattgctggaggagggcccaggcatacattttttaagtttcccaagtgattctaatttacatctagggttaaaaacagccaggcgcggtggctcatgcctgtaatcccagcacttggggaggccggggtgggtggatcacctgatgtcaggagatcgagaccagcctggccagcgtggtgaaaccccatctctattaaaaatacaaaactgaccggtgtggtggcaggagcctgtaatcccagctacttgggaggctgaggcaggagaatcacttgaactcaggaggaggaggttacagtgagcccagatcgtgccattgcactccagcctgggcaaaaagagcaaaactccatctcaaaaaacaaaaacacctcactgctgtttcctaagtacatacttaagaaaattgggatacatggtggtggttcatggatgttgataaggaattaaaatgtaccgtgcgactctctgtttcagtggtgacttttacctgtttagtataaatattcctttgcttccaaccataaatgtgttcttagaaatgggcctatagtttagtaacctatagtttggtaataggcttgtttgttttcagatggattttggttctgtgagctaaagctattttgcattaaagccttcgtcctca

SEQ ID NO: 171137 - DNA, 510 bp, Homo sapiens
  Payload ID: 13673
  Gene Symbol: PPP2CA
  Gene Name: protein phosphatase 2, catalytic subunit, alpha isozyme
  ENST ID: ENST00000523082
  CDS Start-End: 75-510
agatttagatttgtttctcccaagcctgaacaaaactactactagtggatgaggtggcacatcatctgttggagatgccttttaatggtagcgatgtattgaatctcctgtttctttaccctctcacgtcaaatgaggctaaagaaatcctgacaaaagaatccaacgtgcaagaggttcgatgtccagttactgtctgtggagatgtgcatgggcaatttcatgatctcatggaactgtttagaattggtggcaaatcaccagatacaaattacttgtttatgggagattatgttgacagaggatattattcagttgaaacagttacactgcttgtagctcttaaggttcgttaccgtgaacgcatcaccattcttcgagggaatcatgagagcagacagatcacacaagtttatggtttctatgatgaatgtttaagaaaatatggaaatgcaaatgtttggaaatattttacagatctttttgactatcttcctctcactgccttgg

SEQ ID NO: 171138 - DNA, 585 bp, Homo sapiens
  Payload ID: 13673
  Gene Symbol: PPP2CA
  Gene Name: protein phosphatase 2, catalytic subunit, alpha isozyme
  ENST ID: ENST00000522385
  CDS Start-End: 208-585
aaaatggcgccgttcactcgactcctgggcttttgagtcagccggccttggcgccagacgaggtggcagggggagcggagaccctgtgggtcatcgtcagggacggttttgagggctaaagaaatcctgacaaaagaatccaacgtgcaagaggttcgatgtccagttactgtctgtggagatgtgcatgggcaatttcatgatctcatggaactgtttagaattggtggcaaatcaccagatacaaattacttgtttatgggagattatgttgacagaggatattattcagttgaaacagttacactgcttgtagctcttaaggttcgttaccgtgaacgcatcaccattcttcgagggaatcatgagagcagacagatcacacaagtttatggtttctatgatgaatgtttaagaaaatatggaaatgcaaatgtttggaaatattttacagatctttttgactatcttcctctcactgccttggtggatgggcagatcttctgtctacatggtggtctctcgccatctatagatacactggatcatatcagagcacttgatcgcctacaagaagttccccat

SEQ ID NO: 171139 - DNA, 2006 bp, Homo sapiens
  Payload ID: 13674
  Gene Symbol: PPP2CB
  Gene Name: protein phosphatase 2, catalytic subunit, beta isozyme
  Uniprot ID: P62714
  ENST ID: ENST00000221138
  CDS Start-End: 452-1381
cggcggaaatgcccgagcgatgacggaaacccggagggaggggagagaaagagcgagagaaggggaaagacaagtcgggagaggccggtaggcgtgaggcgggcctgaagcggcagcgggcggccttcgtccggcgagagctaggccgaggacccgcgccgcgctccccggcacctcaccgcgtccttcaccgactcccgcggcgcgcggccgggcggggaagggcgggcgggggtctcctccaggctgcgcgctcggagccgcctgctgggcttgggcggggcgcggggcccgcggccgccctacccggctcagtcctccccctgtgggacctggcgacggcggcggagggagaggggagcggcgcccgggccggggccgggggcgggtggggaggggggagggcggcggccgggctggggctcgggatccgcatcgggatcgggccgccatggacgacaaggcgttcaccaaggagctggaccagtgggtcgagcagctgaacgagtgtaagcagctgaacgagaaccaagtgcggacgctgtgcgagaaggcaaaggaaattttaacaaaagaatcaaatgtgcaagaggttcgttgccctgttactgtctgtggagatgtgcatggtcaatttcatgatcttatggaactctttagaattggtggaaaatcaccggatacaaactacttattcatgggtgactatgtagacagaggatattattcagtggagactgtgactcttcttgtagcattaaaggtgcgttatccagaacgcattacaatattgagaggaaatcacgaaagccgacaaattacccaagtatatggcttttatgatgaatgtctgcgaaagtatgggaatgccaacgtttggaaatattttacagatctctttgattatcttccacttacagctttagtagatggacagatattctgcctccatggtggcctctctccatccatagacacactggatcatataagagccctggatcgtttacaggaagttccacatgagggcccaatgtgtgatctgttatggtcagatccagatgatcgtggtggatggggtatttcaccacgtggtgctggctacacatttggacaagacatttctgaaacctttaaccatgccaatggtctcacactggtttctcgtgcccaccagcttgtaatggagggatacaattggtgtcatgatcggaatgtggttaccattttcagtgcacccaattactgttatcgttgtgggaaccaggctgctatcatggaattagatgacactttaaaatattccttccttcaatttgacccagcgcctcgtcgtggtgagcctcatgttacacggcgcaccccagactacttcctataaatttctcctgggaaacctgcctttgtatgtggaagtatacctggctttttaaaatatatgtatttaaaaacaaaaagcaacagtaatctatgtgtttctgtaacaaattgggatctgtcttggcattaaaccacatcatggaccaaatgtgccatactaatgatgagcatttagcacaatttgagactgaaatttagtacactatgttctaggtcagtctaacagtttgcctgctgtatttatagtaaccattttcctttggactgttcaagcaaaaaaggtaactaactgcttcatctccttttgcgcttatttggaaattttagttatagtgtttaactggcatggattaatagagttggagttttatttttaagaaaaattcacaagctaacttccactaatccattatcctttattttattgaaatgtataattaacttaactgaagaaaaggttcttcttgggagtatgttgtcataacatttaaagagatttcccttcatttaaactaaattactgttttatgttgatctgcatatttctgtatatttgtcatgacagtgcttgcatcctatttggtgtactcagcaaataaacttttcattttaaacaaaaacattca

SEQ ID NO: 171140 - DNA, 691 bp, Homo sapiens
  Payload ID: 13674
  Gene Symbol: PPP2CB
  Gene Name: protein phosphatase 2, catalytic subunit, beta isozyme
  ENST ID: ENST00000518564
  CDS Start-End: 177-320
gggcggggcgcggggcccgcggccgccctacccggctcagtcctccccctgtgggacctggcgacggcggcggagggagaggggagcggcgcccgggccggggccgggggcgggtggggaggggggagggcggcggccgggctggggctcgggatccgcatcgggatcgggccgccatggacgacaaggcgttcaccaaggagctggaccagtgggtcgagcagctgaacgagtgtaagcagctgaacgagaaccaagtgcggacgctgtgcgagaaggcaaaggaaattttaacaaaagaatcaaatgtgcaagagtaaccattttcctttggactgttcaagcaaaaaaggtaactaactgcttcatctccttttgcgcttatttggaaattttagttatagtgtttaactggcatggattaatagagttggagttttatttttaagaaaaattcacaagctaacttccactaatccattatcctttattttattgaaatgtataattaacttaactgaagaaaaggttcttcttgggagtatgttgtcataacatttaaagagatttcccttcatttaaactaaattactgttttatgttgatctgcatatttctgtatatttgtcatgacagtgcttgcatcctatttggtgtactcagcaaataaacttttcattttaaacaaaaa

SEQ ID NO: 171141 - DNA, 577 bp, Homo sapiens
  Payload ID: 13674
  Gene Symbol: PPP2CB
  Gene Name: protein phosphatase 2, catalytic subunit, beta isozyme
  ENST ID: ENST00000518243
  CDS Start-End: 26-577
ttttcccggcggaaatgcccgagcgatgacggaaacccggagggaggggagagaaagagcgagagaaggggaaagacaagtcgggagaggccgaattggtggaaaatcaccggatacaaactacttattcatgggtgactatgtagacagaggatattattcagtggagactgtgactcttcttgtagcattaaaggtgcgttatccagaacgcattacaatattgagaggaaatcacgaaagccgacaaattacccaagtatatggcttttatgatgaatgtctgcgaaagtatgggaatgccaacgtttggaaatattttacagatctctttgattatcttccacttacagctttagtagatggacagatattctgcctccatggtggcctctctccatccatagacacactggatcatataagagccctggatcgtttacaggaagttccacatgagggcccaatgtgtgatctgttatggtcagatccagatgatcgtggtggatggggtatttcaccacgtggtgctggctacacatttggacaagacatttctgaaacctttaaccatgcc

SEQ ID NO: 171142 - DNA, 755 bp, Homo sapiens
  Payload ID: 13674
  Gene Symbol: PPP2CB
  Gene Name: protein phosphatase 2, catalytic subunit, beta isozyme
  ENST ID: ENST00000520056
  CDS Start-End: 381-755
gttttgccatgctggccaggctggtctagaactcctggcctgaagtgatccctcagccttccaaagtgctgggattacaggcgcgagcctcgtgcacagcccctattgactttctaataattttaagatgaacttctagagaagaatattgtaccactgctgtactttgaaataatcacaccggagtgtcaacgatcacttgaggaagctttctgtatttgtcaaaagagattatttttacttcggctcctaaataaatcagactaacagttcctaggacttcacaggcaaaggaaattttaacaaaagaatcaaatgtgcaagaggttcgttgccctgttactgtctgtggagatgtgcatggtcaatttcatgatcttatggaactctttagaattggtggaaaatcaccggatacaaactacttattcatgggtgactatgtagacagaggatattattcagtggagactgtgactcttcttgtagcattaaaggtgcgttatccagaacgcattacaatattgagaggaaatcacgaaagccgacaaattacccaagtatatggcttttatgatgaatgtctgcgaaagtatgggaatgccaacgtttggaaatattttacagatctctttgattatcttccacttacagctttagtagatggacagatattctgcctccatggtggcctctctccatccatagacacactggatcatataagagccctggatcgtttacaggaagttcca

SEQ ID NO: 171143 - DNA, 448 bp, Homo sapiens
  Payload ID: 13674
  Gene Symbol: PPP2CB
  Gene Name: protein phosphatase 2, catalytic subunit, beta isozyme
  ENST ID: ENST00000523023
  CDS Start-End: 1-157
cattttcagtgcacccaattactgttatcgttgtgggaaccaggctgctatcatggaattagatgacactttaaaatattccttccttcaatttgacccagcgcctcgtcgtggtgagcctcatgttacacggcgcaccccagactacttcctataaatttctcctgggaaacctgcctttgctggagtgcaatggtgtgatctcggctcactgcaacctccacctcccaagttcaaccgattctcctgcctcagcctcccaaatagctgggattacagacgatgatgatgatgattgagacatgatctcactctgtcacccaggctggagcacagaggtgagatcatggctcactgcaacctcaacctgtggggctccagtgatcctcccacctcagtctccagagtagctgagactacaggtgcaggcaatcacgcctggctaatt

SEQ ID NO: 171144 - DNA, 578 bp, Homo sapiens
  Payload ID: 13674
  Gene Symbol: PPP2CB
  Gene Name: protein phosphatase 2, catalytic subunit, beta isozyme
  ENST ID: ENST00000520334
  CDS Start-End: 1-375
atattctgcctccatggtggcctctctccatccatagacacactggatcatataagagccctggatcgtttacaggaagttccacatgagggcccaatgtgtgatctgttatggtcagatccagatgatcgtggtggatggggtatttcaccacgtggtgctggctacacatttggacaagacatttctgaaacctttaaccatgccaatggtctcacactggtttctcgtgcccaccagcttgtaatggagggatacaattggtgtcatgatcggaatgtggttaccattttcagtgcacccaattactgttatcgttgtgggaaccaggctgctatcatggaattagatgacactttaaaatattccttgtgagtaactgtaaattttaattgtatatactttcagaaggaaaattttaaatgttaaaaatagaagatttctgtttctgaaattggatgaggagtatagcaaagcccctctccagcaaaaataaccattagctggagaacattatttttaaaaaataatttttcaaagcttttggaaattgtcctaagggcatacagcaggtggag

SEQ ID NO: 171145 - DNA, 5380 bp, Homo sapiens
  Payload ID: 13675
  Gene Symbol: PPP2R1A
  Gene Name: protein phosphatase 2, regulatory subunit A, alpha
  Uniprot ID: P30153
  ENST ID: ENST00000322088
  CDS Start-End: 59-1828
ccccccacgtttcagcacagcgctggccgcagtctgacaggaaagggacggagccaagatggcggcggccgacggcgacgactcgctgtaccccatcgcggtgctcatagacgaactccgcaatgaggacgttcagcttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactgttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctcccccatttacttctccacctcccgtcctccccatcattggtttttttttgtgtgtcaactgtgccgtttttattttattccttttattttcccccttttcacagagaaataaaggtctagaagtagttggtcctctggccttagtcatcagcttggaggagggggcaccaccccagagccacaacatctgcgcttttctctggagaagatcttgttacaggacccattatacccctatgtcccgaaagaatactctggggatccccccaggagtgctgctggcctttggggtagagggtccatgaggtgctctgggtggtgtcctgtagtgcagttcagattcatagatgtcggccgagtatttggggggttaagagcaggtgccttggaaccagactgcctgggtccaaattgtggctccttcagttaatagacgtgtgactaggagtagcttgttaagtctttatgagctcagttttgtattgtgtaaaatgagagttacagtaatacctagattgcagggtgggtggcgaggaccaagtgaattagtacctggaaagtgtgtaacagtttcaacatgagaagtacacaacatgagaagcagagttagctgtacattgccagagaaccccctgtgggccatttcctgtgttcttgaagaagacttgggcttggaccctgtccccaggaggtctcagagtaatcaggacggtactagggagagaactgtggcaagatagatcagttatctcggtatctattctccccttcctaatgtagaagctctgatttttaactgggcagatgactacatggattcaaggtattttcctagtgtctcttgaaattaggtgtggtattgtgaccaaattctagccaaaaagatgttgaacagaagtggtatatgcagcttctaggaagtgttcttaagggggaaggcgtcatcccccacctttcctccttcctgcactctggaatgtggaccagatggctggagtaggagctgccacctggggccagaaaatgatcttaggcgtgaaggtcaagtaaggcaggacaagagagaaggagcctgcctccccgaggctgtgaagagccatgccagtactgtcacctgggagaattaaactggtcaagtgcctgttcgtttagggtttcatcacttgaaggtgaccggaattctaactgatggagggaggggcccagagcaccctggagaaaggagcaagggacgtatggctggtggtgtctgcatggaagggtttcacagaggaaatgatgcttgagcacattttgacccaggtggtggaagggaaatgtggctttgagtgacaaggtgatttcaccagctcagccttcatattaccacatccctaccctttgttagactttattgtgccctaggggatgaggctgaaggagaccaaaaagcatctttagaaatttccatttatgccctgggcgataaactctctcccagttgagaactactgctctagaaatgtgaacacacgtgtaaccaaacgtcaaagtctgacattaaactttgactttccccatggttaacgctgctggtccattgtaacaagagtgcagtggaccagcagcctttgcattctcaggagcttgttagaaatgcagagcctctcgtccctgccccgacctgctcaggcagagccttcattttaacaagatgcccaggttcatctgcacactgaagttagagaagtcctgccttaaatactaacccagtttttctctcttgagagtgaggttaatgctacgtgggtctagggctgaggatgtgctatggctcagaggtggggtctacaattggacatgtgtatgtagacaaggctcagggatatgttgaggctgctagattgggcaagtgatggaatgggattattacaggaggtggaggtgcgatggatacccaggatgtgctgggtaatgaggtgatactcagcgaccacaggagtgagtatgagagacgagggtgaaggatagcttgagttattgaacgctggcagagtcctgagttaaccaggagttgcctggtgtcttgggtcatgtgctctagaagcagagcccgagtggagactcgttcaagtgtgttactgagggagtgctctcaggagaacggactgaggtaactcaccttctgtgagcttcatgttggaagaatccaatcaggtgatgaatgtgatgttattaagtccattgttaggagtggttcctaatctcccaggctgcaggctttgtttgctccatacacctggccttctctgtagcagctgaagtttgatgctggagctgggtcagggtggagagactgtgtggagccaggactcatgaccctggcctgtttctcccgctctctaggcctaaatcccagcagtcacactggccatctctaatggttccttccacagcactgttcttcagagcccacacacaaattttgtctccttttgtgatgactgcacttctttggctgtttttgccaacagcctcttcactgaccccttccttccactgcattgacccagacatctggatgtggatgaggtcgagtcacttgttgcctttggctaatgcataggggcacgagtagagctctagaatcaccatgcccttgactcagggtgcagaatctgcctatggtgcttgagctgtggttgtcgctagaggagaattaccatggctcccccgggcagatgaagatgacgaggtggtgcctcagccccgaggagtgaactgcagggcaccgacaagattctgcctgtggccatcagggctggagggaaggaggccaggttcatctacccaagctggtggcatgaggcataaatttaaaaaaattggtgtgggcacagtggctcgcacctgtaatcccagcgctttgggaggccgaggtgggcggatcacctgaggccgggagttcgagaccatcctgaccaattcagtgaaaccctgtctttactaaaaatatgaaaaaattagctgggcgtggtggagggcgcctgtaatcccagctactcaggaggctgaggcgggaggattgcttgaacctgggaggcagaggttgcagtgagcctagattgggccattgcactccagccagggtgacagagcaagaccccatatgaaaaaaaataataattcaggaacttgtcaaaaagagaaaatccaataaagatttagtgccaggccttgactccagcaggccttccccgc

SEQ ID NO: 171146 - DNA, 979 bp, Homo sapiens
  Payload ID: 13675
  Gene Symbol: PPP2R1A
  Gene Name: protein phosphatase 2, regulatory subunit A, alpha
  ENST ID: ENST00000391791
  CDS Start-End: 1-397
tgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactggtaagacctagaaagcacggagccctagcaggagggtggactttgaggacaggcactgggcctgtgggcagcagcttctgggagggggaggtaccttggcattgtgggcagagagagggctctggttctgattcttgcctgttcctgttttcctagttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctcccccatttacttctccacctcccgtcctccccatcattggtttttttttgtgtgtcaactgtgccgtttttattttattccttttattttcccccttttcacagagaa

SEQ ID NO: 171147 - DNA, 1233 bp, Homo sapiens
  Payload ID: 13675
  Gene Symbol: PPP2R1A
  Gene Name: protein phosphatase 2, regulatory subunit A, alpha
  ENST ID: ENST00000454220
  CDS Start-End: 47-1233
cagcacagcgctggccgcagtctgacaggaaagggacggagccaagatggcggcggccgacggcgacgactcgctgtaccccatcgcggtgctcatagacgaactccgcaatgaggacgttcaggtccggaggctacgggggacttggggaagacgcggaggggtacctgggggcacgggcggccctcgcggagaagactcagcgttcgctgggagtggcggaagggggcgacggccaatcagccttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatctt

SEQ ID NO: 171148 - DNA, 668 bp, Homo sapiens
  Payload ID: 13675
  Gene Symbol: PPP2R1A
  Gene Name: protein phosphatase 2, regulatory subunit A, alpha
  ENST ID: ENST00000490868
  CDS Start-End: 50-166
tttcagcacagcgctggccgcagtctgacaggaaagggacggagccaagatggcggcggccgacggcgacgactcgctgtaccccatcgcggtgctcatagacgaactccgcaatgaggacgttcagtgctgggagctattaataataggagaggcctcgtggtgatgaagaaatgaggggagagtttcacagtctgtcctgccatcagagcagctggctttggatcccacactccctcggtgcttgctttgcttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcgga

SEQ ID NO: 171149 - DNA, 2730 bp, Homo sapiens
  Payload ID: 13675
  Gene Symbol: PPP2R1A
  Gene Name: protein phosphatase 2, regulatory subunit A, alpha
  ENST ID: ENST00000462990
  CDS Start-End: 1062-2294
aaagaccgttttgacgtgcacgtcactggattcaaggctaaccctccgtttaggatgatattatctggacacacttaactacgcctgcaaagactgttttgacgtgcacgtcactgggacataactttttgaggctgctattcagcctcctgtactggtggtattattactactgctaatgctactcttgtttttgtagtcattttattacaataatttttttttctctttgagacaaagagtctcactctgttgcccaggctggagtgttgtttgttcttttacaatcacttagccagcaatcctggctttaaatcctgctccatgtgatcttagctgtctgaccctgagaggggcttttgttccccgagcctgtttccctgtctgtaaaatgggactccagctagtgacatgggtgcaggtgtgtggatgtgtttagccgaggaccgggcacagaggaagcgtgttataaacgtggctgctgctgttaaagtacagtgcattggcatgttacatgatactgtgtataggagaaagtgatgaagagagaggaggagagggagtacagttttcaacagagtggtcctggaaagtgcaactgacttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactgttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctcccccatttacttctccacctcccgtcctccccatcattggtttttttttgtgtgtcaactgtgccgtttttattttattccttttattttcccccttttcacagagaaataaaggtctagaagt

SEQ ID NO: 171150 - DNA, 444 bp, Homo sapiens
  Payload ID: 13675
  Gene Symbol: PPP2R1A
  Gene Name: protein phosphatase 2, regulatory subunit A, alpha
  ENST ID: ENST00000477989
  CDS Start-End: 7-207
gccaagatggcggcggccgacggcgacgactcgctgtaccccatcgcggtgctcatagacgaactccgcaatgaggacgttcagagacggggtttcaccatgttggccaggcttggtcgggaactcttgacctcaagcgatccacccgcctcggcctcccaaagtgttggaattacaggcgtgagccaccgcgcccagcccggatgaacattcctggttatgggatgaggtgacccaaggctctgagccgggctggtgtgggattgagaacagttagaactgcaagtccacctcccacctgctgtgtgaccttgtgcaaattacttcaccgctttgggtctctgtgttccataaaatatgggctaattgtagtcctggtcttgctggagggacttgtgagggactgaacgaattatgacacaaataaaaagtagaatggtgtca

SEQ ID NO: 171151 - DNA, 117 bp, Homo sapiens
  Payload ID: 13675
  Gene Symbol: PPP2R1A
  Gene Name: protein phosphatase 2, regulatory subunit A, alpha
  ENST ID: ENST00000628959
  CDS Start-End: 1-117
atggcggcggccgacggcgacgactcgctgtaccccatcgcggtgctcatagacgaactccgcaatgaggacgttcagtgctgggagctattaataataggagaggcctcgtggtga

SEQ ID NO: 171152 - DNA, 2082 bp, Homo sapiens
  Payload ID: 13676
  Gene Symbol: PPP2R1B
  Gene Name: protein phosphatase 2, regulatory subunit A, beta
  Uniprot ID: P30154
  ENST ID: ENST00000311129
  CDS Start-End: 22-2025
agcagcaggaggagaaagaacatggcgggcgcatcagagctcgggaccggcccaggagcagcgggtggagatggagatgattcgctatacccgatcgcggttttaatcgacgagctccgcaatgaagacgtgcagctccgactcaacagtattaagaagttatcaacaattgccctagcacttggagtagaaaggacccgaagtgaattgttgccatttcttacagatacaatttatgatgaagatgaggtactattagctcttgctgagcagctgggaaatttcactggcctagtgggaggtcctgactttgcccactgtctgctgcctcctttggaaaatctggcaactgtggaagagactgttgttcgtgacaaggctgtggagtccctgagacagatctcccaggagcatactcctgttgctctggaagcttattttgtacctctggtgaaacgcttagcaagtggggattggttcacctctcgcacatctgcatgtggtttgttcagcgtttgctatcccagggcatcaaatgctgttaaagcagaaatcagacagcaattccgttccttgtgctcagatgacacaccaatggtacgacgtgctgctgcttccaaattgggtgaatttgcaaaagttttggaattagacagtgtgaaaagtgaaattgttccactgttcactagtctagcttcagatgaacaggattcagtgcgcctccttgctgtggaagcttgtgtcagtattgcccagttattgtctcaggatgaccttgagactttggtgatgcctacacttcgacaagcagcagaagataaatcttggcgcgttcgctatatggtggctgacagattttcagagctccagaaagccatgggtcctaaaatcaccctaaatgacctcatccccgcctttcagaacctacttaaagactgtgaagctgaagtccgggcagctgctgcccacaaagtaaaagaacttggtgagaacttgcccattgaagatagagagaccataattatgaatcaaattctgccttatataaaggaattagtatccgataccaatcaacatgtcaaatcggctctagcttctgtaattatgggattgtctactattttgggcaaagaaaataccattgaacatcttctacctcttttcttagctcagttaaaggatgagtgtcctgacgttcgtttgaatatcatctccaatttggattgtgtaaatgaagtgattggaatccgtcagctctctcagtctctccttcctgccatagtggagctggcagaagatgccaaatggagggtccgcctggccatcattgagtatatgccgctgctggcaggccagctgggtgtggaattctttgatgaaaagctgaattctttatgtatggcttggctcgtggaccatgtatacgccatccgagaagctgccaccaacaacctcatgaaactagttcagaagtttggtacagagtgggcccaaaatactattgttcccaaagtgttagtaatggcaaatgatcctaattacttgcatagaatgaccactttattctgcattaatgcactgtctgaggcctgtggtcaggaaataactactaagcaaatgctgcccatcgtattaaaaatggcaggagaccaagtagcaaatgttcgcttcaatgtggccaaatctctacaaaagattggaccaattctagataccaatgctttacagggagaagtgaagccagtactacagaagttaggtcaagatgaagacatggatgtcaaatactttgcacaggaagctataagtgtggtggcacaaaggctgaggaagctagaatttcctgtgaaggacagtggagaacccagtgtccctcgggctgacaagaaccacttcccaagacccacagtgcctggagaggacatggggaagggaccagtgtatcagttgcgtggagatactagagacacacttgcccagctgggaattgcagagctagtgcatttctcccaaagcacagactaataccccagatttaaaaaaagaacataaaaaataaagtaccacacatattgcactttt

SEQ ID NO: 171153 - DNA, 1953 bp, Homo sapiens
  Payload ID: 13676
  Gene Symbol: PPP2R1B
  Gene Name: protein phosphatase 2, regulatory subunit A, beta
  Uniprot ID: P30154
  ENST ID: ENST00000341980
  CDS Start-End: 8-1678
aaagaacatggcgggcgcatcagagctcgggaccggcccaggagcagcgggtggagatggagatgattcgctatacccgatcgcggttttaatcgacgagctccgcaatgaagacgtgcagctccgactcaacagtattaagaagttatcaacaattgccctagcacttggagtagaaaggacccgaagtgaattgttgccatttcttacagatacaatttatgatgaagatgaggtactattagctcttgctgagcagctgggaaatttcactggcctagtgggaggtcctgactttgcccactgtctgctgcctcctttggaaaatctggcaactgtggaagagactgttgttcgtgacaaggctgtggagtccctgagacagatctcccaggagcatactcctgttgctctggaagcttattttgtacctctggtgaaacgcttagcaagtggggattggttcacctctcgcacatctgcatgtggtttgttcagcgtttgctatcccagggcatcaaatgctgttaaagcagaaatcagacagcaattccgttccttgtgctcagatgacacaccaatggtacgacgtgctgctgcttccaaattgggtgaatttgcaaaagttttggaattagacagtgtgaaaagtgaaattgttccactgttcactagtctagcttcagatgaacaggattcagtgcgcctccttgctgtggaagcttgtgtcagtattgcccagttattgtctcaggatgaccttgagactttggtgatgcctacacttcgacaagcagcagaagataaatcttggcgcgttcgctatatggtggctgacagattttcagagctccagaaagccatgggtcctaaaatcaccctaaatgacctcatccccgcctttcagaacctacttaaagactgtgaagctgaagtccgggcagctgctgcccacaaagtaaaagaacttggtgagaacttgcccattgaagatagagagaccataattatgaatcaaattctgccttatataaagtgtcctgacgttcgtttgaatatcatctccaatttggattgtgtaaatgaagtgattggaatccgtcagctctctcagtctctccttcctgccatagtggagctggcagaagatgccaaatggagggtccgcctggccatcattgagtatatgccgctgctggcaggccagctgggtgtggaattctttgatgaaaagctgaattctttatgtatggcttggctcgtggaccatgtatacgccatccgagaagctgccaccaacaacctcatgaaactagttcagaagtttggtacagagtgggcccaaaatactattgttcccaaagtgttagtaatggcaaatgatcctaattacttgcatagaatgaccactttattctgcattaatgcactgtctgaggcctgtggtcaggaaataactactaagcaaatgctgcccatcgtattaaaaatggcaggagaccaagtagcaaatgttcgcttcaatgtggccaaatctctacaaaagattggaccaattctagataccaatgctttacagggagaagtgaagccagtactacagaagttaggtcaagatgaagacatggatgtcaaatactttgcacaggaagctataagtgttcttgcattggcataatgaggagcaggagggaaaaggcctttactagattcttgtcacaaatttctagtcaatgtgttcttaactgggtggagaaagaatggaaaaccttcaagatctcatccaagcaaatggcaacaacttagaagaaatcatttagtgacttaattctttctaaagatgaaatgggattgttttttactcgtcttccttgttaaatcattatttaagccgttcttattgaccaattcctgacacttgattgtctcctaatgctttatccatcaccacct

SEQ ID NO: 171154 - DNA, 1525 bp, Homo sapiens
  Payload ID: 13676
  Gene Symbol: PPP2R1B
  Gene Name: protein phosphatase 2, regulatory subunit A, beta
  Uniprot ID: P30154
  ENST ID: ENST00000393055
  CDS Start-End: 22-1446
agcagcaggaggagaaagaacatggcgggcgcatcagagctcgggaccggcccaggagcagcgggtggagatggagatgattcgctatacccgatcgcggttttaatcgacgagctccgcaatgaagacgtgcagctccgactcaacagtattaagaagttatcaacaattgccctagcacttggagtagaaaggacccgaagtgaattgttgccatttcttacagatacaatttatgatgaagatgaggtactattagctcttgctgagcagctgggaaatttcactggcctagtgggaggtcctgactttgcccactgtctgctggattcagtgcgcctccttgctgtggaagcttgtgtcagtattgcccagttattgtctcaggatgaccttgagactttggtgatgcctacacttcgacaagcagcagaagataaatcttggcgcgttcgctatatggtggctgacagattttcagagctccagaaagccatgggtcctaaaatcaccctaaatgacctcatccccgcctttcagaacctacttaaagactgtgaagctgaagtccgggcagctgctgcccacaaagtaaaagaacttggtgagaacttgcccattgaagatagagagaccataattatgaatcaaattctgccttatataaaggaattagtatccgataccaatcaacatgtcaaatcggctctagcttctgtaattatgggattgtctactattttgggcaaagaaaataccattgaacatcttctacctcttttcttagctcagttaaaggatgagtgtcctgacgttcgtttgaatatcatctccaatttggattgtgtaaatgaagtgattggaatccgtcagctctctcagtctctccttcctgccatagtggagctggcagaagatgccaaatggagggtccgcctggccatcattgagtatatgccgctgctggcaggccagctgggtgtggaattctttgatgaaaagctgaattctttatgtatggcttggctcgtggaccatgtatacgccatccgagaagctgccaccaacaacctcatgaaactagttcagaagtttggtacagagtgggcccaaaatactattgttcccaaagtgttagtaatggcaaatgatcctaattacttgcatagaatgaccactttattctgcattaatgcactgtctgaggcctgtggtcaggaaataactactaagcaaatgctgcccatcgtattaaaaatggcaggagaccaagtagcaaatgttcgcttcaatgtggccaaatctctacaaaagattggaccaattctagataccaatgctttacagggagaagtgaagccagtactacagaagttaggtcaagatgaagacatggatgtcaaatactttgcacaggaagctataagtgttcttgcattggcataatgaggagcaggagggaaaaggcctttactagattcttgtcacaaatttctagtcaatgtgttcttaactgggtggagaa

SEQ ID NO: 171155 - DNA, 1888 bp, Homo sapiens
  Payload ID: 13676
  Gene Symbol: PPP2R1B
  Gene Name: protein phosphatase 2, regulatory subunit A, beta
  Uniprot ID: P30154
  ENST ID: ENST00000426998
  CDS Start-End: 26-1837
gaccagcagcaggaggagaaagaacatggcgggcgcatcagagctcgggaccggcccaggagcagcgggtggagatggagatgattcgctatacccgatcgcggttttaatcgacgagctccgcaatgaagacgtgcagcctcctttggaaaatctggcaactgtggaagagactgttgttcgtgacaaggctgtggagtccctgagacagatctcccaggagcatactcctgttgctctggaagcttattttgtacctctggtgaaacgcttagcaagtggggattggttcacctctcgcacatctgcatgtggtttgttcagcgtttgctatcccagggcatcaaatgctgttaaagcagaaatcagacagcaattccgttccttgtgctcagatgacacaccaatggtacgacgtgctgctgcttccaaattgggtgaatttgcaaaagttttggaattagacagtgtgaaaagtgaaattgttccactgttcactagtctagcttcagatgaacaggattcagtgcgcctccttgctgtggaagcttgtgtcagtattgcccagttattgtctcaggatgaccttgagactttggtgatgcctacacttcgacaagcagcagaagataaatcttggcgcgttcgctatatggtggctgacagattttcagagctccagaaagccatgggtcctaaaatcaccctaaatgacctcatccccgcctttcagaacctacttaaagactgtgaagctgaagtccgggcagctgctgcccacaaagtaaaagaacttggtgagaacttgcccattgaagatagagagaccataattatgaatcaaattctgccttatataaaggaattagtatccgataccaatcaacatgtcaaatcggctctagcttctgtaattatgggattgtctactattttgggcaaagaaaataccattgaacatcttctacctcttttcttagctcagttaaaggatgagtgtcctgacgttcgtttgaatatcatctccaatttggattgtgtaaatgaagtgattggaatccgtcagctctctcagtctctccttcctgccatagtggagctggcagaagatgccaaatggagggtccgcctggccatcattgagtatatgccgctgctggcaggccagctgggtgtggaattctttgatgaaaagctgaattctttatgtatggcttggctcgtggaccatgtatacgccatccgagaagctgccaccaacaacctcatgaaactagttcagaagtttggtacagagtgggcccaaaatactattgttcccaaagtgttagtaatggcaaatgatcctaattacttgcatagaatgaccactttattctgcattaatgcactgtctgaggcctgtggtcaggaaataactactaagcaaatgctgcccatcgtattaaaaatggcaggagaccaagtagcaaatgttcgcttcaatgtggccaaatctctacaaaagattggaccaattctagataccaatgctttacagggagaagtgaagccagtactacagaagttaggtcaagatgaagacatggatgtcaaatactttgcacaggaagctataagtgtggtggcacaaaggctgaggaagctagaatttcctgtgaaggacagtggagaacccagtgtccctcgggctgacaagaaccacttcccaagacccacagtgcctggagaggacatggggaagggaccagtgtatcagttgcgtggagatactagagacacacttgcccagctgggaattgcagagctagtgcatttctcccaaagcacagactaataccccagatttaaaaaaagaacataaaaaataaagtaccacacatattgc

SEQ ID NO: 171156 - DNA, 582 bp, Homo sapiens
  Payload ID: 13676
  Gene Symbol: PPP2R1B
  Gene Name: protein phosphatase 2, regulatory subunit A, beta
  ENST ID: ENST00000534500
  CDS Start-End: 7-258
aagaacatggcgggcgcatcagagctcgggaccggcccaggagcagcgggtggagatggagatgattcgctatacccgatcgcggttttaatcgacgagctccgcaatgaagacgtgcagctccgactcaacagtattaagaagttatcaacaattgccctagcacttggagtagaaaggacccgaagtgaattgttgccatttcttacagcctcctttggaaaatctggcaactgtggaagagactgttgttcgtgacaaggctgtggagtccctgagacagatctcccaggagcatactcctgttgctctggaagcttattttgtacctctggtgaaacgcttagcaagtggggattggttcacctctcgcacatctgcatgtggtttgttcagcgtttgctatcccagggcatcaaatgctgttaaagcagaaatcagacagcaattccgttccttgtgctcagatgacacaccaatggtacgacgtgctgctgcttccaaattgggtgaatttgcaaaagttttggaattagacagtgtgaaaagtgaaattgttccactgttcactagtctagcttc

SEQ ID NO: 171157 - DNA, 670 bp, Homo sapiens
  Payload ID: 13676
  Gene Symbol: PPP2R1B
  Gene Name: protein phosphatase 2, regulatory subunit A, beta
  ENST ID: ENST00000531890
  CDS Start-End: 1-670
gaacctacttaaagactgtgaagctgaagtccgggcagctgctgcccacaaagtaaaagaacttggtgagaacttgcccattgaagatagagagaccataattatgaatcaaattctgccttatataaaggaattagtatccgataccaatcaacatgtcaaatcggctctagcttctgtaattatgggattgtctactattttgggcaaagaaaataccattgaacatcttctacctcttttcttagctcagttaaaggatgagtgtcctgacgttcgtttgaatatcatctccaatttggattgtgtaaatgaagtgattggaatccgtcagctctctcagtctctccttcctgccatagtggagctggcagaagatgccaaatggagggtccgcctggccatcattgagtatatgccgctgctggcaggccagctggcactgtctgaggcctgtggtcaggaaataactactaagcaaatgctgcccatcgtattaaaaatggcaggagaccaagtagcaaatgttcgcttcaatgtggccaaatctctacaaaagattggaccaattctagataccaatgctttacagggagaagtgaagccagtactacagaagttaggtcaagatgaagacatggatgtcaaatactttgcacaggaagctata

SEQ ID NO: 171158 - DNA, 553 bp, Homo sapiens
  Payload ID: 13676
  Gene Symbol: PPP2R1B
  Gene Name: protein phosphatase 2, regulatory subunit A, beta
  ENST ID: ENST00000531373
  CDS Start-End: 197-553
acctctctagtaaccttgcttcggaccccctgaggcgtccgcccggagccttgcccttcccgggcggttgtcggggaacccgcttcccgcctgggcgccccatccgggccgtgaggtggccgcgtctcttgggcgagggagcaggagaagcgcggtgccaggccgagacggggctggagcggctgaggggcgcaggatgcccagaagccctttgaagtgcccctggatcccttcatctcggcttggaactggctcggcttgttggctccgactcaacagtattaagaagttatcaacaattgccctagcacttggagtagaaaggacccgaagtgaattgttgccatttcttacagatacaatttatgatgaagatgaggtactattagctcttgctgagcagctgggaaatttcactggcctagtgggaggtcctgactttgcccactgtctgctgcctcctttggaaaatctggcaactgtggaagagactgttgttcgtgacaaggctgtggagtccctgagacagatctcccaggagcatactcctgtt

SEQ ID NO: 171159 - DNA, 2294 bp, Homo sapiens
  Payload ID: 13676
  Gene Symbol: PPP2R1B
  Gene Name: protein phosphatase 2, regulatory subunit A, beta
  ENST ID: ENST00000534521
  CDS Start-End: 8-415
aaagaacatggcgggcgcatcagagctcgggaccggcccaggagcagcgggtggagatggagatgattcgctatacccgatcgcggttttaatcgacgagctccgcaatgaagacgtgcagctccgactcaacagtattaagaagttatcaacaattgccctagcacttggagtagaaaggacccgaagtgaattgttgccatttcttacagatacaatttatgatgaagatgaggtactattagctcttgctgagcagctgggaaatttcactggcctagtgggaggtcctgactttgcccactgtctgctgacaccatctgggaattgccatctgggacacgagatcttggcttttctacagaagtcgtgtctttgggttggccgcaccatatgttatcactgtgtgagctgaaagtaaccatttggtatgatgcagctaacattctggttacgtgtaccacctcccttcagtcactttaaaaggcaattccgttccttgtgctcagatgacacaccaatggtacgacgtgctgctgcttccaaattgggtgaatttgcaaaagttttggaattagacagtgtgaaaagtgaaattgttccactgttcactagtctagcttcagatgaacaggattcagtgcgcctccttgctgtggaagcttgtgtcagtattgcccagttattgtctcaggatgaccttgagactttggtgatgcctacacttcgacaagcagcagaagataaatcttggcgcgttcgctatatggtggctgacagattttcagagctccagaaagccatgggtcctaaaatcaccctaaatgacctcatccccgcctttcagaacctacttaaagactgtgaagctgaagtccgggcagctgctgcccacaaagtaaaagaacttggtgagaacttgcccattgaagatagagagaccataattatgaatcaaattctgccttatataaaggaattagtatccgataccaatcaacatgtcaaatcggctctagcttctgtaattatgggattgtctactattttgggcaaagaaaataccattgaacatcttctacctcttttcttagctcagttaaaggatgagtgtcctgacgttcgtttgaatatcatctccaatttggattgtgtaaatgaagtgattggaatccgtcagctctctcagtctctccttcctgccatagtggagctggcagaagatgccaaatggagggtccgcctggccatcattgagtatatgccgctgctggcaggccagctgggtgtggaattctttgatgaaaagctgaattctttatgtatggcttggctcgtggaccatgtatacgccatccgagaagctgccaccaacaacctcatgaaactagttcagaagtttggtacagagtgggcccaaaatactattgttcccaaagtgttagtaatggcaaatgatcctaattacttgcatagaatgaccactttattctgcattaatgcactgtctgaggcctgtggtcaggaaataactactaagcaaatgctgcccatcgtattaaaaatggcaggagaccaagtagcaaatgttcgcttcaatgtggccaaatctctacaaaagattggaccaattctagataccaatgctttacagggagaagtgaagccagtactacagaagttaggtcaagatgaagacatggatgtcaaatactttgcacaggaagctataagtgttcttgcattggcataatgaggagcaggagggaaaaggcctttactagattcttgtcacaaatttctagtcaatgtgttcttaactgggtggagaaagaatggaaaaccttcaagatctcatccaagcaaatggcaacaacttagaagaaatcatttagtgacttaattctttctaaagatgaaatgggattgttttttactcgtcttccttgttaaatcattatttaagccgttcttattgaccaattcctgacacttgattgtctcctaatgctttatccatcaccacctgggctcctgcatcctcactgtggaatcaggcaccagccacataatgttccagacaaagcctggaagggtgtggacccagacgtggagtggagtgattctcttgacgtttacatatatctctgtgtctctccatcattccaaagctaaatgtacatgtttagaataacttattttataaactcttcgggagacatgttgagatttgaccgtaatgaaagccacattttcctgaattatgatggtctgcattagtctcatgtgaaagg

SEQ ID NO: 171160 - DNA, 5587 bp, Homo sapiens
  Payload ID: 13676
  Gene Symbol: PPP2R1B
  Gene Name: protein phosphatase 2, regulatory subunit A, beta
  Uniprot ID: P30154
  ENST ID: ENST00000527614
  CDS Start-End: 67-1872
ctgggcgcggggcggggcctgggcgcggggcgggaggcggtgaccagcagcaggaggagaaagaacatggcgggcgcatcagagctcgggaccggcccaggagcagcgggtggagatggagatgattcgctatacccgatcgcggttttaatcgacgagctccgcaatgaagacgtgcagctccgactcaacagtattaagaagttatcaacaattgccctagcacttggagtagaaaggacccgaagtgaattgttgccatttcttacagatacaatttatgatgaagatgaggtactattagctcttgctgagcagctgggaaatttcactggcctagtgggaggtcctgactttgcccactgtctgctgcctcctttggaaaatctggcaactgtggaagagactgttgttcgtgacaaggctgtggagtccctgagacagatctcccaggagcatactcctgttgctctggaagcttattttgtacctctggtgaaacgcttagcaagtggggattggttcacctctcgcacatctgcatgtggtttgttcagcgtttgctatcccagggcatcaaatgctgttaaagcagaaatcagacagcaattccgttccttgtgctcagatgacacaccaatggtacgacgtgctgctgcttccaaattgggtgaatttgcaaaagttttggaattagacagtgtgaaaagtgaaattgttccactgttcactagtctagcttcagatgaacaggattcagtgcgcctccttgctgtggaagcttgtgtcagtattgcccagttattgtctcaggatgaccttgagactttggtgatgcctacacttcgacaagcagcagaagataaatcttggcgcgttcgctatatggtggctgacagattttcagagctccagaaagccatgggtcctaaaatcaccctaaatgacctcatccccgcctttcagaacctacttaaagactgtgaagctgaagtccgggcagctgctgcccacaaagtaaaagaacttggtgagaacttgcccattgaagatagagagaccataattatgaatcaaattctgccttatataaaggaattagtatccgataccaatcaacatgtcaaatcggctctagcttctgtaattatgggattgtctactattttgggcaaagaaaataccattgaacatcttctacctcttttcttagctcagttaaaggatgagtgtcctgacgttcgtttgaatatcatctccaatttggattgtgtaaatgaagtgattggaatccgtcagctctctcagtctctccttcctgccatagtggagctggcagaagatgccaaatggagggtccgcctggccatcattgagtatatgccgctgctggcaggccagctgggtgtggaattctttgatgaaaagctgaattctttatgtatggcttggctcgtggaccatgtatacgccatccgagaagctgccaccaacaacctcatgaaactagttcagaagtttggtacagagtgggcccaaaatactattgttcccaaagtgttagtaatggcaaatgatcctaattacttgcatagaatgaccactttattctgcattaatgcactgtctgaggcctgtggtcaggaaataactactaagcaaatgctgcccatcgtattaaaaatggcaggagaccaagtagcaaatgttcgcttcaatgtggccaaatctctacaaaagattggaccaattctagataccaatgctttacagggagaagtgaagccagtactacagaagttaggtcaagatgaagacatggatgtcaaatactttgcacaggaagctataagtgttcttgcattggcataatgaggagcaggagggaaaaggcctttactagattcttgtcacaaatttctagtcaatgtgttcttaactgggtggagaaagaatggaaaaccttcaagatctcatccaagcaaatggcaacaacttagaagaaatcatttagtgacttaattctttctaaagatgaaatgggattgttttttactcgtcttccttgttaaatcattatttaagccgttcttattgaccaattcctgacacttgattgtctcctaatgctttatccatcaccacctgggctcctgcatcctcactgtggaatcaggcaccagccacataatgttccagacaaagcctggaagggtgtggacccagacgtggagtggagtgattctcttgacgtttacatatatctctgtgtctctccatcattccaaagctaaatgtacatgtttagaataacttattttataaactcttcgggagacatgttgagatttgaccgtaatgaaagccacattttcctgaattatgatggtctgcattagtctcatgtgaaaggggaatgtggaagctcagggttaatgtagtggttgttttggtttttatttgctcaattttgtctgtactcatgtcattcagaaacctgaagtgtggctgcatcttgctgctaatgtgtgatgttgacgcctaactgaatttgaacagctcaccactgtgcctacatttaaaaatacttctctctcttttctaaaaagctttaactgtagtgcctcctaataagcagtatgtttgtttcattgtgagattgcagttctgtatttcgaatgagtctaagaaccacagggataatactgtgcagatttcctgttctttacctggctctgcttccagcagtattgacacctagtccttgctgcattgtacagtagcttttcaaactgcagttttattgctaagtttttagtatgggtgatactggagtcttatcatttgaagtgtttgcttttctacttttacagtaaaacctcattaattctgaaatttaagataatgagttaagctgaagagtttactgaagcaaattaatagtgaggaagcctatttgaactacttaaacagtattaaagccctttttaaaaagcacctatttgggatcatttgaggtcaagaattcgagatcagcctgaccaacatggtgaaaccccatctctactaaaaatacaaaaaagttagctgggcgtggtggcacacacctgtagtcccagctactcaggaggctgaggcaggagaattgcttgaacctgggaggtagaggttgcactgagccgagatcgcgccactgcactctagcctgggccatagagcgagagtccatctcaaaaaaaaacaactatttttcacataatcaaactcaccttgtctcatgacttttggttaagggggttttcccatagtttatttttctctcagtgcatcttgctatgaggtttgcttgttacccttttggtttttgaattgttgattttgttcacaacctcttttaaatctaacaagtcctgttctgtttagtgaaggcccaaagactcctctaagactttgtatatttgttacataaaaccaagttttactaaatactttaaaatttgtcctacattcgaaaaatagaaattgtaaatcagaggttatctgtctgcattttaaactgccaaattaccttatagtaagtttctattttatgactttgggccaagaattaagtattttcctaagcacaaatctttttctatattctcattttaatatcttatgctattattctgtaaacattttaattttagtttcatgagtctttattttttgttacctgcaagttatgttcttcttcattgaatttcatatttgagagacatttgtcttcatgaagcagatttgcactggaaccattgctttactctggttggaaatgccattgttttggggacagacttttaaaatgcccttgtgtctcccagtgaggagccctaagcattgacttctctaccctaaaactgtttgagagagggagagtgggccctggctttctcaagcatgggtcgggggttcagcggggcctctgtcttttgtggtgacccctcaggggtttcattgtttccttctgacttaagcaatagagagagaatttgttttggtactcttcagaggaattgtgctttggctcataacttggccatgttctccatgaattagttctcctatttttttttttaactaccttaaacttaagggaaaagttctcctatcttgatttcactggaatataggctttaggagctctgtaaggctggtatttttgtctgttttatcttctactgtatcgccagtgcctggaacagtgtctggtgcacataataggtgctcaataaaaatgtgttcaatggatgaatttctaaaatatcctccaatgtgtgcatggaacaaataatcaaaagaaccagactgtgtcttattctcccactgacagaaagattttcctgctttcaggaaacaagctttatgtggcccttttctggtcccctggcttagactacagttctgtgtggatttgtctgattgcttcagacatgtaatgttgtttttcatccttggcagcttacatcagttgtttgtttgattagaaaaatgaagcagacacacacacacacacacacacacacacacacacacacacacaaacatataacctatgccaataaaaatgtctcagcaacagtggaattcaccttggtgtttctctctgtaatttgtgtggggtttacccctcacaggtttaagagaccaggtcttgtttctctctctgtgctaccaagaagatgtgaacctgaggatgcatcttgtttcataagaaggaaggcaggtgaatatgtggtttctaacgaggtcttgttgaaataacgggctgccctcagctcacagaaataccacagctcagccactgtgatgcagagccccaggggtctttgccagacaacttgtcctgactcaacagagacggcagcctgacctttgagctggcttgtccaggcattcaggttgcttgcgtagacttccagggaagcaagcctgtccttcctgacccggcggttaacctggtgcacttttgttcctttgttaactgttgtgttgtcactaaactgaaaggctggggcttgcccttagacgtcacattggctctgtccctgtggcgatggcagggcagggtggccaaacaggtcaggtgcttgttctgtcctcttgccttttacttaaattcctctgacttttaaaaatggtgacactcttatcgtaaagcttcttatttttctccactgcttggatatgaaactgtagagggagaggccctgttgcccagtgttctcctggtttagcagctgaggtgactgcagtctgatgtgatgtaactgtttccctttgattctccagtattcctgtttccatccagttccttactctcctctttcctcttccctcgcatgtctccctccagtcctctgtacctagaatagtctcactgtcccccgtttgcctccacgagcctgctgtttccaggaaattacataacgttcagttgggatggaaatcttccggaggacgaatagagtttaattactcattgcgtcggaaagccaagccatttctgtctccagagttgttctcttaaactgatatgagttct

SEQ ID NO: 171161 - DNA, 1878 bp, Homo sapiens
  Payload ID: 13677
  Gene Symbol: PPP2R2A
  Gene Name: protein phosphatase 2, regulatory subunit B, alpha
  Uniprot ID: P63151
  ENST ID: ENST00000315985
  CDS Start-End: 32-1405
atatgaatcattactccttacccaggcagtaatgttcccgaagttttctcttcgttctatgtttcatggagctggaggagggaatgatattcagtggtgtttttctcaggtgaaaggagcagtagatgatgatgtagcagaagcagatataatttctacagtagaatttaatcattctggagaattactagcaacaggagataaaggtggtagagttgtcatctttcaacaggagcaggagaacaaaatccagtctcatagcagaggagaatataatgtttacagcaccttccagagccatgaaccagagtttgactacttgaaaagtttagaaatagaagaaaagatcaacaaaattaggtggttaccccagaaaaatgctgctcagtttttattgtctaccaatgataaaacaataaaattatggaaaatcagtgaaagggacaaaagaccagaagggtataacttgaaagaggaggatggaaggtatagagatcctactacagttactacactacgagtgccagtctttaggcctatggatctaatggttgaggccagtccacgaagaatatttgccaatgctcatacatatcacatcaactcaatttctattaatagtgattatgaaacatatttatctgcagatgatttgcggattaatctttggcatctggaaattacagacaggagttttaacattgtggatatcaagcctgccaatatggaagagctaacagaggtgattacagcagcagaatttcatccaaacagctgtaacacatttgtatacagcagcagtaaaggaactattcggctatgtgacatgagggcatctgccctctgtgatagacattctaaattgtttgaagaacctgaagatcccagtaacaggtcatttttttccgaaatcatctcctctatttcggatgtaaaattcagccatagtggtcgatatatgatgactagagactatttgtcagtcaaaatttgggacttaaatatggaaaacaggcctgtggaaacataccaggtgcatgaatacctcagaagtaaactctgttcactgtatgaaaatgactgcatatttgacaaatttgaatgttgttggaatggatctgacagtgttgtcatgactggatcttacaataatttcttcagaatgtttgacagaaacacaaagcgagacataaccctagaagcatcgcgggaaaacaataagcctcgcacagttctgaagcctcgcaaagtctgtgcaagtggcaagcgaaagaaagatgaaataagtgttgacagcctagacttcaataagaaaatccttcacacagcctggcaccccaaggaaaatatcattgccgtagctactacaaacaatctgtatatatttcaagacaaagtgaattagggttggcattcctagcagaagaacccacttcctgcttagttgagatagttgaatctagcattcgttcctataaaagagagaggtccattgtggcgcccctttccagtgtttgacagtgtgccattcgacaacacattgttatagctacatggagaaagctctgtggattcatcactgtggtgttctccatgtctgctagccatttaggtaagggtagggcacttttaatttaaatgacttcttgcaccatcttgcctaatggactagattggactgtatcaacattgatttactccactttttatgccttccattgtgatgacgtcaaacacagtgaaagccttcagtcatgctatgggatttaattgtgtatcctcattactgtatcatttgtggggtacaccccttccccctttttttaaattaaatacagctcattcttactgtggcttgtagcattcctcctcttctgg

SEQ ID NO: 171162 - DNA, 3940 bp, Homo sapiens
  Payload ID: 13677
  Gene Symbol: PPP2R2A
  Gene Name: protein phosphatase 2, regulatory subunit B, alpha
  Uniprot ID: P63151
  ENST ID: ENST00000380737
  CDS Start-End: 330-1673
aggtgacgtcactggccaggccagccggcgccattttgaaagtggagtcgcctgcccctgccgctgccgccgccgccgtcgctgtcgtagtcgccgccgccgctgccggagaaagagcacgagcggggaagccccagagtgaaatctagcatcctgccggctggtctgcccgcccctccttccttttccccccggcccccgtcccctccccccgcaggtgccatccgccgccatccgccctctctacccccccatccccaggtgaggggggtgagttcaggaagcggagaccccgaggaacccagcagggtcaccatttgcagcgcaacatggcaggagctggaggagggaatgatattcagtggtgtttttctcaggtgaaaggagcagtagatgatgatgtagcagaagcagatataatttctacagtagaatttaatcattctggagaattactagcaacaggagataaaggtggtagagttgtcatctttcaacaggagcaggagaacaaaatccagtctcatagcagaggagaatataatgtttacagcaccttccagagccatgaaccagagtttgactacttgaaaagtttagaaatagaagaaaagatcaacaaaattaggtggttaccccagaaaaatgctgctcagtttttattgtctaccaatgataaaacaataaaattatggaaaatcagtgaaagggacaaaagaccagaagggtataacttgaaagaggaggatggaaggtatagagatcctactacagttactacactacgagtgccagtctttaggcctatggatctaatggttgaggccagtccacgaagaatatttgccaatgctcatacatatcacatcaactcaatttctattaatagtgattatgaaacatatttatctgcagatgatttgcggattaatctttggcatctggaaattacagacaggagttttaacattgtggatatcaagcctgccaatatggaagagctaacagaggtgattacagcagcagaatttcatccaaacagctgtaacacatttgtatacagcagcagtaaaggaactattcggctatgtgacatgagggcatctgccctctgtgatagacattctaaattgtttgaagaacctgaagatcccagtaacaggtcatttttttccgaaatcatctcctctatttcggatgtaaaattcagccatagtggtcgatatatgatgactagagactatttgtcagtcaaaatttgggacttaaatatggaaaacaggcctgtggaaacataccaggtgcatgaatacctcagaagtaaactctgttcactgtatgaaaatgactgcatatttgacaaatttgaatgttgttggaatggatctgacagtgttgtcatgactggatcttacaataatttcttcagaatgtttgacagaaacacaaagcgagacataaccctagaagcatcgcgggaaaacaataagcctcgcacagttctgaagcctcgcaaagtctgtgcaagtggcaagcgaaagaaagatgaaataagtgttgacagcctagacttcaataagaaaatccttcacacagcctggcaccccaaggaaaatatcattgccgtagctactacaaacaatctgtatatatttcaagacaaagtgaattagggttggcattcctagcagaagaacccacttcctgcttagttgagatagttgaatctagcattcgttcctataaaagagagaggtccattgtggcgcccctttccagtgtttgacagtgtgccattcgacaacacattgttatagctacatggagaaagctctgtggattcatcactgtggtgttctccatgtctgctagccatttaggtaagggtagggcacttttaatttaaatgacttcttgcaccatcttgcctaatggactagattggactgtatcaacattgatttactccactttttatgccttccattgtgatgacgtcaaacacagtgaaagccttcagtcatgctatgggatttaattgtgtatcctcattactgtatcatttgtggggtacaccccttccccctttttttaaattaaatacagctcattcttactgtggcttgtagcattcctcctcttctggcctcctggactgctccccttcatctcttacccttgccccctccacccggtcttggtggtggtatattaaaaaaagaaagaatgaaagcacacaaaatgagtcagtttggggtcagtggtataaagggggtatatgttgcaaacaaatgttttagtaacagttggctgtaatcactcctcgccgtgtctggcactgaaaataaggaaaaaaaacctactactgaataaaagtgacaaagaatggagaatctggttttctttttctttttaacctacctcttgtagccaatattttgtgtcatacctttgggcacagtgaaacaaaatgggttttcattgtttattggtatttttgttaattatttttaacaagtgttcttttacatgcaggaggagaggtattggttctctatgaacatattttgaatataggttttattaaggatttcacaatctataaatgctactagtttttttttttttttttaccatcatgagggtattggatacattgtgtctctatttaactcattatgtgttaatgaaattgttgtaaatgggaaccaaatttgtagaacttaatttctactttttagagtgcttaatttcatttttgccttactaaatagtcaaagacttataaaacatttttaacaagttagaacttttttgttattcagtcatataaaatagcagaaaactaacatcaagtgacactgcactaaatactttttttgtattttactgctatcaaatcagaatgaaatatactttaccatagatatttttcttctatttttggttttccaaagctatatgaaagacaaatttttaaaggtacagcgttcaaaaagtgcttaatgaactccaacagctgcctcaaataaaaatctgtatatgaatacattttccctaagcggtgatacattatccaaagatgaagagtgctcctatttttaataggtagaatgtacctttgtcagtcttgcagaaactttaatggagaagaaatggactttatttttgaaaggtgaaatgaacaggcatttatattattagagaatggtagtcttattttggtggaacataatgtaacaaccttgaatttcagaggactctgagtgcttctatgtccactacctattgttctattcttcaataatgaaaaagaattcaacgagccgaccgtgattccctctactacaaatattatgtcttgtaagttagcatttttagcacacaggagaaattttatgtaataaaattactgtatcttttggatttaacaaatttgtatttgaaacacattctatgtctgataattcttaatggcacttttactaatttatttggggatcttgggtacattcttaatttgtgtttattcttcacgcttgacttgcaagtgggatattcccctgccacaagtgtcaaacagtgatattcttcctgtgttgtgactggacagttttccagatcttttttgggagattttcctacagcttggttgtatgtcttgagataacaccaccaaacagctctcagaaattcttttttgattgatcagtagctatgatgattctcctccatgacactaaggattagtttatatatttaagagaaataattgctaaaattaaaatgcctctatcaaggaatgctattataaattattgttaacattctcaagtattaattttttaatttcattggtgtagcaaactctaagcccagccactcattttacatggccatggttaatctttttattaataaaaattatacttagaataaa

SEQ ID NO: 171163 - DNA, 755 bp, Homo sapiens
  Payload ID: 13677
  Gene Symbol: PPP2R2A
  Gene Name: protein phosphatase 2, regulatory subunit B, alpha
  ENST ID: ENST00000518254
  CDS Start-End: 293-448
gaaagtggagtcgcctgcccctgccgctgccgccgccgccgtcgctgtcgtagtcgccgccgccgctgccggagaaagagcacgagcggggaagccccagagtgaaatctagcatcctgccggctggtctgcccgcccctccttccttttccccccggcccccgtcccctccccccgcaggtgccatccgccgccatccgccctctctacccccccatccccaggtgaggggggtgagttcaggaagcggagaccccgaggaacccagcagggtcaccatttgcagcgcaacatggcaggagctggaggagggaatgatattcagtggtgtttttctcaggtgaaaggagcagtagatgatgatgtagcagaaggtaagaaagcgtttaatgcaaaatttggatatataatttttgcagaaatgtttcctactggaggatttccttgaagccgagactgctataaattcaagatgattttgttgtccaagaaatcagatataatttctacagtagaatttaatcattctggagaattactagcaacaggagataaaggtggtagagttgtcatctttcaacaggagcaggagaacaaaatccagtctcatagcagaggagaatataatgtttacagcaccttccagagccatgaaccagagtttgactacttgaaaagtttagaaatagaagaaaagatcaacaaaattaggtggttaccccagaaaaatgctgctcagtttttattgtctacca

SEQ ID NO: 171164 - DNA, 601 bp, Homo sapiens
  Payload ID: 13677
  Gene Symbol: PPP2R2A
  Gene Name: protein phosphatase 2, regulatory subunit B, alpha
  ENST ID: ENST00000521557
  CDS Start-End: 560-601
ctttctaatgcagtaccaagtattggggactaacctctttccaaactggtgctcttggtggtagttgtatgtgtgggcagaactaggctgagctggaggagggaatgatattcagtggtgtttttctcaggtgaaaggagcagtagatgatgatgtagcagaagcagatataatttctacagtagaatttaatcattctggagaattactagcaacaggagataaaggtggtagagttgtcatctttcaacaggagcaggagaacaaaatccagtctcatagcagaggagaatataatgtttacagcaccttccagagccatgaaccagagtttgactacttgaaaagtttagaaatagaagaaaagatcaacaaaattaggtggttaccccagaaaaatgctgctcagtttttattgtctaccaatgataaaacaataaaattatggaaaatcagtgaaagggacaaaagaccagaagggtataacttgaaagaggaggatggaaggtatagagatcctactacagttactacactacgagtgccagtctttaggcctatggatctaatggttgaggccagtccacgaagaatatttgcc

SEQ ID NO: 171165 - DNA, 836 bp, Homo sapiens
  Payload ID: 13677
  Gene Symbol: PPP2R2A
  Gene Name: protein phosphatase 2, regulatory subunit B, alpha
  ENST ID: ENST00000520329
  CDS Start-End: 293-394
gaaagtggagtcgcctgcccctgccgctgccgccgccgccgtcgctgtcgtagtcgccgccgccgctgccggagaaagagcacgagcggggaagccccagagtgaaatctagcatcctgccggctggtctgcccgcccctccttccttttccccccggcccccgtcccctccccccgcaggtgccatccgccgccatccgccctctctacccccccatccccaggtgaggggggtgagttcaggaagcggagaccccgaggaacccagcagggtcaccatttgcagcgcaacatggcaggagctggaggagggaatgatattcagtggtgtttttctcaggtgaaaggagcagtagatgatgatgtagcagaagatcacttatttgagacatagtcctcaagtggaattatgaaatcaaagagtgactccataaagtgcctcacaacacaagagctgagcagatataatttctacagtagaatttaatcattctggagaattactagcaacaggagataaaggtggtagagttgtcatctttcaacaggagcaggagaacaaaatccagtctcatagcagaggagaatataatgtttacagcaccttccagagccatgaaccagagtttgactacttgaaaagtttagaaatagaagaaaagatcaacaaaattaggtggttaccccagaaaaatgctgctcagtttttattgtctaccaatgataaaacaataaaattatggaaaatcagtgaaagggacaaaagaccagaagggtataacttgaaagaggaggatggaaggtatagagatcctactacagttactacactacga

SEQ ID NO: 171166 - DNA, 653 bp, Homo sapiens
  Payload ID: 13677
  Gene Symbol: PPP2R2A
  Gene Name: protein phosphatase 2, regulatory subunit B, alpha
  ENST ID: ENST00000522535
  CDS Start-End: 644-653
gaaatccccctcgccccctgacaaggcaccgcttccttattcctccctccatcaccccctagcgaccgcccgcgcctcgcgcagagccacagggcgcccctcgggtttgagggagtagggtccagaggggtggggtgggggcggggagggctcccgggaggcaagtggtcacggagctggaggagggaatgatattcagtggtgtttttctcaggtgaaaggagcagtagatgatgatgtagcagaagcagatataatttctacagtagaatttaatcattctggagaattactagcaacaggagataaaggtggtagagttgtcatctttcaacaggagcaggagaacaaaatccagtctcatagcagaggagaatataatgtttacagcaccttccagagccatgaaccagagtttgactacttgaaaagtttagaaatagaagaaaagatcaacaaaattaggtggttaccccagaaaaatgctgctcagtttttattgtctaccaatgataaaacaataaaattatggaaaatcagtgaaagggacaaaagaccagaagggtataacttgaaagaggaggatggaaggtatagagatcctactacagttactacactacgagtgccagtctttaggcctatggatctaa

SEQ ID NO: 171167 - DNA, 529 bp, Homo sapiens
  Payload ID: 13677
  Gene Symbol: PPP2R2A
  Gene Name: protein phosphatase 2, regulatory subunit B, alpha
  ENST ID: ENST00000523925
  CDS Start-End: 514-529
tttcggtttcttttcctctctgtctggagccagtgatttgctggagctggaggagggaatgatattcagtggtgtttttctcaggtgaaaggagcagtagatgatgatgtagcagaagcagatataatttctacagtagaatttaatcattctggagaattactagcaacaggagataaaggtggtagagttgtcatctttcaacaggagcaggagaacaaaatccagtctcatagcagaggagaatataatgtttacagcaccttccagagccatgaaccagagtttgactacttgaaaagtttagaaatagaagaaaagatcaacaaaattaggtggttaccccagaaaaatgctgctcagtttttattgtctaccaatgataaaacaataaaattatggaaaatcagtgaaagggacaaaagaccagaagggtataacttgaaagaggaggatggaaggtatagagatcctactacagttactacactacgagtgccagtctttaggcctatggatctaatggttg

SEQ ID NO: 171168 - DNA, 830 bp, Homo sapiens
  Payload ID: 13677
  Gene Symbol: PPP2R2A
  Gene Name: protein phosphatase 2, regulatory subunit B, alpha
  ENST ID: ENST00000518397
  CDS Start-End: 207-605
cggggaagccccagagtgaaatctagcatcctgccggctggtctgcccgcccctccttccttttccccccggcccccgtcccctccccccgcaggtgccatccgccgccatccgccctctctacccccccatccccaggtgaggggggtgagttcaggaagcggagaccccgaggaacccagcagggtcaccatttgcagcgcaacatggcaggagctggaggagggaatgatattcagtggtgtttttctcaggtgaaaggagcagtagatgatgatgtagcagaagcagatataatttctacagtagaatttaatcattctggagaattactagcaacaggagataaaggtggtagagttgtcatctttcaacaggagcaggagaacaaaatccagtctcatagcagaggagaatataatgtttacagcaccttccagagccatgaaccagagtttgactacttgaaaagtttagaaatagaagaaaagatcaacaaaattaggtggttaccccagaaaaatgctgctcagtttttattgtctaccaatgtacaggctggatttagtgactcacttccaaagaacagaatatggcaagggtgaaagagtcattgtatagtggagaagcctggcaaacattgtcttaaccaaatgacccaagttaacgccaccagctataaaacaataaaattatggaaaatcagtgaaagggacaaaagaccagaagggtataacttgaaagaggaggatggaaggtatagagatcctactacagttactacactacgagtgccagtctttaggcctatggatctaatggttgaggcc

SEQ ID NO: 171169 - DNA, 784 bp, Homo sapiens
  Payload ID: 13677
  Gene Symbol: PPP2R2A
  Gene Name: protein phosphatase 2, regulatory subunit B, alpha
  ENST ID: ENST00000524169
  CDS Start-End: 193-784
cgcctgcccctgccgctgccgccgccgccgtcgctgtcgtagtcgccgccgccgctgccggagaaagagcacgagcggggaagccccagagtgaaatctagcatcctgccggctgatgatttgcggattaatctttggcatctggaaattacagacaggagttttaacattgtggatatcaagcctgccaatatggaagagctaacagaggtgattacagcagcagaatttcatccaaacagctgtaacacatttgtatacagcagcagtaaaggaactattcggctatgtgacatgagggcatctgccctctgtgatagacattctaaattgtttgaagaacctgaagatcccagtaacaggtcatttttttccgaaatcatctcctctatttcggatgtaaaattcagccatagtggtcgatatatgatgactagagactatttgtcagtcaaaatttgggacttaaatatggaaaacaggcctgtggaaacataccaggtgcatgaatacctcagaagtaaactctgttcactgtatgaaaatgactgcatatttgacaaatttgaatgttgttggaatggatctgacagtgttgtcatgactggatcttacaataatttcttcagaatgtttgacagaaacacaaagcgagacataaccctagaagcatcgcgggaaaacaataagcctcgcacagttctgaagcctcgcaaagtctgtgcaagtggcaagcgaaagaaagatgaaataagtgttgacagcctagacttcaataagaaaa

SEQ ID NO: 171170 - DNA, 99 bp, Homo sapiens
  Payload ID: 13677
  Gene Symbol: PPP2R2A
  Gene Name: protein phosphatase 2, regulatory subunit B, alpha
  ENST ID: ENST00000630149
  CDS Start-End: 1-99
tttccaggagctggaggagggaatgatattcagtggtgtttttctcaggtgaaaggagcagtagatgatgatgtagcagaagtaggaattttccaaaca

SEQ ID NO: 171171 - DNA, 3128 bp, Homo sapiens
  Payload ID: 13678
  Gene Symbol: PPP2R5A
  Gene Name: protein phosphatase 2, regulatory subunit B', alpha
  Uniprot ID: Q15172
  ENST ID: ENST00000261461
  CDS Start-End: 575-2035
cgcagagggccggggctacggggcagcgccccgggcgatgaggggccggcgttgaccgggaagagcgggcaccgcggcagtggctccgaggggacccgcgatggcagcgccctgagaggaggctccaggcagggcgggctgcgctggcagcggccgctgaggtgctggccggccggctggctggcgacgggggcagaagcgacgagaggcgcgctcggcacccgcacccccgtgcccccgcctcagttgtctaaacttcgggctctcttccacccgctctgcgcgcccagagtcaacaacttcttcacccccctccgcccccgcccttccctccgtcagccccgggagctcgccgcgcgccggggaccaggaacctccagcgctgagatgtggccgtgaggcgttggcgggcggcgaggagaagctcggcggcgtcccggggccggagggccgtggggccggggcgcaggggcgcgagcaccccgcgcctctcccccgcctcctcctgccgtctccgccgctgcccgtgccttgcaagcagcagccggagctgccaagcgtcagggccgcggagatgtcgtcgtcgtcgccgccggcgggggctgccagcgccgccatctcggcctcggagaaagtggacggcttcacccggaaatcggtccgcaaggcgcagaggcagaagcgctcccagggctcgtcgcagtttcgcagccagggcagccaggcagagctgcacccgctgccccagctcaaagatgccacttcaaatgaacaacaagagcttttctgtcagaagttgcagcagtgttgtatactgtttgatttcatggactctgtttcagacttgaagagcaaagaaattaaaagagcaacactgaatgaactggttgagtatgtttcaactaatcgtggtgtaattgttgaatcagcgtattctgatatagtaaaaatgatcagtgctaacatcttccgtacacttcctccaagtgataatccagattttgatccagaagaggatgaacccacgcttgaggcctcttggcctcacatacagttggtatatgaattcttcttgagatttttggagagccctgatttccagcctagcattgcaaaacgatacattgatcagaaattcgtacaacagctcctggagctttttgatagtgaagatcccagagaacgtgacttcctgaagactgttctgcaccgaatttatgggaaatttcttggattaagagcattcatcagaaaacaaattaacaacattttcctcaggtttatatatgaaacagaacatttcaatggtgttgctgaacttcttgaaatattaggaagtattatcaatggctttgcattgccactgaaagcagaacataaacaatttctaatgaaggttcttattcctatgcatactgcaaaaggattagctttgtttcatgctcagctagcatattgtgttgtacagttcctggagaaagatacaacactaacagagccagtgatcagaggactgctgaaattttggccaaaaacctgcagtcagaaagaggtgatgtttttaggagaaattgaagaaatcttagatgtcattgaaccaacacagttcaaaaaaattgaagagccacttttcaagcagatatccaagtgtgtatccagttctcattttcaggttgcagaaagggcattgtacttctggaataacgaatatattcttagtttgattgaggagaacattgataaaattctgccaattatgtttgccagtttgtacaaaatttccaaagaacactggaatccgaccattgtagcactggtatacaatgtgctgaaaaccctaatggaaatgaatggcaagcttttcgatgaccttactagctcatacaaagctgaaagacagagagagaaaaagaaggaattggaacgtgaagaattatggaaaaaattagaggagctaaagctaaagaaagctctagaaaaacagaatagtgcttacaacatgcacagtattctcagcaatacaagtgccgaataaaaaaaaagcctcccacctctgccggataggcagagttttgtatgcttttttgaaatatgtaaaaattacaaaacaaacctcatcagtataatataattaaaaggccaattttttctggcaactgtaaatggaaaaatatatggactaaacgtagccctgtgctgtatcatggccatagtatattgtaacctttgtctaatcattggatttattgtgtcacttctgaagtttcacagaaatgaatgaattttatcatctatgatatgagtgagataattatgggagtggtaagaattatgacttgaattcttctttgattgtgttgcacatagatatggtagtctgctctgtatatttttcccttttataatgtgcttttcacactgctgcaaaccttagttacatcctaggaaaaaatacttcctaaaataaaactaaggtatcatccttacccttctctttgtctcacccagaaatatgatggggggaattacctgccctaacccctccctcaataaatacattactgtactctggaatttaggcaaaaccttaaatctccaggctttttaaagcacaaaatataaataaaagctgggaaagtaaaccaaaattcttcagattgttcctcatgaatatcccccttcctctgcaattctccagagtggtaacagatgggtagaggcagctcaggtgaattacccagcttgcctctcaattcattcctcctcttcctctcaaaggctgaaggcagggcctttccagtcctcacaacctgtccttcacctagtccctcctgacccagggatggaggctttgagtcccacagtgtggtgatacagagcactagttgtcactgcctggctttatttaaaggaactgcagtaggcttcctctgtagagctctgaaaaggttgactatatagaggtcttgtatgtttttacttggtcaagtatttctcacatcttttgttatcagagtaccattccaatctcttaacttgcagttgtgtggaaaactgttttgtaatgaaagatcttcattgggggattgagcagcatttaataaagtctatgtttgtattttgcctta

SEQ ID NO: 171172 - DNA, 1719 bp, Homo sapiens
  Payload ID: 13678
  Gene Symbol: PPP2R5A
  Gene Name: protein phosphatase 2, regulatory subunit B', alpha
  Uniprot ID: Q15172
  ENST ID: ENST00000537030
  CDS Start-End: 278-1567
atgatacagtgcttgttctataatttgtagcatgaatcctatatgagatcttactttagatttcaagtatgttagcagcagtaattagggatgttttcctctaaggaaaattatagttataaaattattatttgttagaaatgattcctgctacttcaaattatttatccttaaatgtagaggattaacaatgaacaacttgaaataacttggttatcacctcagaagtttagtttatcactgatttaatgaagaagggcaagaagaggaaggctttatgataatgaatgccacttcaaatgaacaacaagagcttttctgtcagaagttgcagcagtgttgtatactgtttgatttcatggactctgtttcagacttgaagagcaaagaaattaaaagagcaacactgaatgaactggttgagtatgtttcaactaatcgtggtgtaattgttgaatcagcgtattctgatatagtaaaaatgatcagtgctaacatcttccgtacacttcctccaagtgataatccagattttgatccagaagaggatgaacccacgcttgaggcctcttggcctcacatacagttggtatatgaattcttcttgagatttttggagagccctgatttccagcctagcattgcaaaacgatacattgatcagaaattcgtacaacagctcctggagctttttgatagtgaagatcccagagaacgtgacttcctgaagactgttctgcaccgaatttatgggaaatttcttggattaagagcattcatcagaaaacaaattaacaacattttcctcaggtttatatatgaaacagaacatttcaatggtgttgctgaacttcttgaaatattaggaagtattatcaatggctttgcattgccactgaaagcagaacataaacaatttctaatgaaggttcttattcctatgcatactgcaaaaggattagctttgtttcatgctcagctagcatattgtgttgtacagttcctggagaaagatacaacactaacagagccagtgatcagaggactgctgaaattttggccaaaaacctgcagtcagaaagaggtgatgtttttaggagaaattgaagaaatcttagatgtcattgaaccaacacagttcaaaaaaattgaagagccacttttcaagcagatatccaagtgtgtatccagttctcattttcaggttgcagaaagggcattgtacttctggaataacgaatatattcttagtttgattgaggagaacattgataaaattctgccaattatgtttgccagtttgtacaaaatttccaaagaacactggaatccgaccattgtagcactggtatacaatgtgctgaaaaccctaatggaaatgaatggcaagcttttcgatgaccttactagctcatacaaagctgaaagacagagagagaaaaagaaggaattggaacgtgaagaattatggaaaaaattagaggagctaaagctaaagaaagctctagaaaaacagaatagtgcttacaacatgcacagtattctcagcaatacaagtgccgaataaaaaaaaagcctcccacctctgccggataggcagagttttgtatgcttttttgaaatatgtaaaaattacaaaacaaacctcatcagtataatataattaaaaggccaattttttctggcaactgtaaatggaaaaatatatggactaaacgt

SEQ ID NO: 171173 - DNA, 6795 bp, Homo sapiens
  Payload ID: 13679
  Gene Symbol: PPP2R3A
  Gene Name: protein phosphatase 2, regulatory subunit B'', alpha
  Uniprot ID: Q06190
  ENST ID: ENST00000264977
  CDS Start-End: 618-4070
aggaggaggaggaggaggagaaggaggtaggggcctgcgggtggctgggcggggcgcgctcgggcctccgctcttcacgcgccgcattcgtagcccgagagtccgcgccgcggggaggcttggaggcaagcgctgcccgcgagctgagccgccggaggaggagccgcgggcaacgaggtttctctgtcattcacagaaaaatgaatcatttaaacctttggaggactcagttatcacaatacttctctactaccaactaagatttatgatagtaaatttatgagagcaaatttccatgttatagaactgttgaagaactaaaagaggatattctttcatcaaaataattctgcagtatcataatattactaaataaaattaaaaagcacaattattaaattattaaatttgccacacatgtgcagcagctactgtatcctgatagtgaccaaacctcaaatataaatggtttcccttcatgggaaaagccattatatttggaagaaaccactgaacattgttattaaatatattttcagctaactgtcatttaggagaattttcatgaaacaagttctagaaagttccaagtcccaccagtaagtggatttgatattatggcagcaacttacagacttgtggttagtactgtgaaccactacagcagcgtggtgatagaccggcgttttgaacaagctatacattattgcactggaacctgccacaccttcacacatggaattgactgcattgtggtacaccatagtgtttgtgcagacctcttgcacatccctgtgtctcagttcaaagatgcagatctgaactctatgtttctaccccatgaaaatgggctttcttcggctgaaggagactatccccaacaggccttcacaggcatacccagggtcaagagaggatctacatttcagaatacctacaacttaaaggatattgcaggagaagcaatcagttttgccagtgggaaaataaaagaattttcctttgaaaaactcaaaaactctaaccatgcagcttacagaaagggaaggaaagttaagtctgactcatttaataggaggtcagttgatttggacttgctttgtggccattataacaacgatgggaacgccccatcctttggtttactgcggagttcctcagttgaggaaaaacctttgtctcatagaaactcactggatacgaacctgacttccatgtttcttcaaaacttttctgaagaagacttggttactcagattttggaaaaacataaaatagataatttttcttctgggacagacataaagatgtgcttggacatcttattgaaatgctccgaggatttaaaaaaatgcacagacatcataaaacaatgcataaagaaaaaatcagggagtagcatcagtgaaggaagtggtaatgatacaatttctagctctgaaactgtctatatgaatgtaatgaccaggttagcatcctatctgaaaaagttaccatttgaattcatgcagtctgggaataatgaggctctagatttaacagaactgatcagtaatatgcctagcttacaactgactcccttctccccagtgtttggcactgaacaaccccctaaatatgaagatgttgtccagctctcagcttctgactctggacgatttcaaactattgaattgcaaaatgacaagcctaattctaggaagatggacactgtacaatccattccaaacaactccacaaattccttatataacttagaggtaaatgatcctagaactctaaaagctgtccaggtccaatcacagtcattaaccatgaatcctttagaaaatgtttcttctgacgacttaatggaaactctttatattgaagaagagtcagatggaaagaaagcattagataaaggacaaaagacagagaatggacctagtcatgagttattaaaggtaaatgaacatagagcagaatttccagaacatgctactcatcttaaaaaatgccccaccccaatgcaaaatgaaattggtaagatatttgagaaatcatttgttaatctacctaaggaagactgtaaatcaaaagtttctaaatttgaagagggagaccagagagattttacaaattccagtagccaggaagagatagataaattgttaatggatttggaatctttttcacagaagatggagacctctctaagagagccacttgcgaagggtaaaaactctaattttttaaatagtcacagtcagttgaccggtcagacccttgtagatcttgagcctaaatctaaagtctcttcacccatagaaaaagtctcaccttcctgtctaacaaggattattgaaaccaatggacacaaaatagaggaagaggatcgagccctcttactgcgaatcctggaaagcattgaagactttgctcaagaactagttgaatgcaaatcaagcagagggagcctatcacaagaaaaggaaatgatgcaaattctacaggaaaccttgacaacttcctcccaggccaatttatcagtctgtagaagtcctgttggtgataaagccaaagatactacttcagcagttttgattcagcagactccagaggtgatcaagattcaaaataaaccagaaaagaaacctggaacaccactcccacctccagccacctctccaagtagtccccgacctctctccccggttccccatgtgaataatgttgtgaatgcgccattgtccataaacattccacggttctactttcctgaaggactcccagatacctgtagtaatcatgaacaaactctaagcagaattgaaactgctttcatggatattgaagaacagaaagcagacatttatgaaatggggaaaattgcaaaggtctgtggctgtcctctctattggaaagcccccatgttcagggctgcagggggagagaagacaggatttgtgacagcacagtcattcattgccatgtggagaaagttgctgaataaccatcatgatgatgcctctaaattcatctgtcttctagcaaagcccaactgcagctctctagaacaggaggatttcatccctctacttcaggatgtggtggatacccaccctggtctcacgttcctgaaagatgctccagaattccactcccgctacatcaccacggttattcagagaatattctacacagtcaacagatcttggagtggaaaaattacttcgacagagataagaaaaagcaactttttgcaaaccctagcacttttggaagaagaggaagatataaaccaaattacagattacttctcctatgaacatttctatgttatttattgtaaattctgggaactagatactgatcacgacctctacatcagccaggccgatctgtctcgatacaatgaccaggcttcatcaagcaggattattgaaaggatattctctggtgcagtaacaaggggaaaaacaatacagaaagagggaagaatgagctatgcagattttgtttggtttttgatctctgaagaagacaaaaggaatcctaccagcattgagtattggttccgctgcatggatgtggatggagacggtgtactctccatgtatgagctggagtacttctatgaggagcagtgtgaacggatggaagccatgggaattgagcccttgccattccatgatttactgtgccagatgcttgacctagtgaagccagctgttgatggcaaaataactctaagagatctgaagaggtgcagaatggctcacatcttctatgacactttctttaatctggagaaatacttagaccatgaacagagagatccctttgcggtccagaaggatgttgagaacgatgggcctgagccctcagactgggaccggtttgccgctgaggagtatgagacgcttgttgcagaggaatctgcccaagcacaattccaggaaggctttgaagattatgaaacagatgaacctgcctctccctctgaatttggaaacaaaagcaataaaatattaagtgcaagccttccagagaaatgtggaaagcttcaatcagtggatgaagaatagctgccggtgtctacaatgaaacgaagatgtgtattttaaatgtttctttcttgtgaagagatgttctcgtttgcatactgctttttaaagactttgatttctccaagtgtgtatcatctgcactaggaactttgtttttaagcaataggtctggatacacatttaacttaggaggctcctccaatttgcctcaaacctcttacggagcttctcctcagaagtggtaccatcgccttccaaagtcagcactctacactcttgaatgtaccaaggatctcttggcgacagtaccaagcacggttctctacacaggtgactgaagttgcctctgtgttggctggcatccctgagtcccctccgggctcctatggagcctagaagaaaccttcacttgcagaaaacttgagtcagaaaattctggaacttgaaaaagtagtaagggcctccagaattgacttagccctagtaataaaagcactgccaaaacatctcagagacttcttttatgtatactggagttcaaagatctttaacttacctggcttaatgtaatttcacagttacctgccaaactactagtcactttacatcctcaggtattgtaaccactgggccttccaactttgctggcaagctctggtaacctccctgactgtggatcttatataaaatctcaagataaaaaaacacttcttaaatgaagtatagaatttgactcatacttggaaaaagcccttttaacttttatcttttattcattgaactattgaatgatgtatttaatatccaaattagttgataactgttttcacttcctatcagaaggcctgcttgaagacataaaggaataatgatacattaaaattcttactagatagatatattccttcctcccaggagtattagactagctaatagtaaaggcctcaacgttattctttacttcatgttgaaaacaattactacagatatttcatccacctcagtatttatcaaggaaatggaaaatgatacagctataaaagaaagctgttatttactgtagttgtagatgtattcactacagaatcctacatttttcagcaggccacagtccagccaaatcctataatatccttgaaaagaaactattaaaaaggatagacatttctgatgtaagtaaaacccccaagcaacttaatatccatctgtcagtcatcaacttttcccctagattttttttttaactagttctgaaagtgtcaagaatagcttccctttccaccctacctaggttccctccttgctggcataaaggccaagcagtgaaatgaaccttgggttagagttatggtaggcaaaaagaaaaggagaatttaggaaataaatatgctataaacaaggtacagtacagtgagagttaacaatcctaggaatcctgcctgtcacaagctcccagttccctgtcattttatcttcatgattagaactgatcttccatttaactattacagaaagcagtaactattgcaactatctaatagttcacacaaaagaattaaaagcttaaaaataatttttaggaaacacaatattcaaaatctaaacacactgataaattattaagattaagattatttatgtgataaatgaaatctcctaccaatccatccagcctttaccagggaagaaaagcaattatttcatttcagatagaaatacaaaaaaaaaaaaaatacttttcttagaagccagatatggtttaaatgttttattatccataatgatctaaactaataagattcaccaaaaagtaaaaattcaattttacaatatacatttttttttttaactatttggctttacctttttaccttggttctccttactgaagtcctcttgctttcactttgatctggtttttgaagtctcttaattattggctgggcatggtgactcatgcctgtaatcccggcactttgggaggccaagggaggtgatcacttgagcccaggagtaaagaccagcctgggcaacatagtgagactccgtctctacaaaaaataaatttagctgggcatggtggtgcacatctgtagtcctaccaacttgggaggctgaggcaggagaatcgcttgagccccaggcttcgaggctgcagtgagctatgattacgacactgcactccagcctaggcgacagagcaagaccccattctcttacaaagtctctattataaaagtacatccatcaataccattccatttaaaatgggctattgtaatttacccacattatcacattttcaggaattataagaatgtgttttattgtactccttccttggagctgaatgcaaggaatgtgaattctgaggaattaaggtagaatatatttgactttctggtaaagatcatggttaagtataatcattactgccaaactggaattttcaagttattataatatcccaggccccttgataaaagctgagggttatcatgaccttaatgctaattcaatgagaaatgagtttaatagcataacattaccaaggtaatcaaactaataaaattccatatatcttccctgcatcttgtcactgtgtaccattcaaagtgtttataaaactctagattcatcaaatgagatttgctcagctttttgaaatgttaagatgtgtttggagaaggctgcatgactttgtttttcccttttagcaaaactaaataaagttgtcaaatat

SEQ ID NO: 171174 - DNA, 2196 bp, Homo sapiens
  Payload ID: 13679
  Gene Symbol: PPP2R3A
  Gene Name: protein phosphatase 2, regulatory subunit B'', alpha
  Uniprot ID: Q06190
  ENST ID: ENST00000334546
  CDS Start-End: 336-1925
ctttcccagaaggctccatattctcaacatgtgcaggtcaatttgacataaagctaccaacaaggagcaacaggcccactgcaggctgtgtttataacttgaaaattatgagcaggtattgggagccacagactgtatttgggaaccagctgcatgtcaggacaagcatagattgtggtctgtggaggctgggagagcacaatgcttgaatttcatttctttgggagataagaagaaaaaataccttcctacctgacaagattgacaacttgctaaatctgattatcttcagaagtgtgctggacagttgcgaagtaaacatttacttttcaaagatgatgatcaaggaaacatctctacgaagggacccggatttaaggggagagctagctttcctggcaaggggctgtgattttgttctcccttcacggtttaagaagcggctgaagtcatttcagcagacacagattcaaaataaaccagaaaagaaacctggaacaccactcccacctccagccacctctccaagtagtccccgacctctctccccggttccccatgtgaataatgttgtgaatgcgccattgtccataaacattccacggttctactttcctgaaggactcccagatacctgtagtaatcatgaacaaactctaagcagaattgaaactgctttcatggatattgaagaacagaaagcagacatttatgaaatggggaaaattgcaaaggtctgtggctgtcctctctattggaaagcccccatgttcagggctgcagggggagagaagacaggatttgtgacagcacagtcattcattgccatgtggagaaagttgctgaataaccatcatgatgatgcctctaaattcatctgtcttctagcaaagcccaactgcagctctctagaacaggaggatttcatccctctacttcaggatgtggtggatacccaccctggtctcacgttcctgaaagatgctccagaattccactcccgctacatcaccacggttattcagagaatattctacacagtcaacagatcttggagtggaaaaattacttcgacagagataagaaaaagcaactttttgcaaaccctagcacttttggaagaagaggaagatataaaccaaattacagattacttctcctatgaacatttctatgttatttattgtaaattctgggaactagatactgatcacgacctctacatcagccaggccgatctgtctcgatacaatgaccaggcttcatcaagcaggattattgaaaggatattctctggtgcagtaacaaggggaaaaacaatacagaaagagggaagaatgagctatgcagattttgtttggtttttgatctctgaagaagacaaaaggaatcctaccagcattgagtattggttccgctgcatggatgtggatggagacggtgtactctccatgtatgagctggagtacttctatgaggagcagtgtgaacggatggaagccatgggaattgagcccttgccattccatgatttactgtgccagatgcttgacctagtgaagccagctgttgatggcaaaataactctaagagatctgaagaggtgcagaatggctcacatcttctatgacactttctttaatctggagaaatacttagaccatgaacagagagatccctttgcggtccagaaggatgttgagaacgatgggcctgagccctcagactgggaccggtttgccgctgaggagtatgagacgcttgttgcagaggaatctgcccaagcacaattccaggaaggctttgaagattatgaaacagatgaacctgcctctccctctgaatttggaaacaaaagcaataaaatattaagtgcaagccttccagagaaatgtggaaagcttcaatcagtggatgaagaatagctgccggtgtctacaatgaaacgaagatgtgtattttaaatgtttctttcttgtgaagagatgttctcgtttgcatactgctttttaaagactttgatttctccaagtgtgtatcatctgcactaggaactttgtttttaagcaataggtctggatacacatttaacttaggaggctcctccaatttgcctcaaacctcttacggagcttctcctcagaagtggtaccatcgccttccaaagtcagcactctacactcttgaatgtaccaa

SEQ ID NO: 171175 - DNA, 806 bp, Homo sapiens
  Payload ID: 13679
  Gene Symbol: PPP2R3A
  Gene Name: protein phosphatase 2, regulatory subunit B'', alpha
  ENST ID: ENST00000447251
  CDS Start-End: 1-574
aaacattccacggttctactttcctgaaggactcccagatacctgtagtaatcatgaacaaactctaagcagaattgaaactgctttcatggatattgaagaacagaaagcagacatttatgaaatggggaaaattgcaaaggtctgtggctgtcctctctattggaaagcccccatgttcagggctgcagggggagagaagacaggatttgtgacagcacagtcattcattgccatgtggagaaagttgctgaataaccatcatgatgatgcctctaaattcatctgtcttctagcaaagcccaactgcagctctctagaacaggaggatttcatccctctacttcaggatgtggtggatacccaccctggtctcacgttcctgaaagatgctccagaattccactcccgctacatcaccacggttattcagagaatattctacacagtcaacagatcttggagtggaaaaattacttcgacagagataagaaaaagcaactttttgcaaagtaatgaagacttggcaaaattagcagtccatgatggatatacaaacatttttttattctaaaatgaacagtcatcatcacagtcagtgttgatatttattgaacacctgatgcctgcctgggctctcagtagaccctagcacttttggaagaagaggaagatataaaccaaattacagattacttctcctatgaacatttctatgttatttattgtaaattctgggaactagatactgatcacgacctctacatcagccaggccgatctgtctcgatacaatgaccaggcttc

SEQ ID NO: 171176 - DNA, 1782 bp, Homo sapiens
  Payload ID: 13679
  Gene Symbol: PPP2R3A
  Gene Name: protein phosphatase 2, regulatory subunit B'', alpha
  Uniprot ID: Q06190
  ENST ID: ENST00000490467
  CDS Start-End: 320-1564
tcttcacgcgccgcattcgtagcccgagagtccgcgccgcggggaggcttggaggcaagcgctgcccgcgagctgagccgccggaggaggagccgcgggcaacgagattcaaaataaaccagaaaagaaacctggaacaccactcccacctccagccacctctccaagtagtccccgacctctctccccggttccccatgtgaataatgttgtgaatgcgccattgtccataaacattccacggttctactttcctgaaggactcccagatacctgtagtaatcatgaacaaactctaagcagaattgaaactgctttcatggatattgaagaacagaaagcagacatttatgaaatggggaaaattgcaaaggtctgtggctgtcctctctattggaaagcccccatgttcagggctgcagggggagagaagacaggatttgtgacagcacagtcattcattgccatgtggagaaagttgctgaataaccatcatgatgatgcctctaaattcatctgtcttctagcaaagcccaactgcagctctctagaacaggaggatttcatccctctacttcaggatgtggtggatacccaccctggtctcacgttcctgaaagatgctccagaattccactcccgctacatcaccacggttattcagagaatattctacacagtcaacagatcttggagtggaaaaattacttcgacagagataagaaaaagcaactttttgcaaaccctagcacttttggaagaagaggaagatataaaccaaattacagattacttctcctatgaacatttctatgttatttattgtaaattctgggaactagatactgatcacgacctctacatcagccaggccgatctgtctcgatacaatgaccaggcttcatcaagcaggattattgaaaggatattctctggtgcagtaacaaggggaaaaacaatacagaaagagggaagaatgagctatgcagattttgtttggtttttgatctctgaagaagacaaaaggaatcctaccagcattgagtattggttccgctgcatggatgtggatggagacggtgtactctccatgtatgagctggagtacttctatgaggagcagtgtgaacggatggaagccatgggaattgagcccttgccattccatgatttactgtgccagatgcttgacctagtgaagccagctgttgatggcaaaataactctaagagatctgaagaggtgcagaatggctcacatcttctatgacactttctttaatctggagaaatacttagaccatgaacagagagatccctttgcggtccagaaggatgttgagaacgatgggcctgagccctcagactgggaccggtttgccgctgaggagtatgagacgcttgttgcagaggaatctgcccaagcacaattccaggaaggctttgaagattatgaaacagatgaacctgcctctccctctgaatttggaaacaaaagcaataaaatattaagtgcaagccttccagagaaatgtggaaagcttcaatcagtggatgaagaatagctgccggtgtctacaatgaaacgaagatgtgtattttaaatgtttctttcttgtgaagagatgttctcgtttgcatactgctttttaaagactttgatttctccaagtgtgtatcatctgcactaggaactttgtttttaagcaataggtctggatacacatttaacttaggaggctcctccaatttgcctcaaacctcttacggagcttctcctcag

SEQ ID NO: 171177 - DNA, 2008 bp, Homo sapiens
  Payload ID: 13680
  Gene Symbol: PPP2R2B
  Gene Name: protein phosphatase 2, regulatory subunit B, beta
  Uniprot ID: Q00005
  ENST ID: ENST00000336640
  CDS Start-End: 232-1572
cttgggggcttctgagtttgagctgcatgcagaaatgtaaggcagtgcttcctggcgctgatggcaaaatgggacccatctccagttattcctcgggcaccccagctttgcaaatctgggaaagaacctacataaacatattggtgatgtagccagcttaaaaggccgagagaatccttatggattcaggagactgtttttttatttagatttttattttttatttggaagatgaaatgcttctctcgttacctgccttacatcttcagacctccgaacaccatcctttcttccagctgccacacagaagctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaataagatggctcccccagcagaatgcagcttactttcttctgtctactaatgataaaactgtgaagctgtggaaagtcagcgagcgtgataagaggccagaaggctacaatctgaaagatgaggagggccggctccgggatcctgccaccatcacaaccctgcgggtgcctgtcctgagacccatggacctgatggtggaggccaccccacgaagagtatttgccaacgcacacacatatcacatcaactccatatctgtcaacagcgactatgaaacctacatgtccgctgatgacctgaggattaacctatggaactttgaaataaccaatcaaagttttaatattgtggacattaagccagccaacatggaggagctcacggaggtgatcacagcagccgagttccacccccatcattgcaacaccttcgtgtacagcagcagcaaagggacaatccggctgtgtgacatgcgggcatctgccctgtgtgacaggcacaccaaattttttgaagagccggaagatccaagcaacagatcatttttctctgaaattatctcttcgatttcggatgtgaagttcagccacagtgggaggtatatcatgaccagggactacttgaccgtcaaagtctgggatctcaacatggaaaaccgccccatcgagacttaccaggttcatgactacctccgcagcaagctgtgttccctctatgaaaatgactgcatttttgataaatttgagtgtgtgtggaatgggtcagacagtgtcatcatgacaggctcctacaacaacttcttcaggatgttcgacagaaacaccaagcgtgatgtgacccttgaggcttcgagggaaaacagcaagccccgggctatcctcaaaccccgaaaagtgtgtgtggggggcaagcggagaaaagacgagatcagtgtcgacagtctggactttagcaaaaagatcttgcatacagcttggcatccttcagaaaatattatagcagtggcggctacaaataacctatatatattccaggacaaggttaactaggtggacaagttattacttaataatctcacatactgaatactagtcaaacaagtttttaaatgtttctttgggtcttcatttgatgcattgactttaatttccctatacaggaaatgattggaatagaattaaaaggagtccaacattcccagctccccagttctaagaaacttttgtcaaacccaataggtttgggacacttctgtttagaattgaaagctgccagctaacagtaattcttccatagttgacttgaacttctgatgcttttattgcccagttttctctggtgggtccagtgttttgttcctaggtgtctgctgcgataaaatgaggttgtctgtagtatttaaggagaaaagagataagttttttttaattaagcaattccatttgattgaaaaaaatcaacaaaaaataaacaccgtttactctt

SEQ ID NO: 171178 - DNA, 10704 bp, Homo sapiens
  Payload ID: 13680
  Gene Symbol: PPP2R2B
  Gene Name: protein phosphatase 2, regulatory subunit B, beta
  Uniprot ID: Q00005
  ENST ID: ENST00000394409
  CDS Start-End: 572-1903
cccgcctgccggagccgccctcccgtgggaccagcaccctcattccggccaggcaagcctgaatcctgtccctgccatctcgccactgcagctcgggtccagaaaggcaccattttgtcgcggctgcccgctctcccagggggaggagggatcttttttgcattttggagcggctgccaaggaggggaacctgttgggcatctccccagacccgcttgtgagcgcctccggggcgggcgggcgggaccagacccctcggggcacggcgtatcttggcacccggaggcagcggaggcaggcgcagcatcctcgctgggaactggagctggagtgagcgcaccgcgcgggaggagccgccgcagcctcgcagaacccgagtggaggaggtgacagctccattgccgggtttttattttttttctctccgcctccccgtctcctcctcaggctcggaccatggtgcagtcccactggctcccctgcccccctctcctgtgagactggctgcggggagggatcatggatacttgtctgccggcttctggttcccacgcaagtaagcctgctgtcaatggaggaggacattgatacccgcaaaatcaacaacagtttcctgcgcgaccacagctatgcgaccgaagctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaataagatggctcccccagcagaatgcagcttactttcttctgtctactaatgataaaactgtgaagctgtggaaagtcagcgagcgtgataagaggccagaaggctacaatctgaaagatgaggagggccggctccgggatcctgccaccatcacaaccctgcgggtgcctgtcctgagacccatggacctgatggtggaggccaccccacgaagagtatttgccaacgcacacacatatcacatcaactccatatctgtcaacagcgactatgaaacctacatgtccgctgatgacctgaggattaacctatggaactttgaaataaccaatcaaagttttaatattgtggacattaagccagccaacatggaggagctcacggaggtgatcacagcagccgagttccacccccatcattgcaacaccttcgtgtacagcagcagcaaagggacaatccggctgtgtgacatgcgggcatctgccctgtgtgacaggcacaccaaattttttgaagagccggaagatccaagcaacagatcatttttctctgaaattatctcttcgatttcggatgtgaagttcagccacagtgggaggtatatcatgaccagggactacttgaccgtcaaagtctgggatctcaacatggaaaaccgccccatcgagacttaccaggttcatgactacctccgcagcaagctgtgttccctctatgaaaatgactgcatttttgataaatttgagtgtgtgtggaatgggtcagacagtgtcatcatgacaggctcctacaacaacttcttcaggatgttcgacagaaacaccaagcgtgatgtgacccttgaggcttcgagggaaaacagcaagccccgggctatcctcaaaccccgaaaagtgtgtgtggggggcaagcggagaaaagacgagatcagtgtcgacagtctggactttagcaaaaagatcttgcatacagcttggcatccttcagaaaatattatagcagtggcggctacaaataacctatatatattccaggacaaggttaactaggtggacaagttattacttaataatctcacatactgaatactagtcaaacaagtttttaaatgtttctttgggtcttcatttgatgcattgactttaatttccctatacaggaaatgattggaatagaattaaaaggagtccaacattcccagctccccagttctaagaaacttttgtcaaacccaataggtttgggacacttctgtttagaattgaaagctgccagctaacagtaattcttccatagttgacttgaacttctgatgcttttattgcccagttttctctggtgggtccagtgttttgttcctaggtgtctgctgcgataaaatgaggttgtctgtagtatttaaggagaaaagagataagttttttttaattaagcaattccatttgattgaaaaaaatcaacaaaaaataaacaccgtttactcttagacaaattcttcttgttttgtgaaaaaccagaactagtcagtatctcctgcccctccaccatttttttttccattttccattttcctttgaacaatttcatttaagccagagatttattgcatgaagctgagaagaggatgcagaatgacaaggaaagggcacatcaaccctgctatgctctttttttgtaagctccatagaaacagcctgagaatttggctagggaacttgaatgcttcaggggacagaaagagagcactttcgacacagtgcttcccagagtgagcttggcagggccaggcggggccaaattccatctgctgccttgttactcttgctttttgtgctcttaaatggctccatataatcttctacttacatgttccttggcttttttctcttcaaccttttccagcttatttattccattgacttctaaaggccgagtcctgggtgcttattatctggtgttctaaatgaagcagtaagttggaagcagtgccaccacccctgagtccctgagaaaggctggtctgttctttttgggtgtttctcctaagcagcaccctcccctcctcctggttttggtaaccaaaagtaacaatccatcaacctccattgtacctagaacaaaaatagccaataaaaacgctgagttgtgaagtccaatcaggcacttctaactcaccccaagctcgccatctggaaaaacagaccagaaggctctcttctacagaaatgaactgtggggaaatcaagcagctgtgacatgaagtgaatgaagtccacttgaagctgtggaagatggttcatccttttccccagttgaggatccagatttataacttctagaaagccatttccagaaggttctatgtggcacacccctaggaaaggcactaaatgcatgcaaaggatttataaacttaggaaagtagatgggtggagtccagaaaactggttctgggttaatatctctacatctgtcttgatgactcatttctcctaactcccatttagtgcagggtaaatggtttgagatgagagtttttcaatgaaagggaaattttctttcagtttacagatgtattagaagtcctgactttcaagtgtaatttgctttggaggaggaaaaaatagtgaaagaatcattttatctcaattctaagctactatccatttactaatagctttttggcaaggaaataactgtcaccttaggtaaaaacagtcttgttagatgcagcccaatttcaggaacattaaaatgtaaaaaagtacgtctcagaattgagggagcatgggaacaaagacgagactttctcagtatttctcatttttcctgcaaggaaagcctcgccttaggcatctcaagtaaagtggctaaggtgtaaactctctgggcaagatttctgtcctgactgggacagtgttcttggaggagacatgagagagtcagaaacttctgccagtcatagagagtgatgattttgcagaaggccactgggttattggcctacatttaccaccgacttcctttatggccttttctccacttctccggactcagctcctctgtctgtaccacgtcgggggttgggaccaatcattgtatctcaaacttaagaatcaactcacatttgtactattactcatgtaacatttttttaagtcaccttttcttaaaagcaagacttagcctcctccaaagaaataatatgcatgaaatttcaactctgatatgctaggtttttccctaacattaatcacataattatcaatgtaacaaacatgcacccacataccacctgaaatcattttgtgaaccaccaggagcatgtgtatcaaactttgggaccctgagtaactgatatgacagaagatttatgcccttaggggcatcaaagatggtggttcttcacatattagagtcagcagggctgcccataacacacacaggaataatttttgtcatggtttaaggagttcataggcccctttgcagtttatctgcgaactccaaataaaagcccctacactagtccaacacccttagcatatagatgtacaaactgggatccagagtaggatgagtttgccagagaagaaagagcagagggcagccatcctctcctccatcccctgcaaaggatgcattagagcaaacacccaagactcctggacgggaacaggaggggaaagccctagagattaggcctcagggagcaataaccaccacgatgtttcacaaattaactgttctttaccaggtactgaactaggtattttacatgtgtgatctttcagccccagtactggcaatatttcttagttagtggcacatagaagtcagtctgttttcctgctgacactaaaaactacttgaaggctgatttgctaccttgcaacagttggttcgattctaagggccctatactactttaccccacaaggcctgctgcttggtaagagccatcagattacaactggagggtgtcagttgaatgaaggaaaatggaagccacgccatccctggcttttacaaaaaccatccttgcgcaacattcagttcctgacgttaaaaacaagtaatgcaaaaagctgaactttggtagacattcgtactcttctgtcaggaggaggaagattagttagaaaaaacaaaaaaggaagatactagccagcatcaagaagtgggatatataaaggcagatgggcagtgggaatcaagttgcttcttaactccttcaagtttggctcctgcctttactcttccattgaaaaaaaagcacctttaaacctctcattgatcttgtaattaattcaaccaaatcaacttctattaggcaaccagcatatataagatggaacaattgcaaggtggaataaagatgaagctaaaattctgctagctcagtggcccaatgaaataagtcagctatctccactaaacttcctttgaatattctagggtccattataataaaaggtacacactcaaatgcccaatttctaaggacttgaaaagccataatttccctcccttcaagcctacagagcaactgcctaaagcttccctccccagacaaccccaggcctcatttctttttcagtccctttgctagctgcctgcagggctcaagaaagccctggtaggcctcataatgaggatttagggatgacactatagtccacagcctgaatggtggaacccttactaattttccctcttccgtgatgaatgtgtggatgaagccggtgtgtttttaataatgccaccccacttccaaaacaaatcccctgacacagtctttggacataccaccctgaatgcacccgatctcatctgatcttggaagtgaaatggagtcaggcctggttagtctttggatgggggaagtctagacacaccactgagaaacattcacactgcaacctgattcactgtgcatccaacatgccttcatccacctcttccccctgaacttctaagtcaactctcagggactgctttccaagggagcaaccaacctggtcagtggaaaaaggatgagactgggagacaggaaacgtgggtcctgctcctggtaaccatggaacttaagctacccactcagtccctatgtcagtgtcatcacctgtaaaatggccagaaagacatctatcctagctcagagaattgttattgggagaacaagaaatccatttacttacaactattttgataggtttaaagcaccataaactaataatagcaacaacagtgatgggtaatatactattgctttccatgcctcatctcattatctcctctcccagaccccatggtggcattagtatttccattttgcaaatgagaaaatagactcaagttgtcaacctagccaagggcacaaagcccgagagagatggaaccaggactccaactcaaggtatctgactctaaagccagagctgttaaaatacagctctaacatacaatagttgctaacatttattgagcacttattataagccaggctttgttctacaaatttcacatgtattgacttatttacccctaaaactccagatgcagatactattgttgttctcattttatagatacagaaacagatgaatgacaaccaaatttacacagttcacaagtgacaaagccaggcagttttagttaaagttcttatccactatccccatcatacattatgtgtgtgtgtgtgtgtgtgtgtgtgtgtgtgtgtgtgtgtgtatgcatgtagatggaagttactgatcagaaaacaagccccagtaatgacccataagctcaatgaattaaagattcattggttgcctgggatgtgtcaggcagccaggttctagacaaggggctggagttactaagatatttaaaccactggcccctgccctccaagagatgacactcacataggagaaagtgcatatttgcatactgtaaacatttttacaatgagatatctatgaagggcagaagtcatacagaggaagaaatagttaatcaatgagtgataagaaaaggttctcagaatgtgtcatctaagcagaattttaactaaatttgctcaacaaagcatgatacagcgtttccaataggtagaccaacatataccagaatatgaagcaaaatccatatggcatggaaacagaaagccaatgtttctctccttccattagaaacacattttcgacatactagaactagcctacccctttttccttttgttcatccaataacaaatatttattaaaccttattttaagcactgtatttaagtgtaaagtagacggaaagaataaaaggaaaccaatatttcctgagtagttattgcaatgacaggcattgggagaggcactgttttaaatcattgttaatcacctgataggtagatgtattattccatttttatagcgagaaacagactcaaaagggttagatgacgtagcaggaagttttatctagatctatcctgttccagatcctatacttcttccatcacagttattggtaatgcagagttaccttggcttgattattttccctagcgtggatactcacaaacacgccatttctctgtgactaaatattgcctgacagctgaccaagaatacaaatttggtctgtcatcaaagcagagagtgaagtcaagtggctcacaggtctccaacttctgactttgaccttattatgactgattaactgtcccccaatttagatattccatgccccattggttaaactgctggtggcagaaccatcatgatctgccatctccgctgatccctgcctcagctgcaatcaaagcaatgatcactgtcaggccagaagaaggggcttagccactgccaagacagatcccagtccactcccagccttcccgcccctgctgctcattccccaaaaagtcaacctgggttttcctgggtgaacagtgcccactgaacagctcctgcttgcccatctcaagccctctcagttgccactccaatcattttggctgctgtatttggtttgagaaagagtggagaggacacttcttcataactcatatttgacagaaacccagaaattgtaggaacaagccatgattgctgtgattcttgctctggttggctagggatgccctcccttccagccagagtaatacatacttgtgggagtcatggaagactgaggaagctggagtagaagggaacaggggctttcctcagtggtaaaaggaaaagcaacattttggaactctaaacagttgctcagttgggcgaatttcatgcattcattcattcatttactaaatggttaatgattgttcatgtactgcctgccaagcccatgccagggtggtctgtggaagcagcagtgacagctccatcttcacacagctcacagatagcgggaggtgcagacaaactcacaggcaatggtggcagtggaatgtcaagagcccaggataccgagcctgccagcctgcctgcctgggttaaaatctgagctccaccatgtaaaagctgagcaacctagaaaaatgacaacctctctgtgcctcgattttctcattatgagataaggataaaaacgacatctatctcataaaattgctgtgaagattgcatgatttaatatgcacaaagctcttagaaggatgcctggcccacaaatatgcattcagtgcacatttcttgctacagttctgctaatcctataaaacatatgcactatgatggatgtgtctgggtgccaggaggacacaaaggagcactaactcatccagaccagaagcttcccagaggaggtgattcccaaggtgaaatccgaaagataaagggagtgagttatccaggagaagagaaaggaaaagcatattccagacatcaggataggacagtggaggcaaaacagcatatgctatatatatatggaattcacaacactctggtatgactgattagtaaaaagtaggaaggcagaccaagagaaataaggagacatggtaaggtgagtgggcaataatgcatgatctgaaaaataataatgcatggacttagtgtggttcacatatcaggagcttctccaatagccaggctatgaggcactaaaatgaggaaatatggtttccaaacttcgcaaatacttatagtccagccacaggggatatactgataaactcagctcaaatgtcacctcctcagagatgctttctcaaccacccttagttccatgaggactgcatcattgtttaggccactcctgtatccccagagcacagaacattgtctggctcatagtaggtgctcaaaagttttgttgaatgaatgaacaaataaacgtgtaaggaagtcaggcacagcacttgcccacaggaagcttataagatgagcggcatgccattgggagtttgaatgatatatggagatccaaacagggcatcagaggactgctcagaggagtcagggaattaagaaaaaattgggagccagtgagccaagatgtgttaaaagcaagtgatcaagcttagattgcagtgttagttaatagagcatatgtgtccctgcctgatgcattaccttccctgcagtagttagccttctgggaccctgaaaagcatgcagaaaggttgacagcttacaatcaataccatgttcactgatgcaggaagcaacattatcacatccaagatattgcccccacacccaggctgcagcactaaatattccccataacaaggcaaagggaagtgacaagagctattattctcaaccctcccacttggaaacaagaggtgagacaaaccttcccctagatgttcttagggaaaggcaagacccccaaagaaatctttcagagctgagcacatgcctaatacagcaagacagggatgggagaagattggcattttcatttgcctgggtgtccacaatattgcaggggaagctctgtgggcagctgggaaatacaacaataaattggagggggatgaacaatagggtcagtggggctgtgtgctgagtgaatgctggattttattctacatgcccaattcactccaataagataaacttgacttcctccagtgtggctttcttatttcagcttctctgactgtggcataattgaaagtcatatttcatctagaccattggttttcaactccaaatgcaggtggcttatgaagactcagcctgaatatataaagagaacagcaaacaatcatagttgcatattaaagacaatctatttctccgtaaaggaaagtaaagtgagtcatattacatacaagccacaatacagaactgatctgaaatacactgcggaatggcctttcagtctatgctggactctaacaggaaaaaggcagaaggtggtcaatggtgcatttatttaaacccctcatttcctccctgacgagaagaaggacaacagttcttatttttcatattatttttgaaaaggcagaaaggttaattatatattgacatgatttggatctgtgtcctcaccataatctcatgtcaaattgtaatccccagtgtttgaggtggggccaggtgggaggtgattggatcgtggaggtggatttctcatgcatggtttagcaccatcttcttggtgctattctcgtgatagtgagtaagttctcacgagatctggttgtttaaaggtgtgaagaacctcccctctgtctctcttgctcctgttcctgccatgtaagatatgctggctccccctttgccttctgccatgattgtaagtatccagaggcctctccagaagctgagcagatgtcagcaccatgcttcctgtacagcctgtggaaccatgagccaattaaacctcattcctttac

SEQ ID NO: 171179 - DNA, 2071 bp, Homo sapiens
  Payload ID: 13680
  Gene Symbol: PPP2R2B
  Gene Name: protein phosphatase 2, regulatory subunit B, beta
  Uniprot ID: Q00005
  ENST ID: ENST00000394411
  CDS Start-End: 300-1631
cctcctgcagcagcagcagcagcagcagcagcagcagctgcgagtgcgcgcgtgtgggtgtgagggtgagtgcgctggcgccggctgcagcgccctgcccagctccccgccagcttccctacccccgcctgccggagccgccctcccgtgggaccagcaccctcattccggccaggctcggaccatggtgcagtcccactggctcccctgcccccctctcctgtgagactggctgcggggagggatcatggatacttgtctgccggcttctggttcccacgcaagtaagcctgctgtcaatggaggaggacattgatacccgcaaaatcaacaacagtttcctgcgcgaccacagctatgcgaccgaagctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaataagatggctcccccagcagaatgcagcttactttcttctgtctactaatgataaaactgtgaagctgtggaaagtcagcgagcgtgataagaggccagaaggctacaatctgaaagatgaggagggccggctccgggatcctgccaccatcacaaccctgcgggtgcctgtcctgagacccatggacctgatggtggaggccaccccacgaagagtatttgccaacgcacacacatatcacatcaactccatatctgtcaacagcgactatgaaacctacatgtccgctgatgacctgaggattaacctatggaactttgaaataaccaatcaaagttttaatattgtggacattaagccagccaacatggaggagctcacggaggtgatcacagcagccgagttccacccccatcattgcaacaccttcgtgtacagcagcagcaaagggacaatccggctgtgtgacatgcgggcatctgccctgtgtgacaggcacaccaaattttttgaagagccggaagatccaagcaacagatcatttttctctgaaattatctcttcgatttcggatgtgaagttcagccacagtgggaggtatatcatgaccagggactacttgaccgtcaaagtctgggatctcaacatggaaaaccgccccatcgagacttaccaggttcatgactacctccgcagcaagctgtgttccctctatgaaaatgactgcatttttgataaatttgagtgtgtgtggaatgggtcagacagtgtcatcatgacaggctcctacaacaacttcttcaggatgttcgacagaaacaccaagcgtgatgtgacccttgaggcttcgagggaaaacagcaagccccgggctatcctcaaaccccgaaaagtgtgtgtggggggcaagcggagaaaagacgagatcagtgtcgacagtctggactttagcaaaaagatcttgcatacagcttggcatccttcagaaaatattatagcagtggcggctacaaataacctatatatattccaggacaaggttaactaggtggacaagttattacttaataatctcacatactgaatactagtcaaacaagtttttaaatgtttctttgggtcttcatttgatgcattgactttaatttccctatacaggaaatgattggaatagaattaaaaggagtccaacattcccagctccccagttctaagaaacttttgtcaaacccaataggtttgggacacttctgtttagaattgaaagctgccagctaacagtaattcttccatagttgacttgaacttctgatgcttttattgcccagttttctctggtgggtccagtgttttgttcctaggtgtctgctgcgataaaatgaggttgtctgtagtatttaaggagaaaagagataagttttttttaattaagcaattccatttgattgaaaaaaatcaacaaaaaataaacaccgtttactcttagac

SEQ ID NO: 171180 - DNA, 1982 bp, Homo sapiens
  Payload ID: 13680
  Gene Symbol: PPP2R2B
  Gene Name: protein phosphatase 2, regulatory subunit B, beta
  Uniprot ID: Q00005
  ENST ID: ENST00000394413
  CDS Start-End: 202-1707
aggacgctgccagggcctgagaagggacaaactccaattgctccagttcaaactggtcctggcctggtcaaacggaggagacagagcagtgattcacagcaggacgtggtacttgcagactgaccgtcctctcaggactcactagggtctcttctctgacgagatgatacctggaattgggacactcacccaggacacactatggtgcttcagccaagtgaaaggcactatcgagattggaaccacagaaggctcggaccatggtgcagtcccactggctcccctgcccccctctcctgtgagactggctgcggggagggatcatggatacttgtctgccggcttctggttcccacgcaagtaagcctgctgtcaatggaggaggacattgatacccgcaaaatcaacaacagtttcctgcgcgaccacagctatgcgaccgaagctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaataagatggctcccccagcagaatgcagcttactttcttctgtctactaatgataaaactgtgaagctgtggaaagtcagcgagcgtgataagaggccagaaggctacaatctgaaagatgaggagggccggctccgggatcctgccaccatcacaaccctgcgggtgcctgtcctgagacccatggacctgatggtggaggccaccccacgaagagtatttgccaacgcacacacatatcacatcaactccatatctgtcaacagcgactatgaaacctacatgtccgctgatgacctgaggattaacctatggaactttgaaataaccaatcaaagttttaatattgtggacattaagccagccaacatggaggagctcacggaggtgatcacagcagccgagttccacccccatcattgcaacaccttcgtgtacagcagcagcaaagggacaatccggctgtgtgacatgcgggcatctgccctgtgtgacaggcacaccaaattttttgaagagccggaagatccaagcaacagatcatttttctctgaaattatctcttcgatttcggatgtgaagttcagccacagtgggaggtatatcatgaccagggactacttgaccgtcaaagtctgggatctcaacatggaaaaccgccccatcgagacttaccaggttcatgactacctccgcagcaagctgtgttccctctatgaaaatgactgcatttttgataaatttgagtgtgtgtggaatgggtcagacagtgtcatcatgacaggctcctacaacaacttcttcaggatgttcgacagaaacaccaagcgtgatgtgacccttgaggcttcgagggaaaacagcaagccccgggctatcctcaaaccccgaaaagtgtgtgtggggggcaagcggagaaaagacgagatcagtgtcgacagtctggactttagcaaaaagatcttgcatacagcttggcatccttcagaaaatattatagcagtggcggctacaaataacctatatatattccaggacaaggttaactaggtggacaagttattacttaataatctcacatactgaatactagtcaaacaagtttttaaatgtttctttgggtcttcatttgatgcattgactttaatttccctatacaggaaatgattggaatagaattaaaaggagtccaacattcccagctccccagttctaagaaacttttgtcaaacccaataggtttgggacacttctgtttagaattgaaagctgccagctaacagtaattcttccatagttgacttgaacttctgatgcttttattg

SEQ ID NO: 171181 - DNA, 2262 bp, Homo sapiens
  Payload ID: 13680
  Gene Symbol: PPP2R2B
  Gene Name: protein phosphatase 2, regulatory subunit B, beta
  Uniprot ID: Q00005
  ENST ID: ENST00000394414
  CDS Start-End: 290-1819
gcaaatcctgttcagaggagcttcagccaatgaagaggctatatcccggcttgcttgggggcttctgagtttgagctgcatgcagaaatgtaaggcagtgcttcctggcgctgatggcaaaatgggacccatctccagttattcctcgggcaccccagctttgcaaatctgggaaagaacctacataaacatattggtgatgtagccagcttaaaaggccgagagaatccttatggattcaggagactgtttttttatttagatttttattttttatttggaagatgaaatgcttctctcgttacctgccttacatcttcagacctccgaacaccatcctttcttccagctgccacacagaaggctcggaccatggtgcagtcccactggctcccctgcccccctctcctgtgagactggctgcggggagggatcatggatacttgtctgccggcttctggttcccacgcaagtaagcctgctgtcaatggaggaggacattgatacccgcaaaatcaacaacagtttcctgcgcgaccacagctatgcgaccgaagctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaataagatggctcccccagcagaatgcagcttactttcttctgtctactaatgataaaactgtgaagctgtggaaagtcagcgagcgtgataagaggccagaaggctacaatctgaaagatgaggagggccggctccgggatcctgccaccatcacaaccctgcgggtgcctgtcctgagacccatggacctgatggtggaggccaccccacgaagagtatttgccaacgcacacacatatcacatcaactccatatctgtcaacagcgactatgaaacctacatgtccgctgatgacctgaggattaacctatggaactttgaaataaccaatcaaagttttaatattgtggacattaagccagccaacatggaggagctcacggaggtgatcacagcagccgagttccacccccatcattgcaacaccttcgtgtacagcagcagcaaagggacaatccggctgtgtgacatgcgggcatctgccctgtgtgacaggcacaccaaattttttgaagagccggaagatccaagcaacagatcatttttctctgaaattatctcttcgatttcggatgtgaagttcagccacagtgggaggtatatcatgaccagggactacttgaccgtcaaagtctgggatctcaacatggaaaaccgccccatcgagacttaccaggttcatgactacctccgcagcaagctgtgttccctctatgaaaatgactgcatttttgataaatttgagtgtgtgtggaatgggtcagacagtgtcatcatgacaggctcctacaacaacttcttcaggatgttcgacagaaacaccaagcgtgatgtgacccttgaggcttcgagggaaaacagcaagccccgggctatcctcaaaccccgaaaagtgtgtgtggggggcaagcggagaaaagacgagatcagtgtcgacagtctggactttagcaaaaagatcttgcatacagcttggcatccttcagaaaatattatagcagtggcggctacaaataacctatatatattccaggacaaggttaactaggtggacaagttattacttaataatctcacatactgaatactagtcaaacaagtttttaaatgtttctttgggtcttcatttgatgcattgactttaatttccctatacaggaaatgattggaatagaattaaaaggagtccaacattcccagctccccagttctaagaaacttttgtcaaacccaataggtttgggacacttctgtttagaattgaaagctgccagctaacagtaattcttccatagttgacttgaacttctgatgcttttattgcccagttttctctggtgggtccagtgttttgttcctaggtgtctgctgcgataaaatgaggttgtctgtagtatttaaggagaaaagagataagttttttttaattaagcaattccatttgattgaaaaaaatcaacaaaaaataaacaccgtttactcttagacaaa

SEQ ID NO: 171182 - DNA, 2569 bp, Homo sapiens
  Payload ID: 13680
  Gene Symbol: PPP2R2B
  Gene Name: protein phosphatase 2, regulatory subunit B, beta
  Uniprot ID: Q00005
  ENST ID: ENST00000453001
  CDS Start-End: 833-2131
aatgcaccagccgcctccagcctcctgcagcagcagcagcagcagcagcagcagcagctgcgagtgcgcgcgtgtgggtgtgagggtgagtgcgctggcgccggctgcagcgccctgcccagctccccgccagcttccctacccccgcctgccggagccgccctcccgtgggaccagcaccctcattccggccaggcaagcctgaatcctgtccctgccatctcgccactgcagctcgggtccagaaaggcaccattttgtcgcggctgcccgctctcccagggggaggagggatcttttttgcattttggagcggctgccaaggaggggaacctgttgggcatctccccagacccgcttgtgagcgcctccggggcgggcgggcgggaccagacccctcggggcacggcgtatcttggcacccggaggcagcggaggcaggcgcagcatcctcgctgggaactggagctggagtgagcgcaccgcgcgggaggagccgccgcagcctcgcagaacccgagtggaggaggtgacagctccattgccgggtttttattttttttctctccgcctccccgtctcctcctcaggctcggaccatggtgcagtcccactggctcccctgcccccctctcctgtgagactggctgcggggagggatcatggatacttgtctgccggcttctggttcccacgcaagtaagcctgctgtcaatggaggaggacattgatacccgcaaaatcaacaacagtttcctgcgcgaccacagctatgcgaccgaaggagccaagggagaacccaagacagagaatagtggcccaataatgaagcatgaattatccagatgaaaacacctatggaaataaagctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaataagatggctcccccagcagaatgcagcttactttcttctgtctactaatgataaaactgtgaagctgtggaaagtcagcgagcgtgataagaggccagaaggctacaatctgaaagatgaggagggccggctccgggatcctgccaccatcacaaccctgcgggtgcctgtcctgagacccatggacctgatggtggaggccaccccacgaagagtatttgccaacgcacacacatatcacatcaactccatatctgtcaacagcgactatgaaacctacatgtccgctgatgacctgaggattaacctatggaactttgaaataaccaatcaaagttttaatattgtggacattaagccagccaacatggaggagctcacggaggtgatcacagcagccgagttccacccccatcattgcaacaccttcgtgtacagcagcagcaaagggacaatccggctgtgtgacatgcgggcatctgccctgtgtgacaggcacaccaaattttttgaagagccggaagatccaagcaacagatcatttttctctgaaattatctcttcgatttcggatgtgaagttcagccacagtgggaggtatatcatgaccagggactacttgaccgtcaaagtctgggatctcaacatggaaaaccgccccatcgagacttaccaggttcatgactacctccgcagcaagctgtgttccctctatgaaaatgactgcatttttgataaatttgagtgtgtgtggaatgggtcagacagtgtcatcatgacaggctcctacaacaacttcttcaggatgttcgacagaaacaccaagcgtgatgtgacccttgaggcttcgagggaaaacagcaagccccgggctatcctcaaaccccgaaaagtgtgtgtggggggcaagcggagaaaagacgagatcagtgtcgacagtctggactttagcaaaaagatcttgcatacagcttggcatccttcagaaaatattatagcagtggcggctacaaataacctatatatattccaggacaaggttaactaggtggacaagttattacttaataatctcacatactgaatactagtcaaacaagtttttaaatgtttctttgggtcttcatttgatgcattgactttaatttccctatacaggaaatgattggaatagaattaaaaggagtccaacattcccagctccccagttctaagaaacttttgtcaaacccaataggtttgggacacttctgtttagaattgaaagctgccagctaacagtaattcttccatagttgacttgaacttctgatgcttttattgcccagttttctctggtgggtccagtgttttgttcctaggtgtctgctgcgataaaatgaggttgtctgtagtatttaaggagaaaagagataagttttttttaattaagcaattccatttgattgaaaaaaatcaacaaaaaataaacaccgtttactcttag

SEQ ID NO: 171183 - DNA, 553 bp, Homo sapiens
  Payload ID: 13680
  Gene Symbol: PPP2R2B
  Gene Name: protein phosphatase 2, regulatory subunit B, beta
  ENST ID: ENST00000508267
  CDS Start-End: 379-553
agtcacacaggggatgactgcaagtccttcgtaaccactccaggacgctgccagggcctgagaagggacaaactccaattgctccagttcaaactggtcctggcctggtcaaacggaggagacagagcagtgattcacagcaggacgtggaattgggacactcacccaggacacactatggtgcttcagccaagtgaaaggcactatcgagattggaaccacagaaggaaactcatcttttcttgaaattggccctatttacacacagaatgagctgaaaagacttcgctgttattaaaccttcaagaatgttctcatgtgccttgcttccccttcgccttctgccatgattgtaagtttcctgagacctccccagccatgcagaactctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccg

SEQ ID NO: 171184 - DNA, 2011 bp, Homo sapiens
  Payload ID: 13680
  Gene Symbol: PPP2R2B
  Gene Name: protein phosphatase 2, regulatory subunit B, beta
  Uniprot ID: Q00005
  ENST ID: ENST00000504198
  CDS Start-End: 226-1575
agtattcccgtgaaaagggccagtcacacaggggatgactgcaagtccttcgtaaccactccaggacgctgccagggcctgagaagggacaaactccaattgctccagttcaaactggtcctggcctggtcaaacggaggagacagagcagtgattcacagcaggacgtggtacttgcagactgaccgtcctctcaggactcactagggtctcttctctgacgagatgatacctggaattgggacactcacccaggacacactatggtgcttcagccaagtgaaaggcactatcgagattggaaccacagaagctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaataagatggctcccccagcagaatgcagcttactttcttctgtctactaatgataaaactgtgaagctgtggaaagtcagcgagcgtgataagaggccagaaggctacaatctgaaagatgaggagggccggctccgggatcctgccaccatcacaaccctgcgggtgcctgtcctgagacccatggacctgatggtggaggccaccccacgaagagtatttgccaacgcacacacatatcacatcaactccatatctgtcaacagcgactatgaaacctacatgtccgctgatgacctgaggattaacctatggaactttgaaataaccaatcaaagttttaatattgtggacattaagccagccaacatggaggagctcacggaggtgatcacagcagccgagttccacccccatcattgcaacaccttcgtgtacagcagcagcaaagggacaatccggctgtgtgacatgcgggcatctgccctgtgtgacaggcacaccaaattttttgaagagccggaagatccaagcaacagatcatttttctctgaaattatctcttcgatttcggatgtgaagttcagccacagtgggaggtatatcatgaccagggactacttgaccgtcaaagtctgggatctcaacatggaaaaccgccccatcgagacttaccaggttcatgactacctccgcagcaagctgtgttccctctatgaaaatgactgcatttttgataaatttgagtgtgtgtggaatgggtcagacagtgtcatcatgacaggctcctacaacaacttcttcaggatgttcgacagaaacaccaagcgtgatgtgacccttgaggcttcgagggaaaacagcaagccccgggctatcctcaaaccccgaaaagtgtgtgtggggggcaagcggagaaaagacgagatcagtgtcgacagtctggactttagcaaaaagatcttgcatacagcttggcatccttcagaaaatattatagcagtggcggctacaaataacctatatatattccaggacaaggttaactaggtggacaagttattacttaataatctcacatactgaatactagtcaaacaagtttttaaatgtttctttgggtcttcatttgatgcattgactttaatttccctatacaggaaatgattggaatagaattaaaaggagtccaacattcccagctccccagttctaagaaacttttgtcaaacccaataggtttgggacacttctgtttagaattgaaagctgccagctaacagtaattcttccatagttgacttgaacttctgatgcttttattgcccagttttctctggtgggtccagtgttttgttcctaggtgtctgctgcgataaaatgaggttgtctgtagtatttaaggagaaaagagataagttttttttaattaagcaattccatttgattgaaaaaaatcaacaaaaaataaacaccgtttactctt

SEQ ID NO: 171185 - DNA, 583 bp, Homo sapiens
  Payload ID: 13680
  Gene Symbol: PPP2R2B
  Gene Name: protein phosphatase 2, regulatory subunit B, beta
  ENST ID: ENST00000515880
  CDS Start-End: 217-330
gtttgagctgcatgcagaaatgtaaggcagtgcttcctggcgctgatggcaaaatgggacccatctccagttattcctcgggcaccccagctttgcaaatctgggaaagaacctacataaacatattggtgatgtagccagcttaaaaggccgagagaatccttatggattcaggagactgtttttttatttagatttttattttttatttggaagatgaaatgcttctctcgttacctgccttacatcttcagacctccgaacaccatcctttcttccagctgccacacagaaggtagaatcctgagactgggggctgtgtgtttataatgaaggaagcttgtattatatcataagctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaataagatggctccc

SEQ ID NO: 171186 - DNA, 570 bp, Homo sapiens
  Payload ID: 13680
  Gene Symbol: PPP2R2B
  Gene Name: protein phosphatase 2, regulatory subunit B, beta
  ENST ID: ENST00000512011
  CDS Start-End: 189-338
agtgcttcctggcgctgatggcaaaatgggacccatctccagttattcctcgggcaccccagctttgcaaatctgggaaagaacctacataaacatattggtgatgtagccagcttaaaaggccgagagaatccttatggattcaggagactgtttttttatttagatttttattttttatttggaagatgaaatgcttctctcgttacctgccttacatcttcagacctccgaacaccatcctttcttccagctgccacacagaaggaaactcatcttttcttgaaattggccctatttacacacagaatgagctgaaaagacttcgctgttattaaaccttcaagaatgttctcctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaat

SEQ ID NO: 171187 - DNA, 572 bp, Homo sapiens
  Payload ID: 13680
  Gene Symbol: PPP2R2B
  Gene Name: protein phosphatase 2, regulatory subunit B, beta
  ENST ID: ENST00000504565
  CDS Start-End: 298-420
actcactagggtctcttctctgacgagatgatacctggtgtgcaagtctccttttagaaatgcatagattctgctatatatttcttttcttgttggtctcttaagaacaactgggagctcttacctaacctgaagtgtctccttgtgttgttttcaggaattgggacactcacccaggacacactatggtgcttcagccaagtgaaaggcactatcgagattggaaccacagaagatgtgccttgcttccccttcgccttctgccatgattgtaagtttcctgagacctccccagccatgcagaactgctcggaccatggtgcagtcccactggctcccctgcccccctctcctgtgagactggctgcggggagggatcatggatacttgtctgccggcttctggttcccacgcaagtaagcctgctgtcaatggaggaggacattgatacccgcaaaatcaacaacagtttcctgcgcgaccacagctatgcgaccgaagctgacattatctctacggtagaattcaaccacacgggagaattactagcgacaggggacaaggggggtcgg

SEQ ID NO: 171188 - DNA, 512 bp, Homo sapiens
  Payload ID: 13680
  Gene Symbol: PPP2R2B
  Gene Name: protein phosphatase 2, regulatory subunit B, beta
  ENST ID: ENST00000512984
  CDS Start-End: 1-236
gtgggaggtatatcatgaccagggactacttgaccgtcaaagtctgggatctcaacatggaaaaccgccccatcgagacttaccaggttcatgactacctccgcagcaagctgtgttccctctatgaaaatgactgcatttttgataaatttgagtgtgtgtggaatgggtcagacaggcttggaaggagtctccacgtggcaaaggacccaagtcacactgaccagttggtataggacagagagcaaagcaactgtgacataagaacaaaatccaccatgggaaaaagaagccagccctctcattttattatttatttatagtgtcatcatgacaggctcctacaacaacttcttcaggatgttcgacagaaacaccaagcgtgatgtgacccttgaggcttcgagggaaaacagcaagccccgggctatcctcaaaccccgaaaagtgtgtgtggggggcaagcggagaaaagacgagatcagtgtcgacagtctggactttagcaaaaa

SEQ ID NO: 171189 - DNA, 1927 bp, Homo sapiens
  Payload ID: 13680
  Gene Symbol: PPP2R2B
  Gene Name: protein phosphatase 2, regulatory subunit B, beta
  ENST ID: ENST00000512639
  CDS Start-End: 511-645
aatcctgtccctgccatctcgccactgcagctcgggtccagaaaggcaccattttgtcgcggctgcccgctctcccagggggaggagggatcttttttgcattttggagcggctgccaaggaggggaacctgttgggcatctccccagacccgcttgtgagcgcctccggggcgggcgggcgggaccagacccctcggggcacggcgtatcttggcacccggaggcagcggaggcaggcgcagcatcctcgctgggaactggagctggagtgagcgcaccgcgcgggaggagccgccgcagcctcgcagaacccgagtggaggaggtgacagctccattgccgggtttttattttttttctctccgcctccccgtctcctcctcaggctcggaccatggtgcagtcccactggctcccctgcccccctctcctgtgagactggctgcggggagggatcatggatacttgtctgccggcttctggttcccacgcaagtaagcctgctgtcaatggaggaggacattgatacccgcaaaatcaacaacagtttcctgcgcgaccacagctatgcgaccgaaggagccaagggagaacccaagacagagaatagtggcccaataatgaagcatgaattatccagatgaaaacacctatggaaataaagctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaataagatggctcccccagcagaatgcagcttactttcttctgtctactaatgataaaactgtgaagctgtggaaagtcagcgagcgtgataagaggccagaaggctacaatctgaaagatgaggagggccggctccgggatcctgccaccatcacaaccctgcgggtgcctgtcctgagacccatggacctgatggtggaggccaccccacgaagagtatttgccaacgcacacacatatcacatcaactccatatctgtcaacagcgactatgaaacctacatgtccgctgatgacctgaggattaacctatggaactttgaaataaccaatcaaagttttaatattgtggacattaagccagccaacatggaggagctcacggaggtgatcacagcagccgagttccacccccatcattgcaacaccttcgtgtacagcagcagcaaagggacaatccggctgtgtgacatgcgggcatctgccctgtgtgacaggcacaccaaattttttgaagagccggaagatccaagcaacagatcatttttctctgaaattatctcttcgatttcggatgtgaagttcagccacagtgggaggtatatcatgaccagggactacttgaccgtcaaagtctgggatctcaacatggaaaaccgccccatcgagacttaccaggttcatgactacctccgcagcaagctgtgttccctctatgaaaatgactgcatttttgataaatttgagtgtgtgtggaatgggtcagacagtgtcatcatgacaggctcctacaacaacttcttcaggatgttcgacagaaacaccaagcgtgatgtgacccttgaggcttcgagggaaaacagcaagccccgggctatcctcaaaccccgaaaagtgtgtgtggggggcaagcggagaaaagacgagatcagtgtcgacagtctggactttagcaaaaagatcttgcatacagcttggcatccttcagaaaatattatagcagtggcggctacaaataacctatatatattccaggacaaggttaactag

SEQ ID NO: 171190 - DNA, 2042 bp, Homo sapiens
  Payload ID: 13680
  Gene Symbol: PPP2R2B
  Gene Name: protein phosphatase 2, regulatory subunit B, beta
  Uniprot ID: Q00005
  ENST ID: ENST00000508545
  CDS Start-End: 301-1599
gtgaagtcagtggccaccagaccctgagctccccgccccatgtgctgtggagtctaggatgttgaagagagctgggaggagatgccaagaacactaggctgcttcctaccatctagcttacagtccaacatgtgagtaacaccaatacaaatgaaaagccatcaaatgtgtccaatagtgaatatcatcccggcagtctctgagctaggagggagagtcctggagaggtgtttattttctgatataaaaaaggagccaagggagaacccaagacagagaatagtggcccaataatgaagcatgaattatccagatgaaaacacctatggaaataaagctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaataagatggctcccccagcagaatgcagcttactttcttctgtctactaatgataaaactgtgaagctgtggaaagtcagcgagcgtgataagaggccagaaggctacaatctgaaagatgaggagggccggctccgggatcctgccaccatcacaaccctgcgggtgcctgtcctgagacccatggacctgatggtggaggccaccccacgaagagtatttgccaacgcacacacatatcacatcaactccatatctgtcaacagcgactatgaaacctacatgtccgctgatgacctgaggattaacctatggaactttgaaataaccaatcaaagttttaatattgtggacattaagccagccaacatggaggagctcacggaggtgatcacagcagccgagttccacccccatcattgcaacaccttcgtgtacagcagcagcaaagggacaatccggctgtgtgacatgcgggcatctgccctgtgtgacaggcacaccaaattttttgaagagccggaagatccaagcaacagatcatttttctctgaaattatctcttcgatttcggatgtgaagttcagccacagtgggaggtatatcatgaccagggactacttgaccgtcaaagtctgggatctcaacatggaaaaccgccccatcgagacttaccaggttcatgactacctccgcagcaagctgtgttccctctatgaaaatgactgcatttttgataaatttgagtgtgtgtggaatgggtcagacagtgtcatcatgacaggctcctacaacaacttcttcaggatgttcgacagaaacaccaagcgtgatgtgacccttgaggcttcgagggaaaacagcaagccccgggctatcctcaaaccccgaaaagtgtgtgtggggggcaagcggagaaaagacgagatcagtgtcgacagtctggactttagcaaaaagatcttgcatacagcttggcatccttcagaaaatattatagcagtggcggctacaaataacctatatatattccaggacaaggttaactaggtggacaagttattacttaataatctcacatactgaatactagtcaaacaagtttttaaatgtttctttgggtcttcatttgatgcattgactttaatttccctatacaggaaatgattggaatagaattaaaaggagtccaacattcccagctccccagttctaagaaacttttgtcaaacccaataggtttgggacacttctgtttagaattgaaagctgccagctaacagtaattcttccatagttgacttgaacttctgatgcttttattgcccagttttctctggtgggtccagtgttttgttcctaggtgtctgctgcgataaaatgaggttgtctgtagtatttaaggagaaaagagataagttttttttaattaagcaattccatttgattgaaaaaaatcaacaaaaaataaacaccgtttactcttagacaaa

SEQ ID NO: 171191 - DNA, 609 bp, Homo sapiens
  Payload ID: 13680
  Gene Symbol: PPP2R2B
  Gene Name: protein phosphatase 2, regulatory subunit B, beta
  ENST ID: ENST00000528601
  CDS Start-End: 164-298
cctttaaattcaccaagggaccacatgcatcatataagggctcggaccatggtgcagtcccactggctcccctgcccccctctcctgtgagactggctgcggggagggatcatggatacttgtctgccggcttctggttcccacgcaagtaagcctgctgtcaatggaggaggacattgatacccgcaaaatcaacaacagtttcctgcgcgaccacagctatgcgaccgaaggagccaagggagaacccaagacagagaatagtggcccaataatgaagcatgaattatccagatgaaaacacctatggaaataaagctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaataagatggctcccccagcagaatgcagcttactttcttctgtctactaatgataaaactgtgaagctgtggaaagtca

SEQ ID NO: 171192 - DNA, 567 bp, Homo sapiens
  Payload ID: 13680
  Gene Symbol: PPP2R2B
  Gene Name: protein phosphatase 2, regulatory subunit B, beta
  ENST ID: ENST00000532154
  CDS Start-End: 210-344
aatgcaccagccgcctccagcctcctgcagcagcagcagcagcagcagcagcagcagctgcgagtgcgcgcgtgtgggtgtgagggctcggaccatggtgcagtcccactggctcccctgcccccctctcctgtgagactggctgcggggagggatcatggatacttgtctgccggcttctggttcccacgcaagtaagcctgctgtcaatggaggaggacattgatacccgcaaaatcaacaacagtttcctgcgcgaccacagctatgcgaccgaaggagccaagggagaacccaagacagagaatagtggcccaataatgaagcatgaattatccagatgaaaacacctatggaaataaagctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaa

SEQ ID NO: 171193 - DNA, 2745 bp, Homo sapiens
  Payload ID: 13681
  Gene Symbol: PPP2R5B
  Gene Name: protein phosphatase 2, regulatory subunit B', beta
  Uniprot ID: Q15173
  ENST ID: ENST00000164133
  CDS Start-End: 623-2116
ggtggggggaggtgacttgatgtcatcctgagcagctgggcggcgggtgccggtgcgcacggagccgagccggggctcccgttgcgctgcaccgcgttgggtcggagtcccaggacttcagcggagatccgcgcgctgcgacggccggtgcagagcccgccgagcgcccagtcccggcccggggctgagttgggggcatgctctagccgcccccccggagcccgggagagaacccaggagcgccgccgcccagccccagcgccccgagcggaaccgctgcgaaggggccctgaacggccgtcgccctccctacgggcagcccccgggggttggcgaccgaagtctaggttttcgagaaagccagggtgggaaccctaactggactcttcgggacccccaggaaggatctgaggcctgagccatcctcctttctaccctgtctgccccccaggactgggcagttgcaggaggccctgggggggggcccaggactgtggttgtgccccccccccaaaggccggacaggatgggaccaagttagtctgtccagtctcacccagcacctcccaggcccagagagaacccccggggctctgaaagcttgccctgccgcctgaccgccatggagacgaagctgccccctgcaagcacccccactagcccctcctcccccgggctgtcgcctgtgcccccacccgacaaggtggacggcttctcccgccgttccctccgcagagcccggccccgccgctcccacagctcctctcagttccgctatcagagcaaccagcaagagctcacaccgctgcccctgctcaaagatgtgccggcttccgagctgcacgagctgctgagccggaagctggcccagtgtggggtgatgtttgacttcttggactgtgtggccgacctcaaggggaaggaggtgaagcgggcagccctcaacgagctggtggagtgtgtggggagcacccggggtgtcctcatcgagcccgtctacccagacatcatccgcatgatctcagtgaatatcttccggactctgccgcccagtgagaaccctgaatttgaccctgaagaggatgagcccaatcttgagccttcgtggccacacctgcagctggtatatgagtttttcctgcgtttcttggagagcccagacttccagccctccgtggccaagagatatgtggatcaaaagtttgtcctgatgctcctggagctatttgatagtgaggatccccgggagcgtgagtacctcaagaccatcctgcaccgggtctatggcaagttcctgggtctccgggcctacatccgcaaacagtgcaaccacatcttcctccggttcatctatgaattcgagcacttcaatggtgtggctgagctgctggagatcctaggaagcatcatcaatggctttgcgctgcccctgaagacggagcacaagcagttcctggttcgcgtcctgatccccctgcactctgtcaagtcgctgtctgtcttccatgcccagctggcatactgtgtggtgcagttcctggagaaggatgccactctgacagagcacgtgatccgggggctgctcaaatactggccaaaaacctgcacccagaaggaggtgatgtttctgggggagatggaagagattcttgatgtcatcgagccctcccagtttgtgaagatccaggagcccctttttaagcaggtggctcgctgtgtttccagcccccatttccaggttgcagagcgggctctgtatttctggaacaatgagtatatcctaagcctcattgaggacaactgccacactgtgctgcctgctgtgtttgggaccctctaccaagtctccaaggagcactggaaccaaaccatcgtatcactgatctacaatgtgctcaagaccttcatggagatgaatgggaagctgtttgatgagctcacagcctcctacaagctggaaaagcagcaggagcagcagaaggcccaggagcgtcaggagttatggcaaggtctggaggagctgcggctacgccggctacaggggacccagggggccaaggaggcccccctccagcggcttacaccccaggtggccgccagtgggggtcagagctagacagcacctcagaaggggaaaagctaaacccagagctgtcagtccctctatcccttctcctgtccaggggcccagagagaaacacacctacccctggccttgccagagtggcttctgaggactccctgcccagcccagctttcactggggggagacgaggagaggcaatggtggtcttggcaacagaatgctcagcccctcgtggcaggacttgacaagggcaagcttgaccaggaagctgccatcagggatcttcccctgccccgcaaagctaggctccagctgcaggcgggctcccaccctctgctcctggccttgggcaagggcactcagcgcctcgcctgcccctgccttggccaatgcgaggtccttccttatccccaccatggggtccatggtctatttattctcgcccagctcaccctctacacagacactgtcctgggtgcacactcctcccttccctcgctgtgtacttccttgtcccctttttatttattgggcagggggagggggagggcacaggcaagaagagattcacagtgtcctggggtaagggggggttcacagtaatcatggtctactcctctttccgtggctgggggtagacttaataaagagagaaattc

SEQ ID NO: 171194 - DNA, 786 bp, Homo sapiens
  Payload ID: 13681
  Gene Symbol: PPP2R5B
  Gene Name: protein phosphatase 2, regulatory subunit B', beta
  ENST ID: ENST00000532850
  CDS Start-End: 454-786
cggtgcgcacggagccgagccggggctcccgttgcgctgcaccgcgttgggtcggagtcccaggacttcagcggagatccgcgcgctgcgacggccggtgcagagcccgccgagcgcccagtcccggcccggggctgagttgggggcatgctctagccgcccccccggagcccgggagagaacccaggagcgccgccgcccagccccagcgccccgagcggaaccgctgcgaaggggccctgaacggccgtcgccctccctacgggcagcccccgggggttggcgaccgaagtctaggttttcgagaaagcccggccccgccgctcccacagctcctctcagttccgctatcagagcaaccagcaagagctcacaccgctgcccctgctcaaagatgtgccggcttccgagctgcacgagctgctgagccggaagctggcccagtgtggggtgatgtttgacttcttggactgtgtggccgacctcaaggggaaggaggtgaagcgggcagccctcaacgagctggtggagtgtgtggggagcacccggggtgtcctcatcgagcccgtctacccagacatcatccgcatgatctcagtgaatatcttccggactctgccgcccagtgagaaccctgaatttgaccctgaagaggatgagcccaatcttgagccttcgtggccacacctgcagctggtatatgagtttttcctgcgtttcttggagagcccagacttccagccctccgtggccaagagatatgtggatcaaaagtttgtcctgatg

SEQ ID NO: 171195 - DNA, 887 bp, Homo sapiens
  Payload ID: 13681
  Gene Symbol: PPP2R5B
  Gene Name: protein phosphatase 2, regulatory subunit B', beta
  ENST ID: ENST00000526559
  CDS Start-End: 307-887
ctcagtgcgcgatcttaagcgcgcatctgtggaaacaattaaagccagggtgggaaccctaactggactcttcgggacccccaggaaggatctgaggcctgagccatcctcctttctaccctgtctgccccccaggactgggcagttgcaggaggccctgggggggggcccaggactgtggttgtgccccccccccaaaggccggacaggatgggaccaagttagtctgtccagtctcacccagcacctcccaggcccagagagaacccccggggctctgaaagcttgccctgccgcctgaccgccatggagacgaagctgccccctgcaagcacccccactagcccctcctcccccgggctgtcgcctgtgcccccacccgacaaggtggacggcttctcccgccgttccctccgcagagcccggccccgccgctcccacagctcctctcagttccgctatcagagcaaccagcaagagctcacaccgctgcccctgctcaaagatgtgccggcttccgagctgcacgagctgctgagccggaagctggcccagtgtggggtgatgtttgacttcttggactgtgtggccgacctcaaggggaaggaggtgaagcgggcagccctcaacgagctggtggagtgtgtggggagcacccggggtgtcctcatcgagcccgtctacccagacatcatccgcatgatctcagtgaatatcttccggactctgccgcccagtgagaaccctgaatttgaccctgaagaggatgagcccaatcttgagccttcgtggccacacctgcagctggtatatgagtttttcctgcgtttcttggagagcccagacttccagccctccgtggccaagagatatgtggatcaaaagtt

SEQ ID NO: 171196 - DNA, 782 bp, Homo sapiens
  Payload ID: 13682
  Gene Symbol: PPP2R3B
  Gene Name: protein phosphatase 2, regulatory subunit B'', beta
  ENST ID: ENST00000381625
  CDS Start-End: 274-782
tgacggctgccgcggtgcagaaagcgcccccttgcccggccggacggcccagcccggagcgaacggggagaggagagaagaggaccggagggagcggagggcagtgcagggagcggagaaggaggagaggagagcagcgccgggagcagccgggtctgcacagtcgcgggtcgggagaggcggccgcccccacccccggcgccatgcgccctcctcagcctgaggaatgcgcgcggcgcgggccccggccccagagcgcctggcgggcgacgcatggagcgcgctgagcccgggccacgcctgcagcgccccgccggccccggcccggccctgccccgagagcgcggcgcccggcccggcccgcggagagccctgcgcgccggcggcatgcgactccgcgagcgctcgctgcgccaggaccccgacctgcgccaggagctggcctcactggcccgcggctgcgacttcgtgctgccctctcggttcaagaagcggctgaaggccttccagcaggttcagacacggaaagaagagcctctgcccccggccacgagccaaagcattccgaccttctacttccccagaggacgcccgcaggactccgtcaacgtggatgccgtcatcagcaagatcgagagcaccttcgcccggttcccccacgagagggccaccatggatgacatgggcctggtggccaaggcctgcggctgccccctctactggaaggggccgctcttctatggcgccggcggggagcgcacgggctccgtgtccgtccacaa

SEQ ID NO: 171197 - DNA, 2151 bp, Homo sapiens
  Payload ID: 13682
  Gene Symbol: PPP2R3B
  Gene Name: protein phosphatase 2, regulatory subunit B'', beta
  Uniprot ID: Q9Y5P8
  ENST ID: ENST00000390665
  CDS Start-End: 20-1747
cgcgggcccagcccccgccatgccgcccggcaaagtgctgcagccggtcctgaagatgaaggtggacgagctgttcctgtactggctcagcgaggccagcacgcagcggatgctgcaggactgcctgcgccggatcaaggcgcccgggcgggaccagccgaccccgggggacggggagcagcccggggcctggcccacagccccgctcgccgccccccggcccagcgggctcgaacccccgggaacccccgggccgggccctgcgctgcccctgggcgccgcctccagccccaggaacgcgccccacgttcgaggcacccgtagatccgcagggacgagagtagttcagacacggaaagaagagcctctgcccccggccacgagccaaagcattccgaccttctacttccccagaggacgcccgcaggactccgtcaacgtggatgccgtcatcagcaagatcgagagcaccttcgcccggttcccccacgagagggccaccatggatgacatgggcctggtggccaaggcctgcggctgccccctctactggaaggggccgctcttctatggcgccggcggggagcgcacgggctccgtgtccgtccacaagttcgtcgccatgtggagaaaaatcctccagaactgccacgacgacgcggccaagttcgtccatctgctcatgagccccggctgcaactacctggtgcaggaggactttgtccccttcttgcaggacgtggtgaacacgcacccggggctgtcgttcctgaaggaggcgtccgagttccactcgcgctacatcaccacggtcatccagcggatcttctacgccgtgaaccggtcctggtccggcaggatcacctgcgccgagctgcggaggagctccttcctgcagaatgtggcgctgctggaggaggaggcggacatcaaccagctgaccgaattcttctcgtacgagcatttctacgtcatctactgcaagttctgggagctggacacggaccacgacctgctcatcgacgcggacgacctggcgcggcacaatgaccacgccctttctaccaagatgatagacaggatcttctcaggagcagtcacacgaggcagaaaagtgcagaaggaagggaagatcagctatgccgactttgtctggtttttgatctctgaggaagacaaaaaaacaccgaccagcatcgagtactggttccgctgcatggacctggacggggacggcgccctgtccatgttcgagctcgagtacttctacgaggagcagtgccgaaggctggacagcatggccatcgaggccctgcccttccaggactgcctctgccagatgctggacctggtcaagccgaggactgaagggaagatcacgctgcaggacctgaagcgctgcaagctggctaacgtcttcttcgacaccttcttcaacatcgagaagtacctcgaccacgagcagaaagagcagatctccctgctcagggacggtgacagcggcggccccgagctctcggactgggagaagtacgcggccgaggagtacgacatcctggtggccgaggagactgcgggagagccctgggaggacgggttcgaggccgagctcagccctgtggagcagaagctgagtgcgctgcgctccccgctggcccagaggcccttcttcgaggcgccctcaccgctgggcgccgtggacctgtacgagtacgcatgcggggacgaggacctggagccgctgtgacgccgcccgcgagaacgccgccgcggggccgctccccacgtgccaccaccgggccaccgcggctcgtgtaaaaactgttgtggaaaatgagtgcgtttgtacggaatgataaacttttatttattcacagaagcgtgttgattgccgctgtgggttcgtggctggacctgcccagagctctgtgccagggggacacgtagggccgcgcgtgaatgggacgggttcccacacggacaccctctggcgcttgccgttcccgacccagcctgggttccggggcctgcgtctgtggaaagggtccgtgtgcgcacaacggtgaccggcggctcccgggcgcctcagtcctggacaggagcctccaccacaggctgtgtgaatgttttgtgtaaacgtacaaaaccgtt

SEQ ID NO: 171198 - DNA, 2151 bp, Homo sapiens
  Payload ID: 13682
  Gene Symbol: PPP2R3B
  Gene Name: protein phosphatase 2, regulatory subunit B'', beta
  ENST ID: ENST00000620224
  CDS Start-End: 20-1747
cgcgggcccagcccccgccatgccgcccggcaaagtgctgcagccggtcctgaagatgaaggtggacgagctgttcctgtactggctcagcgaggccagcacgcagcggatgctgcaggactgcctgcgccggatcaaggcgcccgggcgggaccagccgaccccgggggacggggagcagcccggggcctggcccacagccccgctcgccgccccccggcccagcgggctcgaacccccgggaacccccgggccgggccctgcgctgcccctgggcgccgcctccagccccaggaacgcgccccacgttcgaggcacccgtagatccgcagggacgagagtagttcagacacggaaagaagagcctctgcccccggccacgagccaaagcattccgaccttctacttccccagaggacgcccgcaggactccgtcaacgtggatgccgtcatcagcaagatcgagagcaccttcgcccggttcccccacgagagggccaccatggatgacatgggcctggtggccaaggcctgcggctgccccctctactggaaggggccgctcttctatggcgccggcggggagcgcacgggctccgtgtccgtccacaagttcgtcgccatgtggagaaaaatcctccagaactgccacgacgacgcggccaagttcgtccatctgctcatgagccccggctgcaactacctggtgcaggaggactttgtccccttcttgcaggacgtggtgaacacgcacccggggctgtcgttcctgaaggaggcgtccgagttccactcgcgctacatcaccacggtcatccagcggatcttctacgccgtgaaccggtcctggtccggcaggatcacctgcgccgagctgcggaggagctccttcctgcagaatgtggcgctgctggaggaggaggcggacatcaaccagctgaccgaattcttctcgtacgagcatttctacgtcatctactgcaagttcggggagctggacacggaccacgacctgctcatcgacgcggacgacctggcgcggcacaatgaccacgccctttctaccaagatgatagacaggatcttctcaggagcagtcacacgaggcagaaaagtgcagaaggaagggaagatcagctatgccgactttgtctggtttttgatctctgaggaagacaaaaaaacaccgaccagcatcgagtactggttccgctgcatggacctggacggggacggcgccctgtccatgttcgagctcgagtacttctacgaggagcagtgccgaaggctggacagcatggccatcgaggccctgcccttccaggactgcctctgccagatgctggacctggtcaagccgaggactgaagggaagatcacgctgcaggacctgaagcgctgcaagctggctaacgtcttcttcgacaccttcttcaacatcgagaagtacctcgaccacgagcagaaagagcagatctccctgctcagggacggtgacagcggcggccccgagctctcggactgggagaagtacgcggccgaggagtacgacatcctggtggccgaggagactgcgggagagccctgggaggacgggttcgaggccgagctcagccctgtggagcagaagctgagtgcgctgcgctccccgctggcccagaggcccttcttcgaggcgccctcaccgctgggcgccgtggacctgtacgagtacgcatgcggggacgaggacctggagccgctgtgacgccgcccgcgagaacgccgccgcggggccgctccccacgtgccaccaccgggccaccgcggctcgtgtaaaaactgttgtggaaaatgagtgcgtttgtacggaatgataaacttttatttattcacagaagcgtgttgattgccgctgtgggttcgtggctggacctgcccagagctctgtgccagggggacacgtagggccgcgcgtgaatgggacgggttcccacacggacaccctctggcgcttgccgttcccgacccagcctgggttccggggcctgcgtctgtggaaagggtccgtgtgcgcacaacggtgaccggcggctcccgggcgcttcagtcctggacaggagcctccaccacaggctgtgtgaatgttttgtgtaaacgtacaaaaccgtt

SEQ ID NO: 171199 - DNA, 2181 bp, Homo sapiens
  Payload ID: 13682
  Gene Symbol: PPP2R3B
  Gene Name: protein phosphatase 2, regulatory subunit B'', beta
  ENST ID: ENST00000612937
  CDS Start-End: 20-1747
cgcgggcccagcccccgccatgccgcccggcaaagtgctgcagccggtcctgaagatgaaggtggacgagctgttcctgtactggctcagcgaggccagcacgcagcggatgctgcaggactgcctgcgccggatcaaggcgcccgggcgggaccagccgaccccgggggacggggagcagcccggggcctggcccacagccccgctcgccgccccccggcccagcgggctcgaacccccgggaacccccgggccgggccctgcgctgcccctgggcgccgcctccagccccaggaacgcgccccacgttcgaggcacccgtagatccgcagggacgagagtagttcagacacggaaagaagagcctctgcccccggccacgagccaaagcattccgaccttctacttccccagaggacgcccgcaggactccgtcaacgtggatgccgtcatcagcaagatcgagagcaccttcgcccggttcccccacgagagggccaccatggatgacatgggcctggtggccaaggcctgcggctgccccctctactggaaggggccgctcttctatggcgccggcggggagcgcacgggctccgtgtccgtccacaagttcgtcgccatgtggagaaaaatcctccagaactgccacgacgacgcggccaagttcgtccatctgctcatgagccccggctgcaactacctggtgcaggaggactttgtccccttcttgcaggacgtggtgaacacgcacccggggctgtcgttcctgaaggaggcgtccgagttccactcgcgctacatcaccacggtcatccagcggatcttctacgccgtgaaccggtcctggtccggcaggatcacctgcgccgagctgcggaggagctccttcctgcagaatgtggcgctgctggaggaggaggcggacatcaaccagctgaccgaattcttctcgtacgagcatttctacgtcatctactgcaagttctgggagctggacacggaccacgacctgctcatcgacgcggacgacctggcgcggcacaatgaccacgccctttctaccaagatgatagacaggatcttctcaggagcagtcacacgaggcagaaaagtgcagaaggaagggaagatcagctatgccgactttgtctggtttttgatctctgaggaagacaaaaaaacaccgaccagcatcgagtactggttccgctgcatggacctggacggggacggcgccctgtccatgttcgagctcgagtacttctacgaggagcagtgccgaaggctggacagcatggccatcgaggccctgcccttccaggactgcctctgccagatgctggacctggtcaagccgaggactgaagggaagatcacgctgcaggacctgaagcgctgcaagctggccaacgtcttcttcgacaccttcttcaacatcgagaagtacctcgaccacgagcagaaagagcagatctccctgctcagggacggtgacagcggcggccccgagctctcggactgggagaagtacgcggccgaggagtacgacatcctggtggccgaggagaccgtgggagagccctgggaggacgggttcgaggccgagctcagccccgtggagcagaagctgagtgcgctgcgctccccgctggcccagaggcccttcttcgaggcgccctcaccgctgggcgccgtggacctgtacgagtacgcgtgcggggacgaggacctggagccgctgtgacgccacccgcgagaacgccgccgcggggccgccccccacgtgccaccaccgggccaccgcggctcgtgtaaaaactgttgtggaaaatgagtgcgtttgtacggaatgataaacttttatttattcacagaagcgtgttgattgccgctgtgggttcgtggctggacctgcccagagccctgtgcccgggggacacgtagggccgcgcgtgaatgggacgggttcccacacggacaccctccagcacttgccgttcccgacccggcctgggttccggggcctgcgtctgtggaaagggtccatgtgcgcacaacggtgaccggcggctcccgggcgcctcagtcctggacaggagcctccaccacaggctgtgtgaatgttttgtgtaaacgtacaaaaccgtttctggcgatcacgcttgtacgtttggagga

SEQ ID NO: 171200 - DNA, 782 bp, Homo sapiens; identical to SEQ ID NO: 171196
  Payload ID: 13682
  Gene Symbol: PPP2R3B
  Gene Name: protein phosphatase 2, regulatory subunit B'', beta
  ENST ID: ENST00000627126
  CDS Start-End: 274-782

SEQ ID NO: 171201 - DNA, 782 bp, Homo sapiens; identical to SEQ ID NO: 171196
  Payload ID: 13682
  Gene Symbol: PPP2R3B
  Gene Name: protein phosphatase 2, regulatory subunit B'', beta
  ENST ID: ENST00000626780
  CDS Start-End: 274-782

SEQ ID NO: 171202 - DNA, 5738 bp, Homo sapiens
  Payload ID: 13683
  Gene Symbol: PPP2R2D
  Gene Name: protein phosphatase 2, regulatory subunit B, delta
  Uniprot ID: Q66LE6
  ENST ID: ENST00000455566
  CDS Start-End: 506-1867
gtgtccggccaagcggcgccctgaaggcgtgtccggccgcagcttaggctctccgggagtccccggagagtaggggcggccggcggcgctagtcttctggggagcgccgggtgcacaccggaccactgcgggaggcctagggccgagggccgaggagctggcctgcgcccggcgaccccggcttccctccgcagtcgcccaggcgtcccttcccccctacagccgagcggcgccgggcgcaggcgcattgggcgcccccggcagcccccgcggcccgccccgtccgctgcccgtccgaggaggcggagggcgatgacgtcatcgagcggggcgacgggcattgggcgccattttgaaaagggaaaaaaatccctccccggcggcggcggcggcggcggcggcgccggcggtggtggcggccccggggctgagcgctcggctgcagcggcgcggaggccgtctccctggtctgccgcggtccccgcccgtcccgccgccggctgccatggcaggagccggaggcggcggctgccccgcgggcggcaacgacttccagtggtgcttctcgcaggtcaagggggccatcgacgaggacgtggccgaagcggacatcatttccaccgttgagtttaattactctggagatcttcttgcaacaggagacaagggcggcagagttgttatttttcagcgtgaacaagagaataaaagccgccctcattctaggggagaatataatgtttacagcacctttcaaagtcatgaaccggagtttgactatttgaaaagtctagaaattgaggaaaaaattaataaaattaggtggttaccacaacagaatgctgctcattttctactgtctacaaatgataaaactataaaattatggaaaataagtgaacgggataaaagagcagaaggttataacctgaaagacgaagatggaagacttcgagacccatttaggatcacggcgctacgggtcccaatattgaagcccatggatcttatggtagaagcgagtccacggcgaatttttgcaaatgctcacacatatcatataaattccatttcagtaaatagtgatcatgaaacatatctttctgcagatgacctgagaattaatttatggcacttagaaatcacagatagaagctttaacatcgtggacatcaagcctgctaacatggaggagctgaccgaagtcatcactgcagccgagttccacccgcaccagtgcaacgtgttcgtctacagcagtagcaaagggaccatccgcctgtgtgacatgcgctcctcggccctgtgcgacagacactccaagttttttgaagagcctgaagatcccagcagtaggtccttcttctcagaaataatttcatccatatccgatgtaaaattcagtcatagtgggcggtacatgatgaccagagactacctgtcggtgaaggtgtgggacctcaacatggagagcaggccggtggagacccaccaggtccacgagtacctgcgcagcaagctctgctctctctatgagaacgactgcatctttgacaagtttgagtgttgctggaacggttcggatagcgccatcatgaccgggtcctataacaacttcttcaggatgtttgatagagacacgcggagggatgtgaccctggaggcctcgagagagagcagcaaaccgcgcgccagcctcaaaccccggaaggtgtgtacggggggtaagcggaggaaagacgagatcagtgtggacagtctggacttcaacaagaagatcctgcacacagcctggcaccccgtggacaatgtcattgccgtggctgccaccaataacttgtacatattccaggacaaaatcaactagagacgcgaacgtgaggaccaagtcttgtcttgcatagttaagccggacatttttctgtcagagaaaaggcatcattgtccgctccattaagaacagtgacgcacctgctacttcccttcacagacacaggagaaagccgcctccgctggaggcccggtgtggttccgcctcggcgaggcgcgagacaggcgctgctgctcacgtggagacgctctcgaagcagagttgacggacactgctcccaaaaggtcattactcagaataaatgtatttatttcagtccgagccttcctttccaatttatagaccaaaaaattaacatccaagagaaaagttattgtcagataccgctctttctccaactttccctctttctctgccatcacacttgggccttcactgcagcgtggtgtggccaccgtccgtgtcctctcggccttcctccgagtccaggtggactctgtggatgtgtggatgtggcccgagcaggctcaggcggccccactcacccacagcatccgccgccaccccttcgggtgtgagcgctcaataaaaacaacacactataaagtgtttttaaatccaaacagaagtattgtctttttatttaattttattgcatagaatgaagttatgcagggttcttctttggaactaactgtttgagaaatgtgtgtccttctttggcagcgtgggggtatgtgtgcagcatttctgtccccaagctgctgcccgctgtgtttctgtagaagtagcccatcagatacaccaggtaaggtctgggaaaagccagaaccgaggccacctctgagaaagaaaattgcaaggaagaaccaaaattgctgccatccagtaagcctggtttaaagtagcttcaaattcactacagttgaagaaatacgtgcttgctttctaaggcttttgaaaaagcactttggggaaagtatactttttaaacattgctaaaattacatgcatgctaaatttcatcctgcatttcaagccagcaaaattaagcaattttaattacacgatgccaccagtacgttggtttattttcaaagtaggatctttgataccagaaatcaagattttccaagacaaataatacagagctgtaccaatgctgagtgaccagagcttgcttccgtgggatttaacacacgcccactacgtgtccccgaggggagtggggagtcgggctcccgtgcccctgtggagatggaggtgtgtgctgatcccccgtccgcctgtggagatgaaggtgtgtgttgattcctcctgctgctgtggagatggaggtgtgtgctgatcgcccgtcaccctgtctagatgaaggtatgtgctgattgcctgtgcccctgtggagaaggaggtgtgtgctgatcccctgtgccctgtggagatggaggtgtgtgctgctccctcgtgcccctgtggagatggaggtgtgtgctgatcccccatcccatccccctgtctagatgaaggtgtgtgctgattcctcatgcccctgtctggatgaaggtgtgtgctgatcccccgtccccctgtggagatgaaggtgtgtgctgatcccccgtgcccctgtggagatgaaggtgcgtgctgatcccccatctccctgtggagatgaaggtgtgtgctgatccccatccccctgtggagatgaagggatatgctgatcccctgtcccactgtggagatgaaggggtgtgctgatcccccgtccccctgtggagatgaaggtgtgtgctgatcccccatctccctgtggagatgaaggggtgtgccaatcccccgcgcccctgtggagatggaggcgtgtgctgatccccatccccctgtggagatgaaggtgtgtgctgatcccccatccccatgtggagatgaaggggtgtgttgatcccctgtccccctgtggagatggtgtgtgctgatccccgtccccctgtggagatgaaggtgtgtgctgatcccccatctccctgtgaagatgaaggggtgtgctgatcccccgtgcccctgtggacatggaggcgtgtgctgatcccccgtccccctgtggagatgaaggtgtgtgctgatcccccatccccatgtggagatgaaggggtgtgttgatcccccgtccccctgtggagatgaaggtgtgtgctgatccccgtccccctgtggagatgaaggggtgtgctgatcccccatgccctgtggagatggaggtgtgtgctgatccctcgtgcccctgtggagatagaggtgtgtactgatcccctgttcccctatctagatgaaggtgtgtactgctgatcccccgtccccctgtggagatgaaggtgtgtgctgatcccccatccccctgtggagatgaaggggtgtgctgatcccccgtcttcctgtggagatgaaggtgtgtgctgattcctcatgcccctgtggagatggaggtgtgtgctgatcccccatccccctgtggggatgaaggtgtgtgctgatcccccatccccctgtggagatgaaggggtatgctgatcccccgtccccctgtggagatgaaggtgtgtgctgatcccccatccccctgtggagatgaaggggtatgctgatcccctgtccccctgtggggatgaaggtgtgtgctgatctcttgtccccctgtggagatggaggtgtgtgctgatcccccatccccctgtggagatgaagatgtgtgctgatcccccgtcctcctgtggagatgaaggtgtgtgctgcttcctcgtgcccctgtggagatggaggtgtgtgctggtcccccgtccccctgtggagatggaggtgtgtgctgatcccccgtccccctgtggagatggaggcgtgtgctgatcccccatccccctgtggagatgaaggcgtgtgctgatccgccatcccactgtggagatgaaggcgtgtgctgatcccccatccccctgtggagataaaggtgtgtgctgatcccccatccccctgtggagatgaaggcgtgtgctgatccgccatcccactgtggagatgaaggcgtgtgctgatcccccatccccctgtggagatgaaggcgtgtgctcatcccccatccccctgtggagatgaaggcgtgtgctgatccgccatcccactgtggagatgaaggtgtgtgctgatcccccatccccctgtggagatgaaggtgtgtgctgatccccggtccccctgtggagatgaaggtgtgtgctgatcccccgtcctcctgtggagatgaaggcgtgtgctgatcccccgtccccctgtggagatgaaggcgtgtgctgatccgccgtccccctgtggagatgaaggcgtgtgctgatccgccatccccctgtggagatgaaggcgtgtgctcatcccccatccccctgtggagatgaaggcgtgtgctgatccgccatcccactgtggagatgaaggtgtgtgctgatcccccatccccctgtggagatgaaggcgtgtgctgatccccggtccccctgtggagatgaaggtgtgtgttgatcccccatccccctgtggaggtgaaggtgtgtgctgattactaatccacatgggcaagaacaggatgtccgtcattaccctgaatcaatgctaacacagtgccacttgagttcacattaagttagaaattgagaatctaaaggtacctttattttaactaaaaaataatttatatactgtatattgattgtgacacaatttacaaagtctgaggtgtggaacagttatttaagcattagtcaaccctggtccttaagacagttctagtaaaatgggattgtatatatttgttcaactattttgaccaaaaagttcaataaattttaaatgtttaactgga

SEQ ID NO: 171203 - DNA, 1792 bp, Homo sapiens
  Payload ID: 13683
  Gene Symbol: PPP2R2D
  Gene Name: protein phosphatase 2, regulatory subunit B, delta
  ENST ID: ENST00000482010
  CDS Start-End: 1-451
cggcaacgacttccagtggtgcttctcgcaggtcaagggggccatcgacgaggacgtggccgaagcggacatcatttccaccgttgagtttaattactctggagatcttcttgcaacaggagacaagggcggcagagttgttatttttcagcgtgaacaagagaataaaagccgccctcattctaggggagaatataatgtttacagcacctttcaaagtcatgaaccggagtttgactatttgaaaagtctagaaattgaggaaaaaattaataaaattaggtggttaccacaacagaatgctgctcattttctactgtctacaaatgataaaactataaaattatggaaaataagtgaacgggataaaagagcagaaggttataacctgaaagacgaagatggaagacttcgagacccatttaggatcacggcgctacggatgacctgagaattaatttatggcacttagaaatcacagatagaagctttaacatcgtggacatcaagcctgctaacatggaggagctgaccgaagtcatcactgcagccgagttccacccgcaccagtgcaacgtgttcgtctacagcagtagcaaagggaccatccgcctgtgtgacatgcgctcctcggccctgtgcgacagacactccaagttttttgaagagcctgaagatcccagcagtaggtccttcttctcagaaataatttcatccatatccgatgtaaaattcagtcatagtgggcggtacatgatgaccagagactacctgtcggtgaaggtgtgggacctcaacatggagagcaggccggtggagacccaccaggtccacgagtacctgcgcagcaagctctgctctctctatgagaacgactgcatctttgacaagtttgagtgttgctggaacggttcggatagcgccatcatgaccgggtcctataacaacttcttcaggatgtttgatagagacacgcggagggatgtgaccctggaggcctcgagagagagcagcaaaccgcgcgccagcctcaaaccccggaaggtgtgtacggggggtaagcggaggaaagacgagatcagtgtggacagtctggacttcaacaagaagatcctgcacacagcctggcaccccgtggacaatgtcattgccgtggctgccaccaataacttgtacatattccaggacaaaatcaactagagacgcgaacgtgaggaccaagtcttgtcttgcatagttaagccggacatttttctgtcagagaaaaggcatcattgtccgctccattaagaacagtgacgcacctgctacttcccttcacagacacaggagaaagccgcctccgctggaggcccggtgtggttccgcctcggcgaggcgcgagacaggcgctgctgctcacgtggagacgctctcgaagcagagttgacggacactgctcccaaaaggtcattactcagaataaatgtatttatttcagtccgagccttcctttccaatttatagaccaaaaaattaacatccaagagaaaagttattgtcagataccgctctttctccaactttccctctttctctgccatcacacttgggccttcactgcagcgtggtgtggccaccgtccgtgtcctctcggccttcctccgagtccaggtggactctgtggatgtgtggatgtggcccgagcaggctcaggcggccccactcacccacagcatccgccgccaccccttcgggtgtgagcgctcaataaaaacaacacactataaagtgtttttaaatccaaacagaa

SEQ ID NO: 171204 - DNA, 2058 bp, Homo sapiens
  Payload ID: 13683
  Gene Symbol: PPP2R2D
  Gene Name: protein phosphatase 2, regulatory subunit B, delta
  ENST ID: ENST00000616467
  CDS Start-End: 119-352
ggcggcggcggcggcgccggcggtggtggcggccccggggctgagcgctcggctgcagcggcgcggaggccgtctccctggtctgccgcggtccccgcccgtcccgccgccggctgccatggcaggagccggaggcggcggctgccccgcgggcggcaacgacttccagtggtgcttctcgcaggtcaagggggccatcgacgaggacgtggccgaagcggacatcatttccaccgttgagtttaattactctggagatcttcttgcaacaggagacaagggcggcagagttgttatttttcagcgtgaacaagaggtactggcccagccccgccgtcctgccctgccatgaagtgtgagcagctttctcagcacttcctgcagagaagtctggcaggggtgtgaattctctcttcccttcagggagagaataaaagccgccctcattctaggggagaatataatgtttacagcacctttcaaagtcatgaaccggagtttgactatttgaaaagtctagaaattgaggaaaaaattaataaaattaggtggttaccacaacagaatgctgctcattttctactgtctacaaatgataaaactataaaattatggaaaataagtgaacgggataaaagagcagaaggttataacctgaaagacgaagatggaagacttcgagacccatttaggatcacggcgctacggatgacctgagaattaatttatggcacttagaaatcacagatagaagctttaacatcgtggacatcaagcctgctaacatggaggagctgaccgaagtcatcactgcagccgagttccacccgcaccagtgcaacgtgttcgtctacagcagtagcaaagggaccatccgcctgtgtgacatgcgctcctcggccctgtgcgacagacactccaagttttttgaagagcctgaagatcccagcagtaggtccttcttctcagaaataatttcatccatatccgatgtaaaattcagtcatagtgggcggtacatgatgaccagagactacctgtcggtgaaggtgtgggacctcaacatggagagcaggccggtggagacccaccaggtccacgagtacctgcgcagcaagctctgctctctctatgagaacgactgcatctttgacaagtttgagtgttgctggaacggttcggatagcgccatcatgaccgggtcctataacaacttcttcaggatgtttgatagagacacgcggagggatgtgaccctggaggcctcgagagagagcagcaaaccgcgcgccagcctcaaaccccggaaggtgtgtacggggggtaagcggaggaaagacgagatcagtgtggacagtctggacttcaacaagaagatcctgcacacagcctggcaccccgtggacaatgtcattgccgtggctgccaccaataacttgtacatattccaggacaaaatcaactagagacgcgaacgtgaggaccaagtcttgtcttgcatagttaagccggacatttttctgtcagagaaaaggcatcattgtccgctccattaagaacagtgacgcacctgctacttcccttcacagacacaggagaaagccgcctccgctggaggcccggtgtggttccgcctcggcgaggcgcgagacaggcgctgctgctcacgtggagacgctctcgaagcagagttgacggacactgctcccaaaaggtcattactcagaataaatgtatttatttcagtccgagccttcctttccaatttatagaccaaaaaattaacatccaagagaaaagttattgtcagataccgctctttctccaactttccctctttctctgccatcacacttgggccttcactgcagcgtggtgtggccaccgtccgtgtcctctcggccttcctccgagtccaggtggactctgtggatgtgtggatgtggcccgagcaggctcaggcggccccactcacccacagcatccgccgccaccccttcgggtgtgagcgctcaataaaaacaacacactataaagtgtttttaaatccaaacagaa

SEQ ID NO: 171205 - DNA, 6203 bp, Homo sapiens
  Payload ID: 13683
  Gene Symbol: PPP2R2D
  Gene Name: protein phosphatase 2, regulatory subunit B, delta
  ENST ID: ENST00000470416
  CDS Start-End: 1-174
tcgcaggtcaagggggccatcgacgaggacgtggccgaagggcgtggagaggagagctcggggctgctgccacagatcatgctgagccgccagcagctccacctgcccttggctttgctcatccgtggaaatgacaacagcgtgaaaacggcagatgatgtacaaggattatgatgaaaatagtcttgacctcacggaccctctgagaggttcttgaccgttgcaccctcaagggcccacagaccgcactttgagaactgctgcttgaatgcaagctattagcagtaggagtgtcaaggacagggcagacttcaggattaactgttccttctcatctttaccagattgtactggttttgtctcaaaatacaaaaatagagtgtttattatgtaaagaaaatcaaatgatagaacagctgagaacagctggatcaagagcacagagcggaagttcctcttcatcccactgctgtcctggagtcttcctcaggacccactgctcctaactgtatctttgtagatcattttctatgtgtttatttatttatattttaaaacctagtttgtgtataagcaatcttttttaatccacaaatgtggaatcttattctagactttgaataagattttctgtattagtcagtattgttttttgctacttcttttcctttcctttccttttttggaaatagggtcttactcctctgtcacccaggctggagtgcagtggtgcgatcagagctcactgcagcctgatcaggctcaagcaatcctctccctgctcagcctcctgagtagctggaactataggcttgcactgccatgcccagcttttttctattttttgtagagacagggttttgctgtgttgcccaggatggtcttgaactcctggactcaagtgatcctcccacctcggcctcccaaaatgctgggaatacaagcatgagccatggcatgtggccgccacttgccttttttcattaagagtctataattggagatcttacagggaactgggctttctgctcagccatactcgagctcatttgacccccggccactgccccttgaaatcggacatcatttccaccgttgagtttaattactctggagatcttcttgcaacaggagacaagggcggcagagttgttatttttcagcgtgaacaagagaataaaagccgccctcattctaggggagaatataatgtttacagcacctttcaaagtcatgaaccggagtttgactatttgaaaagtctagaaattgaggaaaaaattaataaaattaggtggttaccacaacagaatgctgctcattttctactgtctacaaatgataaaactataaaattatggaaaataagtgaacgggataaaagagcagaaggttataacctgaaagacgaagatggaagacttcgagacccatttaggatcacggcgctacgggtcccaatattgaagcccatggatcttatggtagaagcgagtccacggcgaatttttgcaaatgctcacacatatcatataaattccatttcagtaaatagtgatcatgaaacatatctttctgcagatgacctgagaattaatttatggcacttagaaatcacagatagaagctttaacatcgtggacatcaagcctgctaacatggaggagctgaccgaagtcatcactgcagccgagttccacccgcaccagtgcaacgtgttcgtctacagcagtagcaaagggaccatccgcctgtgtgacatgcgctcctcggccctgtgcgacagacactccaagttttttgaagagcctgaagatcccagcagtaggtccttcttctcagaaataatttcatccatatccgatgtaaaattcagtcatagtgggcggtacatgatgaccagagactacctgtcggtgaaggtgtgggacctcaacatggagagcaggccggtggagacccaccaggtccacgagtacctgcgcagcaagctctgctctctctatgagaacgactgcatctttgacaagtttgagtgttgctggaacggttcggatagcgccatcatgaccgggtcctataacaacttcttcaggatgtttgatagagacacgcggagggatgtgaccctggaggcctcgagagagagcagcaaaccgcgcgccagcctcaaaccccggaaggtgtgtacggggggtaagcggaggaaagacgagatcagtgtggacagtctggacttcaacaagaagatcctgcacacagcctggcaccccgtggacaatgtcattgccgtggctgccaccaataacttgtacatattccaggacaaaatcaactagagacgcgaacgtgaggaccaagtcttgtcttgcatagttaagccggacatttttctgtcagagaaaaggcatcattgtccgctccattaagaacagtgacgcacctgctacttcccttcacagacacaggagaaagccgcctccgctggaggcccggtgtggttccgcctcggcgaggcgcgagacaggcgctgctgctcacgtggagacgctctcgaagcagagttgacggacactgctcccaaaaggtcattactcagaataaatgtatttatttcagtccgagccttcctttccaatttatagaccaaaaaattaacatccaagagaaaagttattgtcagataccgctctttctccaactttccctctttctctgccatcacacttgggccttcactgcagcgtggtgtggccaccgtccgtgtcctctcggccttcctccgagtccaggtggactctgtggatgtgtggatgtggcccgagcaggctcaggcggccccactcacccacagcatccgccgccaccccttcgggtgtgagcgctcaataaaaacaacacactataaagtgtttttaaatccaaacagaagtattgtctttttatttaattttattgcatagaatgaagttatgcagggttcttctttggaactaactgtttgagaaatgtgtgtccttctttggcagcgtgggggtatgtgtgcagcatttctgtccccaagctgctgcccgctgtgtttctgtagaagtagcccatcagatacaccaggtaaggtctgggaaaagccagaaccgaggccacctctgagaaagaaaattgcaaggaagaaccaaaattgctgccatccagtaagcctggtttaaagtagcttcaaattcactacagttgaagaaatacgtgcttgctttctaaggcttttgaaaaagcactttggggaaagtatactttttaaacattgctaaaattacatgcatgctaaatttcatcctgcatttcaagccagcaaaattaagcaattttaattacacgatgccaccagtacgttggtttattttcaaagtaggatctttgataccagaaatcaagattttccaagacaaataatacagagctgtaccaatgctgagtgaccagagcttgcttccgtgggatttaacacacgcccactacgtgtccccgaggggagtggggagtcgggctcccgtgcccctgtggagatggaggtgtgtgctgatcccccgtccgcctgtggagatgaaggtgtgtgttgattcctcctgctgctgtggagatggaggtgtgtgctgatcgcccgtcaccctgtctagatgaaggtatgtgctgattgcctgtgcccctgtggagaaggaggtgtgtgctgatcccctgtgccctgtggagatggaggtgtgtgctgctccctcgtgcccctgtggagatggaggtgtgtgctgatcccccatcccatccccctgtctagatgaaggtgtgtgctgattcctcatgcccctgtctggatgaaggtgtgtgctgatcccccgtccccctgtggagatgaaggtgtgtgctgatcccccgtgcccctgtggagatgaaggtgcgtgctgatcccccatctccctgtggagatgaaggtgtgtgctgatccccatccccctgtggagatgaagggatatgctgatcccctgtcccactgtggagatgaaggggtgtgctgatcccccgtccccctgtggagatgaaggtgtgtgctgatcccccatctccctgtggagatgaaggggtgtgccaatcccccgcgcccctgtggagatggaggcgtgtgctgatccccatccccctgtggagatgaaggtgtgtgctgatcccccatccccatgtggagatgaaggggtgtgttgatcccctgtccccctgtggagatggtgtgtgctgatccccgtccccctgtggagatgaaggtgtgtgctgatcccccatctccctgtgaagatgaaggggtgtgctgatcccccgtgcccctgtggacatggaggcgtgtgctgatcccccgtccccctgtggagatgaaggtgtgtgctgatcccccatccccatgtggagatgaaggggtgtgttgatcccccgtccccctgtggagatgaaggtgtgtgctgatccccgtccccctgtggagatgaaggggtgtgctgatcccccatgccctgtggagatggaggtgtgtgctgatccctcgtgcccctgtggagatagaggtgtgtactgatcccctgttcccctatctagatgaaggtgtgtactgctgatcccccgtccccctgtggagatgaaggtgtgtgctgatcccccatccccctgtggagatgaaggggtgtgctgatcccccgtcttcctgtggagatgaaggtgtgtgctgattcctcatgcccctgtggagatggaggtgtgtgctgatcccccatccccctgtggggatgaaggtgtgtgctgatcccccatccccctgtggagatgaaggggtatgctgatcccccgtccccctgtggagatgaaggtgtgtgctgatcccccatccccctgtggagatgaaggggtatgctgatcccctgtccccctgtggggatgaaggtgtgtgctgatctcttgtccccctgtggagatggaggtgtgtgctgatcccccatccccctgtggagatgaagatgtgtgctgatcccccgtcctcctgtggagatgaaggtgtgtgctgcttcctcgtgcccctgtggagatggaggtgtgtgctggtcccccgtccccctgtggagatggaggtgtgtgctgatcccccgtccccctgtggagatggaggcgtgtgctgatcccccatccccctgtggagatgaaggcgtgtgctgatccgccatcccactgtggagatgaaggcgtgtgctgatcccccatccccctgtggagataaaggtgtgtgctgatcccccatccccctgtggagatgaaggcgtgtgctgatccgccatcccactgtggagatgaaggcgtgtgctgatcccccatccccctgtggagatgaaggcgtgtgctcatcccccatccccctgtggagatgaaggcgtgtgctgatccgccatcccactgtggagatgaaggtgtgtgctgatcccccatccccctgtggagatgaaggtgtgtgctgatccccggtccccctgtggagatgaaggtgtgtgctgatcccccgtcctcctgtggagatgaaggcgtgtgctgatcccccgtccccctgtggagatgaaggcgtgtgctgatccgccgtccccctgtggagatgaaggcgtgtgctgatccgccatccccctgtggagatgaaggcgtgtgctcatcccccatccccctgtggagatgaaggcgtgtgctgatccgccatcccactgtggagatgaaggtgtgtgctgatcccccatccccctgtggagatgaaggcgtgtgctgatccccggtccccctgtggagatgaaggtgtgtgttgatcccccatccccctgtggaggtgaaggtgtgtgctgattactaatccacatgggcaagaacaggatgtccgtcattaccctgaatcaatgctaacacagtgccacttgagttcacattaagttagaaattgagaatctaaaggtacctttattttaactaaaaaataatttatatactgtatattgattgtgacacaatttacaaagtctgaggtgtggaacagttatttaagcattagtcaaccctggtccttaagacagttctagtaaaatgggattgtatatatttgttcaactattttgaccaaaaagttcaataaattttaaatgttt

SEQ ID NO: 171206 - DNA, 2958 bp, Homo sapiens
  Payload ID: 13684
  Gene Symbol: PPP2R5D
  Gene Name: protein phosphatase 2, regulatory subunit B', delta
  ENST ID: ENST00000230402
  CDS Start-End: 79-414
gagcgggccgagtgcggccgagcaaagccggagccggagcggggccgcaggagacgggccgggtccggacgggccgagatgccctataaactgaaaaaggagaaggagccccccaaggttgccaaatgcacagccaagcctagcagctcgggcaaggatggtggaggcgagaacactgaggaggtgacttgtttgaccaggcccagccgcagccccagccccagccccagccccaagcccagtctcagccaccgtcatccaacaagcgtcccagcaatagcacgccgccccccacgcagctcagcaaaatcaagtactcaggggggccccagattgtcaagaaggagcgacggcaaagctcctcccgcttcaacctcagcaagaatcgggagctgcagaagcttcctgccctgaaagattcgccaacccaggagcgggaggagctgtttatccagaagctacgccagtgctgtgtcctctttgacttcgtgtcagacccactcagtgacctcaaattcaaggaggtgaagcgggcaggactcaacgagatggtggagtacatcacccatagccgtgatgttgtcactgaggccatttaccctgaggctgtcaccatgttttcagtgaacctcttccggacgctgccaccttcatcgaatcccacaggggctgagtttgacccagaggaagatgagcccaccctggaagctgcttggccacatctccagctcgtgtatgagttcttcttacgtttccttgagtctcctgatttccagccaaacatagccaagaagtacatcgaccagaagtttgtacttgctctcctagacctatttgacagtgaggatcctcgagagcgggacttcctcaagaccattttgcatcgcatctatggcaagtttttggggctccgggcttatatccgtaggcagatcaaccacatcttctacaggttcatctacgagacggagcatcacaacgggattgctgagctcctggagatcctgggcagcatcatcaatggctttgccctgccccttaaagaagagcacaagatgttcctcatccgtgtcctacttccccttcacaaggtcaagtccctgagtgtctaccaccctcagctggcatactgtgtggtacaattcctggagaaggagagcagtctgactgagccggtaattgtgggacttctcaagttttggcccaagacccacagccccaaggaggtgatgttcttgaatgagctggaggagattctggacgtcattgaaccttctgagttcagcaaagtgatggaacccctcttccgccagctggccaagtgtgtctctagcccccatttccaggtggcagagcgtgctctctattactggaacaatgagtacatcatgagcctgataagtgacaatgctgcccgagtcctccccatcatgttccctgcactctacaggaactccaagagccactggaacaagacaatccatggactgatctataatgccctgaagttgtttatggaaatgaatcagaagctgtttgatgactgcacacaacaatacaaggcagagaagcagaagggccggttccgaatgaaggaaagggaagagatgtggcaaaaaatcgaggagctggcccggcttaatccccagtatcccatgttccgagcccctccaccactgccccctgtgtactcgatggagacagagacccccacagctgaggacatccagcttctgaagaggactgtggagactgaggctgttcagatgctaaaagacatcaagaaggagaaagtgctgctgcggaggaagtcggagctgccccaggacgtgtacaccatcaaggcactggaggcgcacaagcgggcggaagagttcctaactgccagccaggaggctctctgacccctcacgttcctaccacagggccacagcccacacagccctgggacactgccctggccctccatactctgctccctactggctgtcttgggggaaggcagcgcctctctagctactcaagggagggggatgtgggcacttgaagcagggacacccacagaatggtccctcttctccccaaaaggtgttcatgcctccctgtggctagtacaggctgagcactaagatgcttagtgctcagacaacctggggatgcctgtcccctacctgctcctcacccacagctacctgaggctgctctgagaagtacacacaggaatacatacgctcctctattcttcccttcatcctcatttgaacgccaggtatctcccctcctctctctcccctgcagaggcatgtagggaacagcaggagattattctcaccaaagttatgtcaagccccattggtcccagagtagctgaagggaagccaacccccctgcagcacaaataggccccccagtcccagccgtgtgctggcagatagggttgtattatttcttcttaccccatgcctgaccaagggaggtcaaaaggagaaaagtataggctgtggacaataactgatgaatatagggcccagatggaccaagtggggccggggagggatgaataaacaccctaccccgtgccctgtctttggtgagcagcagccctggggtcacagacatggaagggaccaccctggggctgactgcttttctgtgctgttggttcccaaaactagaaagaaggaagcagggagcggtgccccaagcatggctcctgccaacacctatttatttccttgtttgtgctatgctgggcaggccttctcttgtcccttataggtaccttggaggggccaggggctgaggaaggccggacccaggttccaggggcgcaggcagtgcggcttttggctgtgtacatagggtgctttattctccacagagtgatacatgctaaggtgggttgggcttggaccgatgtccccatatgtacagaactgaataaagtgggtctctgag

SEQ ID NO: 171207 - DNA, 2894 bp, Homo sapiens
  Payload ID: 13684
  Gene Symbol: PPP2R5D
  Gene Name: protein phosphatase 2, regulatory subunit B', delta
  Uniprot ID: Q14738
  ENST ID: ENST00000394110
  CDS Start-End: 126-1838
caccgctcgacccgggcgcagcgcgcaggcggtggcgaagagacgccgagcgggccgagtgcggccgagcaaagccggagccggagcggggccgcaggagacgggccgggtccggacgggccgagatgccctataaactgaaaaaggagaaggagccccccaaggttgccaaatgcacagccaagcctagcagctcgggcaaggatggtggaggcgagaacactgaggaggcccagccgcagccccagccccagccccagccccaagcccagtctcagccaccgtcatccaacaagcgtcccagcaatagcacgccgccccccacgcagctcagcaaaatcaagtactcaggggggccccagattgtcaagaaggagctgtttatccagaagctacgccagtgctgtgtcctctttgacttcgtgtcagacccactcagtgacctcaaattcaaggaggtgaagcgggcaggactcaacgagatggtggagtacatcacccatagccgtgatgttgtcactgaggccatttaccctgaggctgtcaccatgttttcagtgaacctcttccggacgctgccaccttcatcgaatcccacaggggctgagtttgacccagaggaagatgagcccaccctggaagctgcttggccacatctccagctcgtgtatgagttcttcttacgtttccttgagtctcctgatttccagccaaacatagccaagaagtacatcgaccagaagtttgtacttgctctcctagacctatttgacagtgaggatcctcgagagcgggacttcctcaagaccattttgcatcgcatctatggcaagtttttggggctccgggcttatatccgtaggcagatcaaccacatcttctacaggttcatctacgagacggagcatcacaacgggattgctgagctcctggagatcctgggcagcatcatcaatggctttgccctgccccttaaagaagagcacaagatgttcctcatccgtgtcctacttccccttcacaaggtcaagtccctgagtgtctaccaccctcagctggcatactgtgtggtacaattcctggagaaggagagcagtctgactgagccggtaattgtgggacttctcaagttttggcccaagacccacagccccaaggaggtgatgttcttgaatgagctggaggagattctggacgtcattgaaccttctgagttcagcaaagtgatggaacccctcttccgccagctggccaagtgtgtctctagcccccatttccaggtggcagagcgtgctctctattactggaacaatgagtacatcatgagcctgataagtgacaatgctgcccgagtcctccccatcatgttccctgcactctacaggaactccaagagccactggaacaagacaatccatggactgatctataatgccctgaagttgtttatggaaatgaatcagaagctgtttgatgactgcacacaacaatacaaggcagagaagcagaagggccggttccgaatgaaggaaagggaagagatgtggcaaaaaatcgaggagctggcccggcttaatccccagtatcccatgttccgagcccctccaccactgccccctgtgtactcgatggagacagagacccccacagctgaggacatccagcttctgaagaggactgtggagactgaggctgttcagatgctaaaagacatcaagaaggagaaagtgctgctgcggaggaagtcggagctgccccaggacgtgtacaccatcaaggcactggaggcgcacaagcgggcggaagagttcctaactgccagccaggaggctctctgacccctcacgttcctaccacagggccacagcccacacagccctgggacactgccctggccctccatactctgctccctactggctgtcttgggggaaggcagcgcctctctagctactcaagggagggggatgtgggcacttgaagcagggacacccacagaatggtccctcttctccccaaaaggtgttcatgcctccctgtggctagtacaggctgagcactaagatgcttagtgctcagacaacctggggatgcctgtcccctacctgctcctcacccacagctacctgaggctgctctgagaagtacacacaggaatacatacgctcctctattcttcccttcatcctcatttgaacgccaggtatctcccctcctctctctcccctgcagaggcatgtagggaacagcaggagattattctcaccaaagttatgtcaagccccattggtcccagagtagctgaagggaagccaacccccctgcagcacaaataggccccccagtcccagccgtgtgctggcagatagggttgtattatttcttcttaccccatgcctgaccaagggaggtcaaaaggagaaaagtataggctgtggacaataactgatgaatatagggcccagatggaccaagtggggccggggagggatgaataaacaccctaccccgtgccctgtctttggtgagcagcagccctggggtcacagacatggaagggaccaccctggggctgactgcttttctgtgctgttggttcccaaaactagaaagaaggaagcagggagcggtgccccaagcatggctcctgccaacacctatttatttccttgtttgtgctatgctgggcaggccttctcttgtcccttataggtaccttggaggggccaggggctgaggaaggccggacccaggttccaggggcgcaggcagtgcggcttttggctgtgtacatagggtgctttattctccacagagtgatacatgctaaggtgggttgggcttggaccgatgtccccatatgtacagaactgaataaagtgggtctctgagaa

SEQ ID NO: 171208 - DNA, 3044 bp, Homo sapiens
  Payload ID: 13684
  Gene Symbol: PPP2R5D
  Gene Name: protein phosphatase 2, regulatory subunit B', delta
  Uniprot ID: Q14738
  ENST ID: ENST00000485511
  CDS Start-End: 180-1988
ggcgcctggttgtcaggcagttttgtaggagttcgggccaattggaggcgcaggcaccgctcgacccgggcgcagcgcgcaggcggtggcgaagagacgccgagcgggccgagtgcggccgagcaaagccggagccggagcggggccgcaggagacgggccgggtccggacgggccgagatgccctataaactgaaaaaggagaaggagccccccaaggttgccaaatgcacagccaagcctagcagctcgggcaaggatggtggaggcgagaacactgaggaggcccagccgcagccccagccccagccccagccccaagcccagtctcagccaccgtcatccaacaagcgtcccagcaatagcacgccgccccccacgcagctcagcaaaatcaagtactcaggggggccccagattgtcaagaaggagcgacggcaaagctcctcccgcttcaacctcagcaagaatcgggagctgcagaagcttcctgccctgaaagattcgccaacccaggagcgggaggagctgtttatccagaagctacgccagtgctgtgtcctctttgacttcgtgtcagacccactcagtgacctcaaattcaaggaggtgaagcgggcaggactcaacgagatggtggagtacatcacccatagccgtgatgttgtcactgaggccatttaccctgaggctgtcaccatgttttcagtgaacctcttccggacgctgccaccttcatcgaatcccacaggggctgagtttgacccagaggaagatgagcccaccctggaagctgcttggccacatctccagctcgtgtatgagttcttcttacgtttccttgagtctcctgatttccagccaaacatagccaagaagtacatcgaccagaagtttgtacttgctctcctagacctatttgacagtgaggatcctcgagagcgggacttcctcaagaccattttgcatcgcatctatggcaagtttttggggctccgggcttatatccgtaggcagatcaaccacatcttctacaggttcatctacgagacggagcatcacaacgggattgctgagctcctggagatcctgggcagcatcatcaatggctttgccctgccccttaaagaagagcacaagatgttcctcatccgtgtcctacttccccttcacaaggtcaagtccctgagtgtctaccaccctcagctggcatactgtgtggtacaattcctggagaaggagagcagtctgactgagccggtaattgtgggacttctcaagttttggcccaagacccacagccccaaggaggtgatgttcttgaatgagctggaggagattctggacgtcattgaaccttctgagttcagcaaagtgatggaacccctcttccgccagctggccaagtgtgtctctagcccccatttccaggtggcagagcgtgctctctattactggaacaatgagtacatcatgagcctgataagtgacaatgctgcccgagtcctccccatcatgttccctgcactctacaggaactccaagagccactggaacaagacaatccatggactgatctataatgccctgaagttgtttatggaaatgaatcagaagctgtttgatgactgcacacaacaatacaaggcagagaagcagaagggccggttccgaatgaaggaaagggaagagatgtggcaaaaaatcgaggagctggcccggcttaatccccagtatcccatgttccgagcccctccaccactgccccctgtgtactcgatggagacagagacccccacagctgaggacatccagcttctgaagaggactgtggagactgaggctgttcagatgctaaaagacatcaagaaggagaaagtgctgctgcggaggaagtcggagctgccccaggacgtgtacaccatcaaggcactggaggcgcacaagcgggcggaagagttcctaactgccagccaggaggctctctgacccctcacgttcctaccacagggccacagcccacacagccctgggacactgccctggccctccatactctgctccctactggctgtcttgggggaaggcagcgcctctctagctactcaagggagggggatgtgggcacttgaagcagggacacccacagaatggtccctcttctccccaaaaggtgttcatgcctccctgtggctagtacaggctgagcactaagatgcttagtgctcagacaacctggggatgcctgtcccctacctgctcctcacccacagctacctgaggctgctctgagaagtacacacaggaatacatacgctcctctattcttcccttcatcctcatttgaacgccaggtatctcccctcctctctctcccctgcagaggcatgtagggaacagcaggagattattctcaccaaagttatgtcaagccccattggtcccagagtagctgaagggaagccaacccccctgcagcacaaataggccccccagtcccagccgtgtgctggcagatagggttgtattatttcttcttaccccatgcctgaccaagggaggtcaaaaggagaaaagtataggctgtggacaataactgatgaatatagggcccagatggaccaagtggggccggggagggatgaataaacaccctaccccgtgccctgtctttggtgagcagcagccctggggtcacagacatggaagggaccaccctggggctgactgcttttctgtgctgttggttcccaaaactagaaagaaggaagcagggagcggtgccccaagcatggctcctgccaacacctatttatttccttgtttgtgctatgctgggcaggccttctcttgtcccttataggtaccttggaggggccaggggctgaggaaggccggacccaggttccaggggcgcaggcagtgcggcttttggctgtgtacatagggtgctttattctccacagagtgatacatgctaaggtgggttgggcttggaccgatgtccccatatgtacagaactgaataaagtgggtctctgagaa

SEQ ID NO: 171209 - DNA, 2567 bp, Homo sapiens
  Payload ID: 13684
  Gene Symbol: PPP2R5D
  Gene Name: protein phosphatase 2, regulatory subunit B', delta
  ENST ID: ENST00000470467
  CDS Start-End: 1-1513
caagaaggagcgacggcaaagctcctcccgcttcaacctcagcaagaatcgggagctgcagaagcttcctgccctgaaagattcgccaacccaggagcgggaggagctgtttatccagaagctacgccagtgctgtgtcctctttgacttcgtgtcagacccactcagtgacctcaaattcaaggaggtgaagcgggcaggactcaacgagatggtggagtacatcacccatagccgtgatgttgtcactgaggccatttaccctgaggctgtcaccatgttttcagtgaacctcttccggacgctgccaccttcatcgaatcccacaggggctgagtttgacccagaggaagatgagcccaccctggaagctgcttggccacatctccagctcgtgtatgagttcttcttacgtttccttgagtctcctgatttccagccaaacatagccaagaagtacatcgaccagaagtttgtacttgctctcctagacctatttgacagtgaggatcctcgagagcgggacttcctcaagaccattttgcatcgcatctatggcaagtttttggggctccgggcttatatccgtaggcagatcaaccacatcttctacaggttcatctacgagacggagcatcacaacgggattgctgagctcctggagatcctgggcagcatcatcaatggctttgccctgccccttaaagaagagcacaagatgttcctcatccgtgtcctacttccccttcacaaggtcaagtccctgagtgtctaccaccctcaggtaattgtgggacttctcaagttttggcccaagacccacagccccaaggaggtgatgttcttgaatgagctggaggagattctggacgtcattgaaccttctgagttcagcaaagtgatggaacccctcttccgccagctggccaagtgtgtctctagcccccatttccaggtggcagagcgtgctctctattactggaacaatgagtacatcatgagcctgataagtgacaatgctgcccgagtcctccccatcatgttccctgcactctacaggaactccaagagccactggaacaagacaatccatggactgatctataatgccctgaagttgtttatggaaatgaatcagaagctgtttgatgactgcacacaacaatacaaggcagagaagcagaagggccggttccgaatgaaggaaagggaagagatgtggcaaaaaatcgaggagctggcccggcttaatccccagtatcccatgttccgagcccctccaccactgccccctgtgtactcgatggagacagagacccccacagctgaggacatccagcttctgaagaggactgtggagactgaggctgttcagatgctaaaagacatcaagaaggagaaagtgctgctgcggaggaagtcggagctgccccaggacgtgtacaccatcaaggcactggaggcgcacaagcgggcggaagagttcctaactgccagccaggaggctctctgacccctcacgttcctaccacagggccacagcccacacagccctgggacactgccctggccctccatactctgctccctactggctgtcttgggggaaggcagcgcctctctagctactcaagggagggggatgtgggcacttgaagcagggacacccacagaatggtccctcttctccccaaaaggtgttcatgcctccctgtggctagtacaggctgagcactaagatgcttagtgctcagacaacctggggatgcctgtcccctacctgctcctcacccacagctacctgaggctgctctgagaagtacacacaggaatacatacgctcctctattcttcccttcatcctcatttgaacgccaggtatctcccctcctctctctcccctgcagaggcatgtagggaacagcaggagattattctcaccaaagttatgtcaagccccattggtcccagagtagctgaagggaagccaacccccctgcagcacaaataggccccccagtcccagccgtgtgctggcagatagggttgtattatttcttcttaccccatgcctgaccaagggaggtcaaaaggagaaaagtataggctgtggacaataactgatgaatatagggcccagatggaccaagtggggccggggagggatgaataaacaccctaccccgtgccctgtctttggtgagcagcagccctggggtcacagacatggaagggaccaccctggggctgactgcttttctgtgctgttggttcccaaaactagaaagaaggaagcagggagcggtgccccaagcatggctcctgccaacacctatttatttccttgtttgtgctatgctgggcaggccttctcttgtcccttataggtaccttggaggggccaggggctgaggaaggccggacccaggttccaggggcgcaggcagtgcggcttttggctgtgtacatagggtgctttattctccacagagtgatacatgctaaggtgggttgggcttggaccgatgtccccatatgtacagaactgaataaagtgggtctctgag

SEQ ID NO: 171210 - DNA, 462 bp, Homo sapiens
  Payload ID: 13684
  Gene Symbol: PPP2R5D
  Gene Name: protein phosphatase 2, regulatory subunit B', delta
  ENST ID: ENST00000486843
  CDS Start-End: 1-462
gttcttgaatgagctggaggagattctggacgtcattgaaccttctgagttcagcaaagtgatggaacccctcttccgccagctggccaagtgtgtctctagcccccatttccaggtggcagagcgtgctctctattactggaacaatgagtacatcatgagcctgataagtgacaatgctgcccgagtcctccccatcatgttccctgcactctacaggaactccaagagccactggaacaagacaatccatggactgatctataatgccctgaagttgtttatggaaatgaatcagaagctgtttgatgactgcacacaacaatacaaggcagagaagcagaacccaaccccaatcctacttttgctcctcaggggccggttccgaatgaaggaaagggaagagatgtggcaaaaaatcgaggagctggcccggcttaatccccagtatcccatgttccg

SEQ ID NO: 171211 - DNA, 2963 bp, Homo sapiens
  Payload ID: 13684
  Gene Symbol: PPP2R5D
  Gene Name: protein phosphatase 2, regulatory subunit B', delta
  ENST ID: ENST00000472118
  CDS Start-End: 125-1909
accgctcgacccgggcgcagcgcgcaggcggtggcgaagagacgccgagcgggccgagtgcggccgagcaaagccggagccggagcggggccgcaggagacgggccgggtccggacgggccgagatgccctataaactgaaaaaggagaaggagccccccaaggttgccaaatgcacagccaagcctagcagctcgggcaaggatggtggaggcgagaacactgaggagccccagccccaagcccagtctcagccaccgtcatccaacaagcgtcccagcaatagcacgccgccccccacgcagctcagcaaaatcaagtactcaggggggccccagattgtcaagaaggagcgacggcaaagctcctcccgcttcaacctcagcaagaatcgggagctgcagaagcttcctgccctgaaagattcgccaacccaggagcgggaggagctgtttatccagaagctacgccagtgctgtgtcctctttgacttcgtgtcagacccactcagtgacctcaaattcaaggaggtgaagcgggcaggactcaacgagatggtggagtacatcacccatagccgtgatgttgtcactgaggccatttaccctgaggctgtcaccatgttttcagtgaacctcttccggacgctgccaccttcatcgaatcccacaggggctgagtttgacccagaggaagatgagcccaccctggaagctgcttggccacatctccagctcgtgtatgagttcttcttacgtttccttgagtctcctgatttccagccaaacatagccaagaagtacatcgaccagaagtttgtacttgctctcctagacctatttgacagtgaggatcctcgagagcgggacttcctcaagaccattttgcatcgcatctatggcaagtttttggggctccgggcttatatccgtaggcagatcaaccacatcttctacaggttcatctacgagacggagcatcacaacgggattgctgagctcctggagatcctgggcagcatcatcaatggctttgccctgccccttaaagaagagcacaagatgttcctcatccgtgtcctacttccccttcacaaggtcaagtccctgagtgtctaccaccctcagctggcatactgtgtggtacaattcctggagaaggagagcagtctgactgagccggtaattgtgggacttctcaagttttggcccaagacccacagccccaaggaggtgatgttcttgaatgagctggaggagattctggacgtcattgaaccttctgagttcagcaaagtgatggaacccctcttccgccagctggccaagtgtgtctctagcccccatttccaggtggcagagcgtgctctctattactggaacaatgagtacatcatgagcctgataagtgacaatgctgcccgagtcctccccatcatgttccctgcactctacaggaactccaagagccactggaacaagacaatccatggactgatctataatgccctgaagttgtttatggaaatgaatcagaagctgtttgatgactgcacacaacaatacaaggcagagaagcagaagggccggttccgaatgaaggaaagggaagagatgtggcaaaaaatcgaggagctggcccggcttaatccccagtatcccatgttccgagcccctccaccactgccccctgtgtactcgatggagacagagacccccacagctgaggacatccagcttctgaagaggactgtggagactgaggctgttcagatgctaaaagacatcaagaaggagaaagtgctgctgcggaggaagtcggagctgccccaggacgtgtacaccatcaaggcactggaggcgcacaagcgggcggaagagttcctaactgccagccaggaggctctctgacccctcacgttcctaccacagggccacagcccacacagccctgggacactgccctggccctccatactctgctccctactggctgtcttgggggaaggcagcgcctctctagctactcaagggagggggatgtgggcacttgaagcagggacacccacagaatggtccctcttctccccaaaaggtgttcatgcctccctgtggctagtacaggctgagcactaagatgcttagtgctcagacaacctggggatgcctgtcccctacctgctcctcacccacagctacctgaggctgctctgagaagtacacacaggaatacatacgctcctctattcttcccttcatcctcatttgaacgccaggtatctcccctcctctctctcccctgcagaggcatgtagggaacagcaggagattattctcaccaaagttatgtcaagccccattggtcccagagtagctgaagggaagccaacccccctgcagcacaaataggccccccagtcccagccgtgtgctggcagatagggttgtattatttcttcttaccccatgcctgaccaagggaggtcaaaaggagaaaagtataggctgtggacaataactgatgaatatagggcccagatggaccaagtggggccggggagggatgaataaacaccctaccccgtgccctgtctttggtgagcagcagccctggggtcacagacatggaagggaccaccctggggctgactgcttttctgtgctgttggttcccaaaactagaaagaaggaagcagggagcggtgccccaagcatggctcctgccaacacctatttatttccttgtttgtgctatgctgggcaggccttctcttgtcccttataggtaccttggaggggccaggggctgaggaaggccggacccaggttccaggggcgcaggcagtgcggcttttggctgtgtacatagggtgctttattctccacagagtgatacatgctaaggtgggttgggcttggaccgatgtccccatatgtacagaactgaataaagtgggtctctgag

SEQ ID NO: 171212 - DNA, 1558 bp, Homo sapiens
  Payload ID: 13684
  Gene Symbol: PPP2R5D
  Gene Name: protein phosphatase 2, regulatory subunit B', delta
  Uniprot ID: Q14738
  ENST ID: ENST00000461010
  CDS Start-End: 27-1517
gacgggccgggtccggacgggccgagatgccctataaactgaaaaaggagaaggagctgtttatccagaagctacgccagtgctgtgtcctctttgacttcgtgtcagacccactcagtgacctcaaattcaaggaggtgaagcgggcaggactcaacgagatggtggagtacatcacccatagccgtgatgttgtcactgaggccatttaccctgaggctgtcaccatgttttcagtgaacctcttccggacgctgccaccttcatcgaatcccacaggggctgagtttgacccagaggaagatgagcccaccctggaagctgcttggccacatctccagctcgtgtatgagttcttcttacgtttccttgagtctcctgatttccagccaaacatagccaagaagtacatcgaccagaagtttgtacttgctctcctagacctatttgacagtgaggatcctcgagagcgggacttcctcaagaccattttgcatcgcatctatggcaagtttttggggctccgggcttatatccgtaggcagatcaaccacatcttctacaggttcatctacgagacggagcatcacaacgggattgctgagctcctggagatcctgggcagcatcatcaatggctttgccctgccccttaaagaagagcacaagatgttcctcatccgtgtcctacttccccttcacaaggtcaagtccctgagtgtctaccaccctcagctggcatactgtgtggtacaattcctggagaaggagagcagtctgactgagccggtaattgtgggacttctcaagttttggcccaagacccacagccccaaggaggtgatgttcttgaatgagctggaggagattctggacgtcattgaaccttctgagttcagcaaagtgatggaacccctcttccgccagctggccaagtgtgtctctagcccccatttccaggtggcagagcgtgctctctattactggaacaatgagtacatcatgagcctgataagtgacaatgctgcccgagtcctccccatcatgttccctgcactctacaggaactccaagagccactggaacaagacaatccatggactgatctataatgccctgaagttgtttatggaaatgaatcagaagctgtttgatgactgcacacaacaatacaaggcagagaagcagaagggccggttccgaatgaaggaaagggaagagatgtggcaaaaaatcgaggagctggcccggcttaatccccagtatcccatgttccgagcccctccaccactgccccctgtgtactcgatggagacagagacccccacagctgaggacatccagcttctgaagaggactgtggagactgaggctgttcagatgctaaaagacatcaagaaggagaaagtgctgctgcggaggaagtcggagctgccccaggacgtgtacaccatcaaggcactggaggcgcacaagcgggcggaagagttcctaactgccagccaggaggctctctgacccctcacgttcctaccacagggccacagcccacacagccc

SEQ ID NO: 171213 - DNA, 6659 bp, Homo sapiens
  Payload ID: 13685
  Gene Symbol: PPP2R5E
  Gene Name: protein phosphatase 2, regulatory subunit B', epsilon isoform
  Uniprot ID: Q16537
  ENST ID: ENST00000337537
  CDS Start-End: 604-2007
ggccagaaggttcggttgcgcgtgtgccatggactcagccgcccggtgatattgacaataggagagagaaaggggcattgactgggacccaccgcgggtagcgaaaggtggctctggcagcggcggctccagctcctgcggctcctcctccttattctgtccccttctcttgctgccgctgcagatccagtcttcctccctcccttccccccctccccacgtcgtcgccgccgccgccgggtccggggcaacgagctgaggcgccgcccgccaggaatgtgagcgaggagccaccggcggagccgcaacggggtcggtgccgatttgatgggacgggcccgcgggggaggatcgtgaggccgccgccgccaccggaacgctgaggttcgggtccggccgtgaggcctagaggctccgccgccgcggaaccggagggaccccgtaccggacagccgtcgccccaggctccccgcagctgcccggacctccccctgcacgtcccggtcccgccgcccgcccccgctgcggccacctcgcccgtctcccgcccctccaagccacagatcatctttggattcttccccagaagcttcaagtagggatatgtcctcagcaccaactactcctccatcagtggataaagtagacggattttctcggaagtccgtcagaaaagccagacagaagaggtcgcaaagttcctcacagtttaggtctcaaggcaagcctattgagttaacacctctgccgctgctaaaagacgttccatcctcagagcagcctgaactgttcctaaagaaacttcagcagtgctgtgtcatttttgacttcatggacacgctatctgatcttaaaatgaaagaatacaagcgctccactcttaatgaactggtggactacattacaataagcagaggctgtttgacagagcagacttaccctgaagtagttagaatggtatcttgcaatatattcagaactctccctcctagtgacagcaatgaatttgatccagaagaagatgaacctacccttgaggcatcgtggccacacttacagcttgtatatgaatttttcatacgatttttggaaagccaagaattccaacccagcattgccaaaaaatatatagatcagaaatttgtattacagcttctggagctatttgacagcgaagaccctcgggaacgggactacttaaaaacagtcttacacagaatttatggcaagtttcttggtcttagagcatttatccgaaaacagattaacaatatttttctaaggtttgtttatgaaacagaacacttcaatggtgtagctgaactgctggaaatattaggaagtattatcaatggctttgctttacctcttaaggcagaacacaaacagtttctggtgaaagtattgatccctttacacactgtcaggagcttatcactcttccatgcacagctggcatattgtatagtacagtttctggagaaagatccttcactcacagaaccagttattagggggttaatgaaattttggcctaaaacatgtagtcaaaaagaggtcatgttccttggggaactggaagaaatattggatgtgattgaaccttcacaatttgttaaaatccaagaacctttgtttaaacaaatcgccaagtgtgtatctagcccccattttcaggtggcagaaagagcactctattattggaataatgaatacatcatgagtttgatagaagaaaactctaacgtcatccttcccatcatgttttccagcctttataggatttcaaaagaacattggaatccggctattgtggcgttggtgtacaatgtgttgaaggcatttatggaaatgaacagcaccatgtttgacgagctgacagccacatacaagtcagatcgtcagcgtgagaaaaagaaagaaaaggagcgtgaagaattgtggaaaaaattggaggatctggagttaaagagaggtcttagacgtgatggaataattccaacttaacaaaaacaatgacaacaacattactaacctgtggagtcacacgtttatgtagtagaagatggagcaacagttttctgtattgtgcaactttacagtagatttcacctttgtttcattattacagcagcactgtatatacctgtctctaagtaaaggaaaaaacaaaataaggacttcaatccaaagtttggacagtagatggacttctcagaactttgcaaacataatcattgttctcaccctcttttaaaaaaaaaaatcggtcttcaaagatctgttgatgaaattgctatgttaaaattccattatcgggagttccttatttatcactagcagagagtatgatacaattttcaaatgtgaacaatcttaaatttagcttgtctttctgctaagctgttaaatgtatttatagtaaaggaagaaaaaaagactgtcatttccttataagtttgtgtaacatcctcctctggataacttgactgtaatttaacatctttttcttttgcacatcttcctgagttgaatgtccacgtggaatggggtcatgaattataaaagtccctgataaaagttttgtttactggggtgaacatctttccagtaaccaggtagtcctggtactcctttagttttaaaattaggagttaagagagaagaggtgataaacatagtagggaagggaatatcggattcatgcatcagtttatggtgaatccaaatcaatgtcttgaatcctttgaaaacaggcactgggacatcacaggcttcagtacctgaccagtattagttgcatatatcattgaacacacataccagagatgttttagaaatgtgagaaaaacatccttttggaccatttgaaataagaaagacaaacactaaacaatacaaccatgaaattgatcaccgggattgcaaatctaattgggaaaagagttgagcaaacagcttggactgtttggagttgttgccttactttttaatatgtatttataaagtattccagcaaaagaggatgtagcctctgggaaaaaacaaacatgttacagtgttttttgtagattctcgttctatatctcatcacagcgccagccctgtttttagccggaaaggattcaggataaacattattatgcattctgaattggatgcatattcctaactactgtatttgttaccaaaagtggttctacaaatgctactgaaaaaaatctggaaattcctaatgtcctgagtattaataataaagtttaaaaatgcttttatatcaaaggtgcatcgtgaccaaattgtttaagaaaaaaaaacaaaaaaaacaaaatctagggctgtattttatatatatatatatatatatatatatatatatatcttattggctctctgctttgtatttaaatgaagaatcttacatcttgggtaggtaaactgctgataaaatttgtgtacagtatgtacttacctaatgcagttgcattattacgtactgaaagatatgtgtttggaggtttatttccaggatgcatttgcttgttttggtcatggcagcagtgagttggtaatcctaaaccatcacttccagcagtattcatggtatagagctgatctgtgttcatatgttgaattgtgatagtagcaaacatgaacatatgaactattgttgctcttaatagaaatacaatataaatatgggcttgtatattttcttccttacatttaaatataaagtagaatacgcagttttattattttcaagaaaaagaaagagaagctgctgacctttctcccccataaagtttttcaggatgatcaggtcacagtgtgtacgtaagagtcagctaattatggatattgtcatctcggtaactttgtaaaaaaacaaacaaaactggcattgttaattccaaaaagaaaaaaaaaagcagtaaaaaaaaaaagtcatatgcaacaccagacgcaacatggtttaatggaattaatagtttttttttttttttttttaaagaacattgatggggattcactgtaaagttggcagaggctgccaaagacgaaacaactgactttaaaaatgctggaacaatgtgataaaaaataaatttgtaacaaatcttctcctttttagcccttgtcattttagccctttagtttcaactctgcattatatttagtttatatagtgtaaacttttgtttgccattaattcatctttttaggtagaagacattaaaatcacaggtttatgaagaatctctgctcattggaatgaaatgcagtcatttgaaatgagaaaggccaggatccttttttgtaccttaccctgtcttcaagagtaaaggtgaacacttacagctctcctccttgatgtcaattttgtatgttgatcattccaaactgagaagaataaagccacattttagacatatttatagaatcaattaaagctatatgtctaaaattcgtagggcaacttctgagaagaaacaccgtctttttcttttttaatggaaagtgacaatgtgacattagtcatgttgtgtgcggtgacgcagagtaactgaggtaatctgactgttgcactatgtgacatatttcaggacgtacttgctgcatttgcagcagccctctctctctgtcccttcccacaattctgctgttgctgcaacttgagttaattgtgacaaatgcatctttgtgttatattttgtttgcttcataatttccagaactatatataaatatattttttaaatagcaaatattgtagttagtgagtgatgatcactccaaccttatccttaccatattggtttcagggataggattaagagtgtctttggaagagaaaaatacacacaaccctgtggtttagaatgacgctgaggccttaggctgtgggcctagaacaactatgtgagtgaattcacccatctcatactttgaatcaagcatgcattcctgtttctcattgtgaagtatccccagttgttttccttcagtgttgagtttttgtccttttaaattttattatattttgctctccctaacatttgactgttttttataaaagaaaagaaaaaaaaagaaataaataataccctcgatgccactggatactcacaagcagggttatgctccttcatcttgggcttgtttgcctaaatgaaagggtttaatttattttgtacctcctatgcgtgggatagtccagggtgcagagccaggacttgcttgtaattgcacctgctatacttaaatgtatagccctaggctcaatcacactatggaaagaaacaaaaaaagtatatttagagctttaaaagcttttttatttttttgtggggatgagggtgggatgggaaagggatgtatggatgttattggcatttttaagtgtttagagttttttggggtttggggtggttttttttccttgttttccttttttccttttaattggatgcactgacctggcccaggaaatgaagagattctcttttgatgctattaccaatgttatcataaagtgacagtcacctgtaacaaaaaggtggcaccagacatgatcactgatgttttatttgcacatcaatatttttatttttgtattctggctcagctgcttctctgagtggagttaaggaatgagccacaaagatttttgtagtaggtatattggcattgcattttatattcctctatatttaattttgaaaacctaaaagaaggattgtgcatcttgagagaaagttgagcaaattgtgatctagcggaatgttaatttgtgctgcttcttgtgcacgatagcagcagtagtatctctcttggaaataaacatcccatattatgatgtctatgaatataggtttccttttcttccttccctccctccttcccccacctttctcttttttttttctctctcagcttctcttttcctccttccctcttcccttcctctttctttactttttttgaaatcacttattgtaaataagttgtaatccaaacctcatgtatcaatggggaattttcaaatataaatattaccaatgcattttctggttgttgtctgatttttgattgaagtataatgagaatgacatgtctgttgcttttggtttgaggacttcgctttagcttcataaatcttttggtattttagtatttcattgttttagcaggagagggcagcaaaagttcattttccctgttagtaatgctgtggttcatgatcggttttaaatttagctgtgtgtgtgtttttttaaacagcatctctttgtgagtagaggtaaaaatgaaacatttttgatatgaaaagttgcatatgaaaattatagactggttcaaccagacagtgaagacttctgatccacatcaaacttaaaatgccacaaaacaatcttccacctctggctaaaacatgctacttccttttcaaacaccacaaaatacaagctgagtcttaaacacttggaatttaaaatgtttttctttggaaatgatttgctttcttcaaagtggtaacagaaacaaaaatgaaggtgctccccaaaaagaaatgtaaccttcccctttcacagatgtgtgagaggttctgtactgtgggtgcatcataataaagaagcagtgaagagttttcaggt

SEQ ID NO: 171214 - DNA, 3478 bp, Homo sapiens
  Payload ID: 13685
  Gene Symbol: PPP2R5E
  Gene Name: protein phosphatase 2, regulatory subunit B', epsilon isoform
  Uniprot ID: Q16537
  ENST ID: ENST00000422769
  CDS Start-End: 186-1361
aagcatttgtgtgcatagtggctccaaagaggtgtgtgaggtgtgcgaggagggaagagcacacacttggtaatgaaggcctgagagctgcaggggctggaagagaacactcgtacgttccatcctcagagcagcctgaactgttcctaaagaaacttcagcagtgctgtgtcatttttgacttcatggacacgctatctgatcttaaaatgaaagaatacaagcgctccactcttaatgaactggtggactacattacaataagcagaggctgtttgacagagcagacttaccctgaagtagttagaatggtatcttgcaatatattcagaactctccctcctagtgacagcaatgaatttgatccagaagaagatgaacctacccttgaggcatcgtggccacacttacagcttgtatatgaatttttcatacgatttttggaaagccaagaattccaacccagcattgccaaaaaatatatagatcagaaatttgtattacagcttctggagctatttgacagcgaagaccctcgggaacgggactacttaaaaacagtcttacacagaatttatggcaagtttcttggtcttagagcatttatccgaaaacagattaacaatatttttctaaggtttgtttatgaaacagaacacttcaatggtgtagctgaactgctggaaatattaggaagtattatcaatggctttgctttacctcttaaggcagaacacaaacagtttctggtgaaagtattgatccctttacacactgtcaggagcttatcactcttccatgcacagctggcatattgtatagtacagtttctggagaaagatccttcactcacagaaccagttattagggggttaatgaaattttggcctaaaacatgtagtcaaaaagaggtcatgttccttggggaactggaagaaatattggatgtgattgaaccttcacaatttgttaaaatccaagaacctttgtttaaacaaatcgccaagtgtgtatctagcccccattttcaggtggcagaaagagcactctattattggaataatgaatacatcatgagtttgatagaagaaaactctaacgtcatccttcccatcatgttttccagcctttataggatttcaaaagaacattggaatccggctattgtggcgttggtgtacaatgtgttgaaggcatttatggaaatgaacagcaccatgtttgacgagctgacagccacatacaagtcagatcgtcagcgtgagaaaaagaaagaaaaggagcgtgaagaattgtggaaaaaattggaggatctggagttaaagagaggtcttagacgtgatggaataattccaacttaacaaaaacaatgacaacaacattactaacctgtggagtcacacgtttatgtagtagaagatggagcaacagttttctgtattgtgcaactttacagtagatttcacctttgtttcattattacagcagcactgtatatacctgtctctaagtaaaggaaaaaacaaaataaggacttcaatccaaagtttggacagtagatggacttctcagaactttgcaaacataatcattgttctcaccctcttttaaaaaaaaaaatcggtcttcaaagatctgttgatgaaattgctatgttaaaattccattatcgggagttccttatttatcactagcagagagtatgatacaattttcaaatgtgaacaatcttaaatttagcttgtctttctgctaagctgttaaatgtatttatagtaaaggaagaaaaaaagactgtcatttccttataagtttgtgtaacatcctcctctggataacttgactgtaatttaacatctttttcttttgcacatcttcctgagttgaatgtccacgtggaatggggtcatgaattataaaagtccctgataaaagttttgtttactggggtgaacatctttccagtaaccaggtagtcctggtactcctttagttttaaaattaggagttaagagagaagaggtgataaacatagtagggaagggaatatcggattcatgcatcagtttatggtgaatccaaatcaatgtcttgaatcctttgaaaacaggcactgggacatcacaggcttcagtacctgaccagtattagttgcatatatcattgaacacacataccagagatgttttagaaatgtgagaaaaacatccttttggaccatttgaaataagaaagacaaacactaaacaatacaaccatgaaattgatcaccgggattgcaaatctaattgggaaaagagttgagcaaacagcttggactgtttggagttgttgccttactttttaatatgtatttataaagtattccagcaaaagaggatgtagcctctgggaaaaaacaaacatgttacagtgttttttgtagattctcgttctatatctcatcacagcgccagccctgtttttagccggaaaggattcaggataaacattattatgcattctgaattggatgcatattcctaactactgtatttgttaccaaaagtggttctacaaatgctactgaaaaaaatctggaaattcctaatgtcctgagtattaataataaagtttaaaaatgcttttatatcaaaggtgcatcgtgaccaaattgtttaagaaaaaaaaacaaaaaaaacaaaatctagggctgtattttatatatatatatatatatatatatatatatatatcttattggctctctgctttgtatttaaatgaagaatcttacatcttgggtaggtaaactgctgataaaatttgtgtacagtatgtacttacctaatgcagttgcattattacgtactgaaagatatgtgtttggaggtttatttccaggatgcatttgcttgttttggtcatggcagcagtgagttggtaatcctaaaccatcacttccagcagtattcatggtatagagctgatctgtgttcatatgttgaattgtgatagtagcaaacatgaacatatgaactattgttgctcttaatagaaatacaatataaatatgggcttgtatattttcttccttacatttaaatataaagtagaatacgcagttttattattttcaagaaaaagaaagagaagctgctgacctttctcccccataaagtttttcaggatgatcaggtcacagtgtgtacgtaagagtcagctaattatggatattgtcatctcggtaactttgtaaaaaaacaaacaaaactggcattgttaattccaaaaagaaaaaaaaaagcagtaaaaaaaaaaagtcatatgcaacaccagacgcaacatggtttaatggaattaatagtttttttttttttttttttaaagaacattgatggggattcactgtaaagttggcagaggctgccaaagacgaaacaactgactttaaaaatgctggaacaatgtgataaaaaataaatttgtaacaaatctt

SEQ ID NO: 171215 - DNA, 2164 bp, Homo sapiens
  Payload ID: 13685
  Gene Symbol: PPP2R5E
  Gene Name: protein phosphatase 2, regulatory subunit B', epsilon isoform
  Uniprot ID: Q16537
  ENST ID: ENST00000555899
  CDS Start-End: 528-1916
attgactgggacccaccgcgggtagcgaaaggtggctctggcagcggcggctccagctcctgcggctcctcctccttattctgtccccttctcttgctgccgctgcagatccagtcttcctccctcccttccccccctccccacgtcgtcgccgccgccgccgggtccggggcaacgagctgaggcgccgcccgccaggaatgtgagcgaggagccaccggcggagccgcaacggggtcggtgccgatttgatgggacgggcccgcgggggaggatcgtgaggccgccgccgccaccggaacgctgaggttcgggtccggccgtgaggcctagaggctccgccgccgcggaaccggagggaccccgtaccggacagccgtcgccccaggctccccgcagctgcccggacctccccctgcacgtcccggtcccgccgcccgcccccgctgcggccacctcgcccgtctcccgcccctccaagccacagatcatctttggattcttccccagaagcttcaagtagggatatgtcctcagcaccaactactcctccatcagtggataaagtagacggattttctcggaagtccgtcagaaaagccagacagaagaggtcgcaaagttcctcacagtttaggtctcaaggcaagcctattgagttaacacctctgccgctgctaaaagacgttccatcctcagagcagcctgaactgttcctaaagaaacttcagcagtgctgtgtcatttttgacttcatggacacgctatctgatcttaaaatgaaagaatacaagcgctccactcttaatgaactggtggactacattacaataagcagaggctgtttgacagagcagacttaccctgaagtagttagaatggtatcttgcaatatattcagaactctccctcctagtgacagcaatgaatttgatccagaagaagatgaacctacccttgaggcatcgtggccacacttacagcttgtatatgaatttttcatacgatttttggaaagccaagaattccaacccagcattgccaaaaaatatatagatcagaaatttgtattacagcttctggagctatttgacagcgaagaccctcgggaacgggactacttaaaaacagtcttacacagaatttatggcaagtttcttggtcttagagcatttatccgaaaacagattaacaatatttttctaaggtttgtttatgaaacagaacacttcaatggtgtagctgaactgctggaaatattaggaagtattatcaatggctttgctttacctcttaaggcagaacacaaacagtttctggtgaaagtattgatccctttacacactgtcaggagcttatcactcttccatgcacagctggcatattgtatagtacagtttctggagaaagatccttcactcacagaaccagttattagggggttaatgaaattttggcctaaaacatgtagtcaaaaagaggtcatgttccttggggaactggaagaaatattggatgtgattgaaccttcacaatttgttaaaatccaagaacctttgtttaaacaaatcgccaagtgtgtatctagcccccattttcaggtggcagaaagagcactctattattggaataatgaatacatcatgagtttgatagaagaaaactctaacgtcatccttcccatcatgttttccagcctttataggatttcaaaagaacattggaatccggctattgtggcgttggtgtacaatgtgttgaaggcatttatggaaatgaacagcaccatgtttgacgagctgacagccacatacaatgagaaaaagaaagaaaaggagcgtgaagaattgtggaaaaaattggaggatctggagttaaagagaggtcttagacgtgatggaataattccaacttaacaaaaacaatgacaacaacattactaacctgtggagtcacacgtttatgtagtagaagatggagcaacagttttctgtattgtgcaactttacagtagatttcacctttgtttcattattacagcagcactgtatatacctgtctctaagtaaaggaaaaaacaaaataaggacttcaatccaaagtttggacagtagatggacttctcagaactttgcaaacataatcattgttctcaccctctttt

SEQ ID NO: 171216 - DNA, 4092 bp, Homo sapiens
  Payload ID: 13686
  Gene Symbol: PPP2R2C
  Gene Name: protein phosphatase 2, regulatory subunit B, gamma
  Uniprot ID: Q9Y2T4
  ENST ID: ENST00000335585
  CDS Start-End: 25-1368
acatgcaaaaagtggggcctggagatggggctgtcttttttctccaaacacttgcccatccaggaaggccagccctgggcattgaagactccagctgacatcatctctaccgttgagttcaaccacacgggagagctgctggccacaggtgacaagggcggccgggtcgtcatcttccagcgggaaccagagagtaaaaatgcgccccacagccagggcgaatacgacgtgtacagcactttccagagccacgagccggagtttgactatctcaagagcctggagatagaggagaagatcaacaagatcaagtggctcccacagcagaacgccgcccactcactcctgtccaccaacgataaaactatcaaattatggaagattaccgaacgagataaaaggcccgaaggatacaacctgaaggatgaagaggggaaacttaaggacctgtccacggtgacgtcactgcaggtgccagtgctgaagcccatggatctgatggtggaggtgagccctcggaggatctttgccaatggccacacctaccacatcaactccatctccgtcaacagtgactgcgagacctacatgtcggcggatgacctgcgcatcaacctctggcacctggccatcaccgacaggagcttcaacatcgtggacatcaagccggccaacatggaggaccttacggaggtgatcacagcatctgagttccatccgcaccactgcaacctcttcgtctacagcagcagcaagggctccctgcggctctgcgacatgcgggcagctgccctgtgtgacaagcattccaagctctttgaagagcctgaggaccccagtaaccgctcattcttctcggaaatcatctcctccgtgtccgacgtgaagttcagccacagcggccgctacatgctcacccgggactaccttacagtcaaggtctgggacctgaacatggaggcaagacccatagagacctaccaggtccatgactaccttcggagcaagctctgttccctgtacgagaacgactgcattttcgacaagtttgaatgtgcctggaacgggagcgacagcgtcatcatgaccggggcctacaacaacttcttccgcatgttcgatcggaacaccaagcgggacgtgaccctggaggcctcgagggaaagcagcaagccccgggctgtgctcaagccacggcgcgtgtgcgtggggggcaagcgccggcgtgatgacatcagtgtggacagcttggacttcaccaagaagatcctgcacacggcctggcacccggctgagaacatcattgccatcgccgccaccaacaacctgtacatcttccaggacaaggtaaactctgacatgcactaggtatgtgcagttcccggcccctgccacccagcctcatgcaagtcatccccgacatgaccttcacgaccgcaatgcaaggaggggaagaaagtcacagcactgatgaggacagctgcagaggtggcagtgtgtggacacaggaagtttgggccccctccctgccccagctttcctaggccagaattgtgtttggcagtaattgtctgtttaaaaaaataaaaaggaaaggaagcgttcaccgccacaaatcataaaatggacatgactgtggagtcttacagttcagggttctttcattcacgtcccttcctgtctcggtctgcggtctttaccacatcaataggactttttatgcgtccgggttaatttttcactccagtgcgtcctgttgcagggaccggagctgatgggagctgcttctcccccatgcctcactggtcccagatcagggctccagggacagatgatgagtctcaaacgagccagccaggggttcttttggttataaatggggcaattcgccctgtctcagagctgatgacctcaccgttgttttttggatggtgaattcatgctgagaatttgcagatgcaagctcctctcctaggtcttctgaatgtcttgaaacatcccaggtcccaggtctggtgcggtttcccgagaggagcggagtggggtttgtcttctgtgtgcctgtgtcctcatctgattcacctgccatttgctgagcctctgctgtgtaccaggcgtggtgctcagccctagaggcagttgacttaccctctgcagccctccctgccgcctcacccttcagcattcactgggcaccttcccggagcggacactgactcccatgcacgattttttggaatcttcctcctgactgtgaggtgggtgttcattcatttcctccataaacaccaacttctcgaagcgtgccaggctctgggctggatgctggggataagcgggaacccttaggatcccctctgtccacgagaagaagctgaggctctgagcggatgcacaggtcacccatggcaggtgccgtgcagtggtgtcaggaacccgtccgggtcttcacacaaggttctctccagtccatctcgtgggcggctcatgttagagcgacattcaaatggaaggtttggaaaggaatgcctctgtcttgtgaagtaggacatggcagacttggcgacgacaagggtccaggagaactgagacgcaggatggaagacagagaagaccccccggagctcctcgctctgcttggtggcttcaggagtgtggccctccccaggactccacttcatcctgggcttgcaccctccttgagccaatgcactgaactgcctttgaaaggaaattgcatgttctgaccattttaggatacctttactttaaggaccacacagtcccagaggacacatccctcgggaactctgcccctctgacaatgagggccacagagaaggtggtgtttccatggtagatgctcctgttctggtgataccaaacctgcccacccctctgagtcgtctttgctcatggacttgcagcagagccacgtagtttggcattttgattcagaaagtggggagcagagacccagccaaatccaaactttttttttggttttgttttgttttgttttttacaagatataacataacccaggaaacagacccagctgaggttattctcagtggattacagtatacttttgtgtgtgtaaaagcacaaagtgcatgtgtactcacttctggccatataacatttacacagggaaatggatcattgatttttttttaatcaacgtgaatgaagaatgtttgtttatatatcactataaaatccagttgacctggacagtattatatgtacatatctattctaattaaatttaacaatcaaaggattggattacttttttcccccttgtaaagaggttcgagaatgtggtcaattgtatagatagcgtgttaaagccaaaacccagctctgagggccttacccattacttggatatttgctacgatccatctccctttgtgagtcaaatgttaagagaagaaacttgtatttgcagctagaggttactgtcacatcatagatttaacatttaccatcttcaaagtacaaatcttacatgtccttcaaaaggaggtcttaatacagttcctagttccttacttctgttttaaactttgggtaccaaaccaaaaagaagaaaaaagaaaggaaaagatcttctttgaagaaaagtatgtctctggatccctggaaaataatgatgtccaaagcaaattgtgaagatcaaatgtgtgttaagaaaaggtgtcgaggggagggacaaaaccagaaacggtggaaggaccagtgtaatagtcacagacttgcatcctggctctgcttacatttcctggtactctcgaatgtacgggcgttcacatagtcattgtgaagttgttggggtttttttggttttgtttttaatttagctcttctctgaggacgaagctgttggtggtggtggtggtgggggtggtggtgtgggatacatggtggtcaagttgtcagccctgatcagtttggactctgtaactcataggtgcattctttttttctttggtgtctcacaaattacccaattgttgaataaaactataaatatgttaataccagctttttccaataaaataacaaatgttacatcaaaaacga

SEQ ID NO: 171217 - DNA, 1807 bp, Homo sapiens
  Payload ID: 13686
  Gene Symbol: PPP2R2C
  Gene Name: protein phosphatase 2, regulatory subunit B, gamma
  Uniprot ID: Q9Y2T4
  ENST ID: ENST00000382599
  CDS Start-End: 218-1561
gcggccgccgcccgcccaccgcgcgctcgcttgaccgcggcgcccgcccccggccgcccccgcccgtccccctgccgcgatgccctcccttcggggccccggcggcccgcgcccctgctaggctgcggcggcatggcccgcgcgcccggcgcgacctctgcggattgcatcggtgtgtggcggcggggcatgcccagagcaccgggcacggccttcaatgggcgaggacacggacacgcggaaaattaaccacagcttcctgcgggaccacagctatgtgactgaagctgacatcatctctaccgttgagttcaaccacacgggagagctgctggccacaggtgacaagggcggccgggtcgtcatcttccagcgggaaccagagagtaaaaatgcgccccacagccagggcgaatacgacgtgtacagcactttccagagccacgagccggagtttgactatctcaagagcctggagatagaggagaagatcaacaagatcaagtggctcccacagcagaacgccgcccactcactcctgtccaccaacgataaaactatcaaattatggaagattaccgaacgagataaaaggcccgaaggatacaacctgaaggatgaagaggggaaacttaaggacctgtccacggtgacgtcactgcaggtgccagtgctgaagcccatggatctgatggtggaggtgagccctcggaggatctttgccaatggccacacctaccacatcaactccatctccgtcaacagtgactgcgagacctacatgtcggcggatgacctgcgcatcaacctctggcacctggccatcaccgacaggagcttcaacatcgtggacatcaagccggccaacatggaggaccttacggaggtgatcacagcatctgagttccatccgcaccactgcaacctcttcgtctacagcagcagcaagggctccctgcggctctgcgacatgcgggcagctgccctgtgtgacaagcattccaagctctttgaagagcctgaggaccccagtaaccgctcattcttctcggaaatcatctcctccgtgtccgacgtgaagttcagccacagcggccgctacatgctcacccgggactaccttacagtcaaggtctgggacctgaacatggaggcaagacccatagagacctaccaggtccatgactaccttcggagcaagctctgttccctgtacgagaacgactgcattttcgacaagtttgaatgtgcctggaacgggagcgacagcgtcatcatgaccggggcctacaacaacttcttccgcatgttcgatcggaacaccaagcgggacgtgaccctggaggcctcgagggaaagcagcaagccccgggctgtgctcaagccacggcgcgtgtgcgtggggggcaagcgccggcgtgatgacatcagtgtggacagcttggacttcaccaagaagatcctgcacacggcctggcacccggctgagaacatcattgccatcgccgccaccaacaacctgtacatcttccaggacaaggtaaactctgacatgcactaggtatgtgcagttcccggcccctgccacccagcctcatgcaagtcatccccgacatgaccttcacgaccgcaatgcaaggaggggaagaaagtcacagcactgatgaggacagctgcagaggtggcagtgtgtggacacaggaagtttgggccccctccctgccccagctttcctaggccagaattgtgtttggcagtaattgtctgtttaaaaaaataaaaaggaaaggaagcgttcaccgccaca

SEQ ID NO: 171218 - DNA, 1832 bp, Homo sapiens
  Payload ID: 13686
  Gene Symbol: PPP2R2C
  Gene Name: protein phosphatase 2, regulatory subunit B, gamma
  Uniprot ID: Q9Y2T4
  ENST ID: ENST00000515571
  CDS Start-End: 284-1576
atgtgttttgggggaaacagagagaaaggtgtggcctctccacttctgtggacaccccaaataggaagaagggtgcacacaaagcaccgcttcctccacgaagccctcctcaggcacatcgaggagaaccagctgcccaagctcttggctgctgcccttctgaggcctgcctgatttgggccacatagatctggttttggccattgactggcaacatggcagtagccaactgcagagccaccagggagcagcctcattctgattgagtataacgaagacgctgatgggaaagagagacacggctgacatcatctctaccgttgagttcaaccacacgggagagctgctggccacaggtgacaagggcggccgggtcgtcatcttccagcgggaaccagagagtaaaaatgcgccccacagccagggcgaatacgacgtgtacagcactttccagagccacgagccggagtttgactatctcaagagcctggagatagaggagaagatcaacaagatcaagtggctcccacagcagaacgccgcccactcactcctgtccaccaacgataaaactatcaaattatggaagattaccgaacgagataaaaggcccgaaggatacaacctgaaggatgaagaggggaaacttaaggacctgtccacggtgacgtcactgcaggtgccagtgctgaagcccatggatctgatggtggaggtgagccctcggaggatctttgccaatggccacacctaccacatcaactccatctccgtcaacagtgactgcgagacctacatgtcggcggatgacctgcgcatcaacctctggcacctggccatcaccgacaggagcttcaacatcgtggacatcaagccggccaacatggaggaccttacggaggtgatcacagcatctgagttccatccgcaccactgcaacctcttcgtctacagcagcagcaagggctccctgcggctctgcgacatgcgggcagctgccctgtgtgacaagcattccaagctctttgaagagcctgaggaccccagtaaccgctcattcttctcggaaatcatctcctccgtgtccgacgtgaagttcagccacagcggccgctacatgctcacccgggactaccttacagtcaaggtctgggacctgaacatggaggcaagacccatagagacctaccaggtccatgactaccttcggagcaagctctgttccctgtacgagaacgactgcattttcgacaagtttgaatgtgcctggaacgggagcgacagcgtcatcatgaccggggcctacaacaacttcttccgcatgttcgatcggaacaccaagcgggacgtgaccctggaggcctcgagggaaagcagcaagccccgggctgtgctcaagccacggcgcgtgtgcgtggggggcaagcgccggcgtgatgacatcagtgtggacagcttggacttcaccaagaagatcctgcacacggcctggcacccggctgagaacatcattgccatcgccgccaccaacaacctgtacatcttccaggacaaggtaaactctgacatgcactaggtatgtgcagttcccggcccctgccacccagcctcatgcaagtcatccccgacatgaccttcacgaccgcaatgcaaggaggggaagaaagtcacagcactgatgaggacagctgcagaggtggcagtgtgtggacacaggaagtttgggccccctccctgccccagctttcctaggccagaattgtgtttggcagtaattgtctgtttaaaaaaataaaaaggaaaggaagcgttcaccgccacaaatcataaaa

SEQ ID NO: 171219 - DNA, 1780 bp, Homo sapiens
  Payload ID: 13686
  Gene Symbol: PPP2R2C
  Gene Name: protein phosphatase 2, regulatory subunit B, gamma
  Uniprot ID: Q9Y2T4
  ENST ID: ENST00000506140
  CDS Start-End: 100-1422
gtgccagctcaatggggccgccgacctcgaagtttccgaagaagtaaaatagaaagaagaccttttttgaaatgacctgtgttagtcacctctctcaggatgcgtgaggcggacacgttgaggccacctcagctgatggaagtttccgctgacatcatctctaccgttgagttcaaccacacgggagagctgctggccacaggtgacaagggcggccgggtcgtcatcttccagcgggaaccagagagtaaaaatgcgccccacagccagggcgaatacgacgtgtacagcactttccagagccacgagccggagtttgactatctcaagagcctggagatagaggagaagatcaacaagatcaagtggctcccacagcagaacgccgcccactcactcctgtccaccaacgataaaactatcaaattatggaagattaccgaacgagataaaaggcccgaaggatacaacctgaaggatgaagaggggaaacttaaggacctgtccacggtgacgtcactgcaggtgccagtgctgaagcccatggatctgatggtggaggtgagccctcggaggatctttgccaatggccacacctaccacatcaactccatctccgtcaacagtgactgcgagacctacatgtcggcggatgacctgcgcatcaacctctggcacctggccatcaccgacaggagcttcaacatcgtggacatcaagccggccaacatggaggaccttacggaggtgatcacagcatctgagttccatccgcaccactgcaacctcttcgtctacagcagcagcaagggctccctgcggctctgcgacatgcgggcagctgccctgtgtgacaagcattccaagctctttgaagagcctgaggaccccagtaaccgctcattcttctcggaaatcatctcctccgtgtccgacgtgaagttcagccacagcggccgctacatgctcacccgggactaccttacagtcaaggtctgggacctgaacatggaggcaagacccatagagacctaccaggtccatgactaccttcggagcaagctctgttccctgtacgagaacgactgcattttcgacaagtttgaatgtgcctggaacgggagcgacagcgtcatcatgaccggggcctacaacaacttcttccgcatgttcgatcggaacaccaagcgggacgtgaccctggaggcctcgagggaaagcagcaagccccgggctgtgctcaagccacggcgcgtgtgcgtggggggcaagcgccggcgtgatgacatcagtgtggacagcttggacttcaccaagaagatcctgcacacggcctggcacccggctgagaacatcattgccatcgccgccaccaacaacctgtacatcttccaggacaaggtaaactctgacatgcactaggtatgtgcagttcccggcccctgccacccagcctcatgcaagtcatccccgacatgaccttcacgaccgcaatgcaaggaggggaagaaagtcacagcactgatgaggacagctgcagaggtggcagtgtgtggacacaggaagtttgggccccctccctgccccagctttcctaggccagaattgtgtttggcagtaattgtctgtttaaaaaaataaaaaggaaaggaagcgttcaccgccacaaatcataaaatggacatgactgtggagtcttacagttcagggttctttcattcacgtcccttcctgtctcggtctgcggtctttaccacatcaataggactttttatgcgtc

SEQ ID NO: 171220 - DNA, 533 bp, Homo sapiens
  Payload ID: 13686
  Gene Symbol: PPP2R2C
  Gene Name: protein phosphatase 2, regulatory subunit B, gamma
  ENST ID: ENST00000509917
  CDS Start-End: 22-150
tgcaaaaagtggggcctggagatggggctgtcttttttctccaaacacttgcccatccaggaaggccagccctgggcattgaagactccagctgacatcatctctaccgttgagttcaaccacacgggagagctgctggccacagagtaaaaatgcgccccacagccagggcgaatacgacgtgtacagcactttccagagccacgagccggagtttgactatctcaagagcctggagatagaggagaagatcaacaagatcaagtggctcccacagcagaacgccgcccactcactcctgtccaccaacgataaaactatcaaattatggaagattaccgaacgagataaaaggcccgaaggatacaacctgaaggatgaagaggggaaacttaaggacctgtccacggtgacgtcactgcaggtgccagtgctgaagcccatggatctgatggtggaggtgagccctcggaggatctttgccaatggccacacctaccacatcaactccatctccgtcaacagtgactgcg

SEQ ID NO: 171221 - DNA, 1667 bp, Homo sapiens
  Payload ID: 13686
  Gene Symbol: PPP2R2C
  Gene Name: protein phosphatase 2, regulatory subunit B, gamma
  Uniprot ID: Q9Y2T4
  ENST ID: ENST00000507294
  CDS Start-End: 204-1526
atcattcaaaggattcctgcggtggtgcagagctgcggcaaagggccctcgcccgtggggttcactctcatcacccagaagcagggagaagggcctgcggctgcaggcctggctgccacaccggcctccagacaacacacagcagaagtaaaatagaaagaagaccttttttgaaatgacctgtgttagtcacctctctcaggatgcgtgaggcggacacgttgaggccacctcagctgatggaagtttccgctgacatcatctctaccgttgagttcaaccacacgggagagctgctggccacaggtgacaagggcggccgggtcgtcatcttccagcgggaaccagagagtaaaaatgcgccccacagccagggcgaatacgacgtgtacagcactttccagagccacgagccggagtttgactatctcaagagcctggagatagaggagaagatcaacaagatcaagtggctcccacagcagaacgccgcccactcactcctgtccaccaacgataaaactatcaaattatggaagattaccgaacgagataaaaggcccgaaggatacaacctgaaggatgaagaggggaaacttaaggacctgtccacggtgacgtcactgcaggtgccagtgctgaagcccatggatctgatggtggaggtgagccctcggaggatctttgccaatggccacacctaccacatcaactccatctccgtcaacagtgactgcgagacctacatgtcggcggatgacctgcgcatcaacctctggcacctggccatcaccgacaggagcttcaacatcgtggacatcaagccggccaacatggaggaccttacggaggtgatcacagcatctgagttccatccgcaccactgcaacctcttcgtctacagcagcagcaagggctccctgcggctctgcgacatgcgggcagctgccctgtgtgacaagcattccaagctctttgaagagcctgaggaccccagtaaccgctcattcttctcggaaatcatctcctccgtgtccgacgtgaagttcagccacagcggccgctacatgctcacccgggactaccttacagtcaaggtctgggacctgaacatggaggcaagacccatagagacctaccaggtccatgactaccttcggagcaagctctgttccctgtacgagaacgactgcattttcgacaagtttgaatgtgcctggaacgggagcgacagcgtcatcatgaccggggcctacaacaacttcttccgcatgttcgatcggaacaccaagcgggacgtgaccctggaggcctcgagggaaagcagcaagccccgggctgtgctcaagccacggcgcgtgtgcgtggggggcaagcgccggcgtgatgacatcagtgtggacagcttggacttcaccaagaagatcctgcacacggcctggcacccggctgagaacatcattgccatcgccgccaccaacaacctgtacatcttccaggacaaggtaaactctgacatgcactaggtatgtgcagttcccggcccctgccacccagcctcatgcaagtcatccccgacatgaccttcacgaccgcaatgcaaggaggggaagaaagtcacagcactgatgaggacagctgcagaggtggcagtgtgtggacacagg

SEQ ID NO: 171222 - DNA, 3845 bp, Homo sapiens
  Payload ID: 13687
  Gene Symbol: PPP2R5C
  Gene Name: protein phosphatase 2, regulatory subunit B', gamma
  Uniprot ID: Q13362
  ENST ID: ENST00000350249
  CDS Start-End: 141-1598
agcttcatgcctgctgacatcacgaaccagccagttccctccagctgcagagagcttcagtttgtctttttttttttaaactaaaatggaggctggtttcttgccttaaggagcccattgcctttcccgctgaagtctagatgttgacatgtaataaagcgggcagcaggatggtggtggatgcggccaactccaatgggcctttccagcccgtggtccttctccatattcgagatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccaggcacagaaagatccgaagaaggaccgtcctcttgcacgccgcaagtccgagctgcctcaggacccccacaccaagaaagccttggaagctcactgcagggccgatgagctggcctcccaggacggccgctagcctccggggcgccgcgtcggggccgggcccgccagttcttttccggattctgtagaaaatacatacttcctgtgccataccaatcagttacactcaaagctttcttggaccccgttccgtaggcaataacgtgcgtccgcctcagcgcgagattaggagttcaaacaatggtgacttcccagagcccgctggcagagccgcgggttgacgacggtgtcctcgcagtgtcgccgccaccccagcgtagtccaagtcagactatttcacaaagtcagagcgataggaaagcaccctgcccttcatcttcatgttctcccaaatggaacttaggatcttttaacataggtggttctgtgataacatcagtgttttccaaatcaaaggaacgctttaaaaaataggacctattttttaagactttacagcctttgaaatggtttccacgtgattgttacgccagcagttctcgttttgtttgtttttcaatctcagtgaaatggctctttgctttcgagttctcacgcaacgtactgggcaaatgacaatcctcagccgctggtattttctaaggggtctcttcactttgatgagtgacatgaacaccgtgtctccttctcttgtgtgtacctaaagccatatttccaagtctgtggtactccaggattccaggagtaagcctgtagaagagatttattttaaaagagattgctctgaaatttatcttaaaagagcttgctctgtctaccttgacagaaattggagttttaaaattatgtgttaatatttttatttgcagatttcgtttccgtcaacttaaacattgttgcccttcaacaaggctcttgaattaataaaattatagtctctaagaattccacattttatggaaagttagagcaaaatcattttgagttaagccagttcttagcctaatgcaaactgcagcgcctttaagcataaagtaacacaacagcattgcacggggccggcactgccgctgccttcactgaaggctgcagtgctgttctgagagcttggaggaggcaccagcgaggatgacgtttagtggagctctttctgttgaaaagagctcacgttatcaacaccttgtaaggaaaatacagtgtctgagttttcatcggtcttcacatgctgctatatattccacagagttccttgcatgtactgagcttttgttttagatggaatagcacaaggagaaaaatctttaaacttagtgctttgtctattctttatttctctcagggtggccagtattttgacttatttatcctgcttgaaagctacttgagatgtgtactgctattctaaacacgtgatctagtttctttcatctctggcataagattatataacttaatgttaagtgtcttgaggcataaaagacaaaatgtggcttattttaggatctgttttttcatcgaggtctcgggtatcctttcaaagatagtgagaagcagacactgctccttgtgcagctctggtacctcctgcccactgctgtcacttcaagccactggcaatgcttctgtcctcgtgtcttggaggaaaatcacctggggggaggggacttcttgtggtaagagcaagtgcaggtatgaaatgcgaagattgccccagctaaaagtggacaagtccgctttgtgagatgaatacttcctgagaaacttgacaagtatctctccattttaccattatgaaaactatcattaaaaaaaacagtttagatgccttctccttttgagggaaaaagggtgctttttattgtataaagcagcgtcttatgtattttgatataccattgtttgaacttccgtctttagctgatagattctcaaatatccttgattttggatgttcagtatgtttgtgagagaggtttctgggaagactctctttttgccctcgggaaaaagcaaaatatcaatgtttgggtgactgtgtaaagctcagtgtgtaagaacatctttttgtctaggttttctttctgctctttattgaagacaaacactcaccaaaaagaaaaataaaagttttcagagaaactaattttctttggcaagagtattacttaatattttggcctcctaaagtttccctagttagtactcggactcctgtgctaattgtcagcttacatatcattgtatagagactgtttattctgtaccaaactgatttcaaaagtactacattgaaaataaaccggtgactgtttttcttcat

SEQ ID NO: 171223 - DNA, 4045 bp, Homo sapiens
  Payload ID: 13687
  Gene Symbol: PPP2R5C
  Gene Name: protein phosphatase 2, regulatory subunit B', gamma
  Uniprot ID: Q13362
  ENST ID: ENST00000328724
  CDS Start-End: 10-1632
gctccagccatgccgaataaaaacaagaaggagaaagaatcaccaaaagcagggaagagtggaaaaagttcaaaagaaggacaagacacagtagaatcagagcaaatttccgtcaggaaaaacagccttgttgctgtcccgtctacagtatctgctaaaataaaagtaccagtctctcagcccatagtgaagaaagacaaacggcaaaattcttcaaggtttagcgcaagcaataatagagaacttcaaaaactaccatccttaaaagatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccaggcacagaaagatccgaagaaggaccgtcctcttgcacgccgcaagtccgagctgcctcaggacccccacaccaagaaagccttggaagctcactgcagggccgatgagctggcctcccaggacggccgctagcctccggggcgccgcgtcggggccgggcccgccagttcttttccggattctgtagaaaatacatacttcctgtgccataccaatcagttacactcaaagctttcttggaccccgttccgtaggcaataacgtgcgtccgcctcagcgcgagattaggagttcaaacaatggtgacttcccagagcccgctggcagagccgcgggttgacgacggtgtcctcgcagtgtcgccgccaccccagcgtagtccaagtcagactatttcacaaagtcagagcgataggaaagcaccctgcccttcatcttcatgttctcccaaatggaacttaggatcttttaacataggtggttctgtgataacatcagtgttttccaaatcaaaggaacgctttaaaaaataggacctattttttaagactttacagcctttgaaatggtttccacgtgattgttacgccagcagttctcgttttgtttgtttttcaatctcagtgaaatggctctttgctttcgagttctcacgcaacgtactgggcaaatgacaatcctcagccgctggtattttctaaggggtctcttcactttgatgagtgacatgaacaccgtgtctccttctcttgtgtgtacctaaagccatatttccaagtctgtggtactccaggattccaggagtaagcctgtagaagagatttattttaaaagagattgctctgaaatttatcttaaaagagcttgctctgtctaccttgacagaaattggagttttaaaattatgtgttaatatttttatttgcagatttcgtttccgtcaacttaaacattgttgcccttcaacaaggctcttgaattaataaaattatagtctctaagaattccacattttatggaaagttagagcaaaatcattttgagttaagccagttcttagcctaatgcaaactgcagcgcctttaagcataaagtaacacaacagcattgcacggggccggcactgccgctgccttcactgaaggctgcagtgctgttctgagagcttggaggaggcaccagcgaggatgacgtttagtggagctctttctgttgaaaagagctcacgttatcaacaccttgtaaggaaaatacagtgtctgagttttcatcggtcttcacatgctgctatatattccacagagttccttgcatgtactgagcttttgttttagatggaatagcacaaggagaaaaatctttaaacttagtgctttgtctattctttatttctctcagggtggccagtattttgacttatttatcctgcttgaaagctacttgagatgtgtactgctattctaaacacgtgatctagtttctttcatctctggcataagattatataacttaatgttaagtgtcttgaggcataaaagacaaaatgtggcttattttaggatctgttttttcatcgaggtctcgggtatcctttcaaagatagtgagaagcagacactgctccttgtgcagctctggtacctcctgcccactgctgtcacttcaagccactggcaatgcttctgtcctcgtgtcttggaggaaaatcacctggggggaggggacttcttgtggtaagagcaagtgcaggtatgaaatgcgaagattgccccagctaaaagtggacaagtccgctttgtgagatgaatacttcctgagaaacttgacaagtatctctccattttaccattatgaaaactatcattaaaaaaaacagtttagatgccttctccttttgagggaaaaagggtgctttttattgtataaagcagcgtcttatgtattttgatataccattgtttgaacttccgtctttagctgatagattctcaaatatccttgattttggatgttcagtatgtttgtgagagaggtttctgggaagactctctttttgccctcgggaaaaagcaaaatatcaatgtttgggtgactgtgtaaagctcagtgtgtaagaacatctttttgtctaggttttctttctgctctttattgaagacaaacactcaccaaaaagaaaaataaaagttttcagagaaactaattttctttggcaagagtattacttaatattttggcctcctaaagtttccctagttagtactcggactcctgtgctaattgtcagcttacatatcattgtatagagactgtttattctgtaccaaactgatttcaaaagtactacattgaaaataaaccggtgactgtttttcttcataaagttctgcgtttggcatcttcactctttccaaaatgtatctgtacatcagaaatgtcactattccaagtgtctttttagtgtggctttagtatggcttccttttaatattgtacatacattgtatctttgttttatggtaataagtaataaaaatgtagacttc

SEQ ID NO: 171224 - DNA, 4328 bp, Homo sapiens
  Payload ID: 13687
  Gene Symbol: PPP2R5C
  Gene Name: protein phosphatase 2, regulatory subunit B', gamma
  Uniprot ID: Q13362
  ENST ID: ENST00000334743
  CDS Start-End: 49-1623
ctggtttcttgccttaaggagcccattgcctttcccgctgaagtctagatgttgacatgtaataaagcgggcagcaggatggtggtggatgcggccaactccaatgggcctttccagcccgtggtccttctccatattcgagatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccagtacacagtgtatagtcaagccagcaccatgagcattccggttgcaatggagacagatgggcctttatttgaagatgtgcagatgctgagaaagacagtgaaggacgaggctcatcaggcacagaaagatccgaagaaggaccgtcctcttgcacgccgcaagtccgagctgcctcaggacccccacaccaagaaagccttggaagctcactgcagggccgatgagctggcctcccaggacggccgctagcctccggggcgccgcgtcggggccgggcccgccagttcttttccggattctgtagaaaatacatacttcctgtgccataccaatcagttacactcaaagctttcttggaccccgttccgtaggcaataacgtgcgtccgcctcagcgcgagattaggagttcaaacaatggtgacttcccagagcccgctggcagagccgcgggttgacgacggtgtcctcgcagtgtcgccgccaccccagcgtagtccaagtcagactatttcacaaagtcagagcgataggaaagcaccctgcccttcatcttcatgttctcccaaatggaacttaggatcttttaacataggtggttctgtgataacatcagtgttttccaaatcaaaggaacgctttaaaaaataggacctattttttaagactttacagcctttgaaatggtttccacgtgattgttacgccagcagttctcgttttgtttgtttttcaatctcagtgaaatggctctttgctttcgagttctcacgcaacgtactgggcaaatgacaatcctcagccgctggtattttctaaggggtctcttcactttgatgagtgacatgaacaccgtgtctccttctcttgtgtgtacctaaagccatatttccaagtctgtggtactccaggattccaggagtaagcctgtagaagagatttattttaaaagagattgctctgaaatttatcttaaaagagcttgctctgtctaccttgacagaaattggagttttaaaattatgtgttaatatttttatttgcagatttcgtttccgtcaacttaaacattgttgcccttcaacaaggctcttgaattaataaaattatagtctctaagaattccacattttatggaaagttagagcaaaatcattttgagttaagccagttcttagcctaatgcaaactgcagcgcctttaagcataaagtaacacaacagcattgcacggggccggcactgccgctgccttcactgaaggctgcagtgctgttctgagagcttggaggaggcaccagcgaggatgacgtttagtggagctctttctgttgaaaagagctcacgttatcaacaccttgtaaggaaaatacagtgtctgagttttcatcggtcttcacatgctgctatatattccacagagttccttgcatgtactgagcttttgttttagatggaatagcacaaggagaaaaatctttaaacttagtgctttgtctattctttatttctctcagggtggccagtattttgacttatttatcctgcttgaaagctacttgagatgtgtactgctattctaaacacgtgatctagtttctttcatctctggcataagattatataacttaatgttaagtgtcttgaggcataaaagacaaaatgtggcttattttaggatctgttttttcatcgaggtctcgggtatcctttcaaagatagtgagaagcagacactgctccttgtgcagctctggtacctcctgcccactgctgtcacttcaagccactggcaatgcttctgtcctcgtgtcttggaggaaaatcacctggggggaggggacttcttgtggtaagagcaagtgcaggtatgaaatgcgaagattgccccagctaaaagtggacaagtccgctttgtgagatgaatacttcctgagaaacttgacaagtatctctccattttaccattatgaaaactatcattaaaaaaaacagtttagatgccttctccttttgagggaaaaagggtgctttttattgtataaagcagcgtcttatgtattttgatataccattgtttgaacttccgtctttagctgatagattctcaaatatccttgattttggatgttcagtatgtttgtgagagaggtttctgggaagactctctttttgccctcgggaaaaagcaaaatatcaatgtttgggtgactgtgtaaagctcagtgtgtaagaacatctttttgtctaggttttctttctgctctttattgaagacaaacactcaccaaaaagaaaaataaaagttttcagagaaactaattttctttggcaagagtattacttaatattttggcctcctaaagtttccctagttagtactcggactcctgtgctaattgtcagcttacatatcattgtatagagactgtttattctgtaccaaactgatttcaaaagtactacattgaaaataaaccggtgactgtttttcttcataaagttctgcgtttggcatcttcactctttccaaaatgtatctgtacatcagaaatgtcactattccaagtgtctttttagtgtggctttagtatggcttccttttaatattgtacatacattgtatctttgttttatggtaataagtaataaaaatgtagacttcatattttgtacaaaatgtcctatgtacagaataaaaaagttcatagaaacagcaaatataggtaagtggcacaattatttttctttagaaaatatctgtaactttatgcattagtgaaatgttaagtaccgacatattttttaacattttgtaattcaaaactttttgttttgacattgtttatgaagagaaacttcatacacttgccatttaatatgctcttttatctaattttcaaaaactctaaaaaacggtgtatcatatggactaaataaagaacatgtgaatttta

SEQ ID NO: 171225 - DNA, 1526 bp, Homo sapiens
  Payload ID: 13687
  Gene Symbol: PPP2R5C
  Gene Name: protein phosphatase 2, regulatory subunit B', gamma
  Uniprot ID: Q13362
  ENST ID: ENST00000445439
  CDS Start-End: 49-1398
ctggtttcttgccttaaggagcccattgcctttcccgctgaagtctagatgttgacatgtaataaagcgggcagcaggatggtggtggatgcggccaactccaatgggcctttccagcccgtggtccttctccatattcgagatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccaggtactaaaaaagagaataacatgaaaacgcccagggttacttgaatgtttttataagataggaatatatgtcttcaccatggggggggtctcgatttcactaacgttgtatatgaaaatgtctgcaataaaaagtacttttaaactttgtaa

SEQ ID NO: 171226 - DNA, 4481 bp, Homo sapiens
  Payload ID: 13687
  Gene Symbol: PPP2R5C
  Gene Name: protein phosphatase 2, regulatory subunit B', gamma
  Uniprot ID: Q13362
  ENST ID: ENST00000422945
  CDS Start-End: 97-1764
gcggccgcgggggcgcgacggccggggcgggggcgctgctgctgcgggggcaggcggcggcaggggcggcggcggcggcggcggcccgctccagccatgccgaataaaaacaagaaggagaaagaatcaccaaaagcagggaagagtggaaaaagttcaaaagaaggacaagacacagtagaatcagagggaacaagtcctgaagaaccctcaagccctaaagtaccacctccacttcttcctgagttgctggttcttatttttggtgggcttcaaggaagagatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccagtacacagtgtatagtcaagccagcaccatgagcattccggttgcaatggagacagatgggcctttatttgaagatgtgcagatgctgagaaagacagtgaaggacgaggctcatcaggcacagaaagatccgaagaaggaccgtcctcttgcacgccgcaagtccgagctgcctcaggacccccacaccaagaaagccttggaagctcactgcagggccgatgagctggcctcccaggacggccgctagcctccggggcgccgcgtcggggccgggcccgccagttcttttccggattctgtagaaaatacatacttcctgtgccataccaatcagttacactcaaagctttcttggaccccgttccgtaggcaataacgtgcgtccgcctcagcgcgagattaggagttcaaacaatggtgacttcccagagcccgctggcagagccgcgggttgacgacggtgtcctcgcagtgtcgccgccaccccagcgtagtccaagtcagactatttcacaaagtcagagcgataggaaagcaccctgcccttcatcttcatgttctcccaaatggaacttaggatcttttaacataggtggttctgtgataacatcagtgttttccaaatcaaaggaacgctttaaaaaataggacctattttttaagactttacagcctttgaaatggtttccacgtgattgttacgccagcagttctcgttttgtttgtttttcaatctcagtgaaatggctctttgctttcgagttctcacgcaacgtactgggcaaatgacaatcctcagccgctggtattttctaaggggtctcttcactttgatgagtgacatgaacaccgtgtctccttctcttgtgtgtacctaaagccatatttccaagtctgtggtactccaggattccaggagtaagcctgtagaagagatttattttaaaagagattgctctgaaatttatcttaaaagagcttgctctgtctaccttgacagaaattggagttttaaaattatgtgttaatatttttatttgcagatttcgtttccgtcaacttaaacattgttgcccttcaacaaggctcttgaattaataaaattatagtctctaagaattccacattttatggaaagttagagcaaaatcattttgagttaagccagttcttagcctaatgcaaactgcagcgcctttaagcataaagtaacacaacagcattgcacggggccggcactgccgctgccttcactgaaggctgcagtgctgttctgagagcttggaggaggcaccagcgaggatgacgtttagtggagctctttctgttgaaaagagctcacgttatcaacaccttgtaaggaaaatacagtgtctgagttttcatcggtcttcacatgctgctatatattccacagagttccttgcatgtactgagcttttgttttagatggaatagcacaaggagaaaaatctttaaacttagtgctttgtctattctttatttctctcagggtggccagtattttgacttatttatcctgcttgaaagctacttgagatgtgtactgctattctaaacacgtgatctagtttctttcatctctggcataagattatataacttaatgttaagtgtcttgaggcataaaagacaaaatgtggcttattttaggatctgttttttcatcgaggtctcgggtatcctttcaaagatagtgagaagcagacactgctccttgtgcagctctggtacctcctgcccactgctgtcacttcaagccactggcaatgcttctgtcctcgtgtcttggaggaaaatcacctggggggaggggacttcttgtggtaagagcaagtgcaggtatgaaatgcgaagattgccccagctaaaagtggacaagtccgctttgtgagatgaatacttcctgagaaacttgacaagtatctctccattttaccattatgaaaactatcattaaaaaaaacagtttagatgccttctccttttgagggaaaaagggtgctttttattgtataaagcagcgtcttatgtattttgatataccattgtttgaacttccgtctttagctgatagattctcaaatatccttgattttggatgttcagtatgtttgtgagagaggtttctgggaagactctctttttgccctcgggaaaaagcaaaatatcaatgtttgggtgactgtgtaaagctcagtgtgtaagaacatctttttgtctaggttttctttctgctctttattgaagacaaacactcaccaaaaagaaaaataaaagttttcagagaaactaattttctttggcaagagtattacttaatattttggcctcctaaagtttccctagttagtactcggactcctgtgctaattgtcagcttacatatcattgtatagagactgtttattctgtaccaaactgatttcaaaagtactacattgaaaataaaccggtgactgtttttcttcataaagttctgcgtttggcatcttcactctttccaaaatgtatctgtacatcagaaatgtcactattccaagtgtctttttagtgtggctttagtatggcttccttttaatattgtacatacattgtatctttgttttatggtaataagtaataaaaatgtagacttcatattttgtacaaaatgtcctatgtacagaataaaaaagttcatagaaacagcaaatataggtaagtggcacaattatttttctttagaaaatatctgtaactttatgcattagtgaaatgttaagtaccgacatattttttaacattttgtaattcaaaactttttgttttgacattgtttatgaagagaaacttcatacacttgccatttaatatgctcttttatctaattttcaaaaactctaaaaaacggtgtatcatatggactaaataaagaacatgtgaattttattgctcatcatg

SEQ ID NO: 171227 - DNA, 800 bp, Homo sapiens
  Payload ID: 13687
  Gene Symbol: PPP2R5C
  Gene Name: protein phosphatase 2, regulatory subunit B', gamma
  ENST ID: ENST00000554442
  CDS Start-End: 33-407
ggcggcggcggcggcggcggcccgctccagccatgccgaataaaaacaagaaggagaaagaatcaccaaaagcagggaagagtggaaaaagttcaaaagaaggacaagacacagtagaatcagagcaaatttccgtcaggaaaaacagccttgttgctgtcccgtctacagtatctgctaaaataaaagtaccagtctctcagcccatagtgaagaaagacaaacggcaaaattcttcaaggtttagcgcaagcaataatagagaacttcaaaaactaccatccttaaaagattgcaaatgcacaagattcgagacctatgtatacagagggccaacttttcatacgcacgggttctgcgggccgactgtgggacttgaatatgcgtggatttggttgaggctgtgaagctgggcagggtttcagctgagctgaggttggaagtccctgaccttcagctgtggccgcctacggagcagcagggagagcaaacccatggagaaccccgcggcccccaaagcatggacggagctgccagccttctcccctgcccttcttcctctactcccgacctgccagccttctcccctgcccttctgcctctactcccgacctgccaaccttagcctaaaatcagagctgctagaatcacacacactgtcgtagctggttttgtattgtaaatgagtcattctgttattttggaaacttatgtctcatgccaggatctgcagatagttctttttcaaaatattgtttagacaaaataaatttctttaaatataatatctctactttaaa

SEQ ID NO: 171228 - DNA, 798 bp, Homo sapiens
  Payload ID: 13687
  Gene Symbol: PPP2R5C
  Gene Name: protein phosphatase 2, regulatory subunit B', gamma
  ENST ID: ENST00000557071
  CDS Start-End: 1-137
tatttgatgactgtacacaacagttcaaagcagagaaactaaaagagaagctaaaaatgaaagaacgggaagaagcatgggttaaaatagaaaatctagccaaagccaatccccaggcatgccgtggttctgcataggagctttgacgaactgtgatgctgggagcttagccctgccttgtcctcatgtctgtgttgacgccatctgtgacgcagtccccatgagtctcgtccacatgctctagtcgcatggcacatggtctcctaaacagaaaatacttcatgggtcaatacctcagagctggaaactctggcctcgtacttgcttctcattctcaggagaaaatatctaaattctgatcactgcttcccattacaacagcaacaaaaagtcaataattttgtggataatacagtctggttatttctgtagtgaaaatagttgggttttcaaagtttggttttccatctcagatctgcctgtggagaattggtttgcgggctttgtttttaagtacacagtgtatagtcaagccagcaccatgagcattccggttgcaatggagacagatgggcctttatttgaagatgtgcagatgctgagaaagacagtgaaggacgaggctcatcaggcacagaaagatccgaagaaggaccgtcctcttgcacgccgcaagtccgagctgcctcaggacccccacaccaagaaagccttggaagctcactgcagggccgatgagctggcctcccaggacggccgctagcctccggggcgccgcgtcggggccgggcccgccag

SEQ ID NO: 171229 - DNA, 384 bp, Homo sapiens
  Payload ID: 13687
  Gene Symbol: PPP2R5C
  Gene Name: protein phosphatase 2, regulatory subunit B', gamma
  ENST ID: ENST00000554137
  CDS Start-End: 1-216
tttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcaggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactg

SEQ ID NO: 171230 - DNA, 607 bp, Homo sapiens
  Payload ID: 13687
  Gene Symbol: PPP2R5C
  Gene Name: protein phosphatase 2, regulatory subunit B', gamma
  ENST ID: ENST00000555237
  CDS Start-End: 1-455
gcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccagtacacagtgtatagtcaagccagcaccatgagcattccggttgcaatggagacagatgggcctttatttgaagatgtgcagatgctgagaaagacagtgaaggacgaggctcatcagggtcttgctctgatacccaggctggaatgcagtggcacaatcttggctcactgcagcctcggcctcctggactcaagcaatccgcccacttcagcctcccaagcagcagtgactaccggcaccaccacactcagctgatttttgtatttttagcagagatggagttttaacatgttggctaggctggtctcaaactcctggtctcaagtgatctgcctgccttggcctcccaaagtgctgggattatgggcatgagccaccgcgcccagccaataaacttttcttaagtt

SEQ ID NO: 171231 - DNA, 759 bp, Homo sapiens
  Payload ID: 13687
  Gene Symbol: PPP2R5C
  Gene Name: protein phosphatase 2, regulatory subunit B', gamma
  ENST ID: ENST00000557621
  CDS Start-End: 110-759
cagttccctccagctgcagagagcttcagtttgtctttttttttttaaactaaaatggaggctggtttcttgccttaaggagcccattgcctttcccgctgaagtctagatgttgacatgtaataaagcgggcagcaggatggtggtggatgcggccaactccaatgggcctttccagcccgtggtccttctccatattcgagatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttatt

SEQ ID NO: 171232 - DNA, 2013 bp, Homo sapiens
  Payload ID: 13687
  Gene Symbol: PPP2R5C
  Gene Name: protein phosphatase 2, regulatory subunit B', gamma
  ENST ID: ENST00000557268
  CDS Start-End: 1-1662
aataaaaacaagaaggagaaagaatcaccaaaagcagggaagagtggaaaaagttcaaaagaaggacaagacacagtagaatcagagggaacaagtcctgaagaaccctcaagccctaaagtaccacctccacttcttcctgagttgctggttcttatttttggtgggcttcaaggaagagatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccagtacacagtgtatagtcaagccagcaccatgagcattccggttgcaatggagacagatgggcctttatttgaagatgtgcagatgctgagaaagacagtgaaggacgaggctcatcaggcacagaaagatccgaagaaggaccgtcctcttgcacgccgcaagtccgagctgcctcaggacccccacaccaagaaagccttggaagctcactgcagggccgatgagctggcctcccaggacggccgctagcctccggggcgccgcgtcggggccgggcccgccagttcttttccggattctgtagaaaatacatacttcctgtgccataccaatcagttacactcaaagctttcttggaccccgttccgtaggcaataacgtgcgtccgcctcagcgcgagattaggagttcaaacaatggtgacttcccagagcccgctggcagagccgcgggttgacgacggtgtcctcgcagtgtcgccgccaccccagcgtagtccaagtcagactatttcacaaagtcagagcgataggaaagcaccctgcccttcatcttcatgttctcccaaatggaacttaggatcttttaacataggtggtt

SEQ ID NO: 171233 - DNA, 1307 bp, Homo sapiens
  Payload ID: 13687
  Gene Symbol: PPP2R5C
  Gene Name: protein phosphatase 2, regulatory subunit B', gamma
  ENST ID: ENST00000557095
  CDS Start-End: 39-1193
gccttaaggagcccattgcctttcccgctgaagtctagatgttgacatgtaataaagcgggcagcaggatggtggtggatgcggccaactccaatgggcctttccagcccgtggtccttctccatattcgagatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagtaagaaagaactggctgccatctttttcagtcattttaaaatatggcacgttttactgctacttcagtaagaataaatatcagaattttaaatatcaattaaaaaacaagaaggtca

SEQ ID NO: 171234 - DNA, 645 bp, Homo sapiens
  Payload ID: 13687
  Gene Symbol: PPP2R5C
  Gene Name: protein phosphatase 2, regulatory subunit B', gamma
  ENST ID: ENST00000557716
  CDS Start-End: 1-462
aaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccagagagaagctaaaaatgaaagaacgggaagaagcatgggttaaaatagaaaatctagccaaagccaatccccaggtactaaaaaagagaataacatgaaaacgcccagggttacttgaatgtttttataagataggaatatatgtcttcaccatggggggggtctcgatttcactaacgttgtatatgaaaatgtctgcaataaaaagtacttttaaactttgtaa

SEQ ID NO: 171235 - DNA, 601 bp, Homo sapiens
  Payload ID: 13687
  Gene Symbol: PPP2R5C
  Gene Name: protein phosphatase 2, regulatory subunit B', gamma
  ENST ID: ENST00000556307
  CDS Start-End: 107-247
ttccctccagctgcagagagcttcagtttgtctttttttttttaaactaaaatggaggctggtttcttgccttaaggagcccattgcctttcccgctgaagtctagatgttgacatgtaataaagcgggcagcaggatggtggtggatgcggccaactccaatgggcctttccagcccgtggtccttctccatattcgaggcacagtgcccacttgttccgtggcacagccccagagctcctgttgaaggaacagactccaggactgactttccacttgattttcggagctcgcacatcccgagagattcatgttcaagctgcattttagacatagctggcaagagtattttcgtgatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcct

SEQ ID NO: 171236 - DNA, 579 bp, Homo sapiens
  Payload ID: 13687
  Gene Symbol: PPP2R5C
  Gene Name: protein phosphatase 2, regulatory subunit B', gamma
  ENST ID: ENST00000557534
  CDS Start-End: 1-210
caacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttatagatgcttgaaattttccaaaataaaatattgagaaaaaaattcgtgcaagaccaagttctctgccctcgaggcatttacagctgcaggccttgaggagtttctttggttcctgaagggctgcttgctcaccacgagcagtgtttgcacaaatagatgcgcttcttgttgcctggctccatggctcctcctagagcattgttttcttattcagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactg

SEQ ID NO: 171237 - DNA, 536 bp, Homo sapiens
  Payload ID: 13687
  Gene Symbol: PPP2R5C
  Gene Name: protein phosphatase 2, regulatory subunit B', gamma
  ENST ID: ENST00000557714
  CDS Start-End: 75-284
tttttttttttaaactaaaatggaggctggtttcttgccttaaggagcccattgcctttcccgctgaagtctagatgttgacatgtaataaagcgggcagcaggatggtggtggatgcggccaactccaatgggcctttccagcccgtggtccttctccatattcgagattgcaaatgcacaagattcgagacctatgtatacagagggccaacttttcatacgcacgggttctgcgggccgactgtgggacttgaatatgcgtggatttggttgaggctgtgaagctgggcagggtttcagctgagctgaggttggaagtccctgaccttcagctgtggccgcctacggagcagcagggagagcaaacccatggagaaccccgcggcccccaaagcatggacggagctgccagccttctcccctgcccttcttcctctactcccgacctgccagccttctcccctgcccttctgcctctactcccgacctgccaaccttagcctaaaatcagagctgctagaatcacacacactg

SEQ ID NO: 171238 - DNA, 492 bp, Homo sapiens
  Payload ID: 13687
  Gene Symbol: PPP2R5C
  Gene Name: protein phosphatase 2, regulatory subunit B', gamma
  ENST ID: ENST00000553890
  CDS Start-End: 1-439
tggaaaaagttcaaaagaaggacaagacacagtagaatcagagcaaatttccgtcaggaaaaacagccttgttgctgtcccgtctacagtatctgctaaaataaaagtaccagtctctcagcccatagtgaagaaagacaaacggcaaaattcttcaaggtttagcgcaagcaataatagagaacttcaaaaactaccatccttaaaagttgaggctgtgaagctgggcagggtttcagctgagctgaggttggaagtccctgaccttcagctgtggccgcctacggagcagcagggagagcaaacccatggagaaccccgcggcccccaaagcatggacggagctgccagccttctcccctgcccttcttcctctactcccgacctgccagccttctcccctgcccttctgcctctactcccgacctgccaaccttagcctaaaatcagagctgctagaatcacacacactgtcgtagctggttttgtatt

SEQ ID NO: 171239 - DNA, 564 bp, Homo sapiens
  Payload ID: 13687
  Gene Symbol: PPP2R5C
  Gene Name: protein phosphatase 2, regulatory subunit B', gamma
  ENST ID: ENST00000553554
  CDS Start-End: 1-90
gacaaacggcaaaattcttcaaggtttagcgcaagcaataatagagaacttcaaaaactaccatccttaaaaggtccccccacattgtagcacgtgccagaccctcgctcccgtcgaaggctgatgccatccttcagtgatgtgtggacggacacattccgcgtatcccccaatcagtggatggacgcgtgggttgcagagcacgccacacacattcagtcagtacacgagttaacagttgcgtgcttgtctgcctgtgtcatccattcgagcatctgccaaggacccaggaaacacacagtgtgtctcctgaaggaatgaaaagccctcctggcccctctgccctctttctccaccctctccattttcaccgagatggttgtggtgtcacctctcgtggggtggccaaaaccccagccagggccacctatcccttcacctccctccacctcggatttcctcttggaaaatgaggctcctgactcacttgacctactgcgtaggctcctaaaagggtgtcggcaagttggcaagttaaaaaaaaaaacaatcagcatgaaagca

SEQ ID NO: 171240 - DNA, 483 bp, Homo sapiens
  Payload ID: 13687
  Gene Symbol: PPP2R5C
  Gene Name: protein phosphatase 2, regulatory subunit B', gamma
  ENST ID: ENST00000561006
  CDS Start-End: 1-270
ttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaaagctaaaaatgaaagaacgggaagaagcatgggttaaaatagaaaatctagccaaagccaatccccaggtactaaaaaagagaataacatgaaaacgcccagggttacttgaatgtttttataagataggaatatatgtcttcaccatggggggggtctcgatttcactaacgttgtatatgaaaatgtctgcaataaaaagtacttttaaactttgta

SEQ ID NO: 171241 - DNA, 2013 bp, Homo sapiens
  Payload ID: 13687
  Gene Symbol: PPP2R5C
  Gene Name: protein phosphatase 2, regulatory subunit B', gamma
  ENST ID: ENST00000556260
  CDS Start-End: 25-231
cggcggcggcggcccgctccagccatgccgaataaaaacaagaaggagaaagaatcaccaaaagcagggaagagtggaaaaagttcaaaagaaggacaagacacagtagaatcagagtgctactgtctaagagctggagctacagagcttgaaattaccactgaaaacactgaaatgttgggcccttcactgcttcctcataaggataccagaggcaacctggcatattaagcttgacacttggcagatcactgtgtaaattgtttttcaggaatacaagttgggacacttctgttcatttgacctttgagttgacccttaaattttattattgttttttttcccctcagtcttcagctcactgcttcacttctagttccacccacttaccaaatatgattgactcatgcaggtgaattaaaccattattgcacactttttccctctcctctctctcagtattactcttaacttgaatattttaacctgaacaatttaaataggcttgacattcccatgctgctttcaagcctttttttttttttttttgagacagagtttcactcttgttccctggctggagtgcaatggcacagtctcggctcactgcaacctccacctcccgggttcaagtgatcctcttgcctcagcctcccaagtagctgggattacaggctcctgccaccatgcccagctaattttttttttttttttttttttttgtatttttagtagagacggagttttaccttgttggccaggctagtctcgaactcgtgacctcaggtgatccgtctgcctcagcatcccaaagtgctgggattacaggcgttagccaccatgcagcccctttcaagccttttaacatcatgtcaccttcacaatgagcagttgctcccattacccagtgaactcaccttctgatgggacagttaccctagttggggcttctcagccttgagagatgtgcagagcagggacctgtccagggcagagcagccagacagcgtggaaataatccaaacagagaaagcattcaagaacttggcctctggttgacttaacacactacttcaagtatatggcaggtctgtataataaactcctgcctgtctagtcttcagcctcatagaaagcaagaaagcaggtggcgtatgttgcagaacaattcttgggtagaacaaggggacatttgatggtttgggtttttcagtaagaaagatgaagtcctggagtatagggtagagtggtacagtggaaaatatttcagcttgggggttagaaaataaacatgccgattcttgctttgccataaatgatgtcacctaacttgtgtgaccctgttttctcatccctaaaatgatttgataagtttaagattaggctatttttaaatgtatggaagaaattgggtgttacccttcttgaaagacattttccctgcaagtatggcaggctgtatctttcagtgtaacaaagttctattaaaggtcataactgctgccctgtaacttttgccttattctagaaacttctactccttgaatgacatgtgttggtacatgtttcttctctttcagatagaatggttaattttgacttgttgcttctgcacacgtgtcctggaaataaaagtttcttcccactacttattgctgatttatttcataggaagtcttaaggaaagaggcaaaaaacgggctcatgggtcacttgaagttggaaaattctgtggagattgacaaaggagactcacttttgagcatctgttctcagtgtaaccttcaaatctgtggaaacataactaggcacattttatgattatttagaatgttaataaattgctctgagtttcctcaagtccattttgtaagatcagaccataggtgggtgttgtttcttttaagtgtgtgtactgtgtccaatgttacatttttagaagtgttcatgctttttgtaaagtgattcgttttaagcacattaaaggtcgtttgagtattgtcatgtatttta

SEQ ID NO: 171242 - DNA, 735 bp, Homo sapiens
  Payload ID: 13687
  Gene Symbol: PPP2R5C
  Gene Name: protein phosphatase 2, regulatory subunit B', gamma
  ENST ID: ENST00000556946
  CDS Start-End: 109-432
agttccctccagctgcagagagcttcagtttgtctttttttttttaaactaaaatggaggctggtttcttgccttaaggagcccattgcctttcccgctgaagtctagatgttgacatgtaataaagcgggcagcaggatggtggtggatgcggccaactccaatgggcctttccagcccgtggtccttctccatattcgagttgaggctgtgaagctgggcagggtttcagctgagctgaggttggaagtccctgaccttcagctgtggccgcctacggagcagcagggagagcaaacccatggagaaccccgcggcccccaaagcatggacggagctgccagccttctcccctgcccttcttcctctactcccgacctgccagccttctcccctgcccttctgcctctactcccgacctgccaaccttagcctaaaatcagagctgctagaatcacacacactgtcgtagctggttttgtattgtaaatgagtcattctgttattttggaaacttatgtctcatgccaggatctgcagatagttctttttcaaaatattgtttagacaaaataaatttctttaaatataatatctctactttaaatgcctggggtgttgcatgcatttttctaggctagcaaagcttaaagattatttctataatttcagttacatttacctttatagatgggttactctaagtaacaaattaaacacacatggatcttctaa

SEQ ID NO: 171243 - DNA, 1839 bp, Homo sapiens
  Payload ID: 13688
  Gene Symbol: PPP2R3C
  Gene Name: protein phosphatase 2, regulatory subunit B'', gamma
  Uniprot ID: Q969Q6
  ENST ID: ENST00000261475
  CDS Start-End: 355-1716
ctaatgaactcctgggtcacgtggtgcgcacgcgccaaaggcacacgataaaggaaaacgcgggcttatcgtggcctttaaaatccggcttggtgagcttgggtcgcctctgaaggagaaccattttccatctctttcatagttttttcccccagtcagcgtggtagcggtattctccgcggcagtgacagtaattgtttttgcctctttagccaagacttccgccctcgatcaagatggtggttggacggccttcctaacctttacggggcctggcggtgctgacgcctgagctggtaggggtggagcaggtaggaaacagcaaatgcagaagctgctgcgcggaagtcggccatggactggaaagaagttcttcgtcggcgcctagcgacgcccaacacctgtccaaacaaaaaaaaaagtgaacaagaattaaaagatgaagaaatggatttatttacaaaatattactccgaatggaaaggaggtagaaaaaacacaaatgaattctataagaccattccccggttttattataggctgcctgctgaagatgaagtcttactacagaaattaagagaggaatcaagagctgtctttctacaaagaaaaagcagagaactgttagataatgaagaattacagaacttatggtttttgctggacaaacaccagacaccacctatgattggagaggaagcgatgatcaattacgaaaactttttgaaggttggtgaaaaggctggagcaaagtgcaagcaatttttcacagcaaaagtctttgctaaactccttcatacagattcatatggaagaatttccatcatgcagttctttaattatgtcatgagaaaagtttggcttcatcaaacaagaataggactcagtttatatgatgtcgctgggcaggggtaccttcgggaatctgatttagaaaactacatattggaacttatccctacgttgccacaattagatggtctggaaaaatctttctactccttttatgtttgtacagcagttaggaagttcttcttctttttagatcctttaagaacaggaaagataaaaattcaagatattttagcatgcagcttcctagatgatttattggagctaagggatgaggaactgtccaaggagagtcaagaaacaaattggttttctgctccttctgccctaagagtttatggccagtacttgaatcttgataaagatcacaatggcatgctcagtaaagaagaactctcacgctatggaacagctaccatgaccaatgtcttcttagaccgtgttttccaggagtgtctcacttatgatggagaaatggactataagacctacttggactttgtccttgcattagaaaacagaaaggaacctgcagctctacaatatattttcaaactgcttgatattgagaacaaaggatacctgaatgtcttttcacttaattatttctttagggccatacaggaactaatgaaaatccatggacaagatcctgtttcatttcaagatgtcaaggatgaaatctttgacatggtaaaaccaaaggatcctttgaaaatctctcttcaggatttaatcaacagtaatcaaggagacacagtaaccaccattctaatcgatttgaatggcttctggacttacgagaacagagaggctcttgttgcaaatgacagtgaaaactctgcagaccttgatgatacatgatctctgaaagactagactgtcttatattatgagatacttgaatgctgcatgtaaagcctttaaagcaaaatcctcagaaatggtctaaataaaacacttgatatgcctagagaacacagcaaa

SEQ ID NO: 171244 - DNA, 593 bp, Homo sapiens
  Payload ID: 13688
  Gene Symbol: PPP2R3C
  Gene Name: protein phosphatase 2, regulatory subunit B'', gamma
  ENST ID: ENST00000554488
  CDS Start-End: 28-96
gcagaagctgctgcgcggaagtcggccatggactggaaagaagttcttcgtcggcgcctagcgacgcccaacacctgtccaaacactgcctgctgaagatgaagtcttactacagaaattaagagaggaatcaagagctgtctttctacaaagaaaaagcagagaactgttagataatgaagaattacagaacttatggtttttgctggacaaacaccagacaccacctatgattggagaggaagcgatgatcaattacgaaaactttttgaaggttggtgaaaaggctggagcaaagtgcaagcaatttttcacagcaaaagtctttgctaaactccttcatacagattcatatggaagaatttccatcatgcagttctttaattatgtcatgagaaaaggtgattcatttttactgtgcttgaactccttatctgggaatcaatttggcttcatcaaacaagaataggactcagtttatatgatgtcgctgggcaggggtaccttcgggaatctgatttagaaaactacatattggaacttatccctacgttgccacaattagatggtctggaaaaatctttctactcctt

SEQ ID NO: 171245 - DNA, 478 bp, Homo sapiens
  Payload ID: 13688
  Gene Symbol: PPP2R3C
  Gene Name: protein phosphatase 2, regulatory subunit B'', gamma
  ENST ID: ENST00000557074
  CDS Start-End: 1-125
ttgcattagaaaacagaaaggaacctgcagctctacaatatattttcaaactgcttgatattgagaacaaaggatacctgaatgtcttttcacttaattatttctttaggatttatttctattaaatacaggccatacaggaactaatgaaaatccatggacaagatcctgtttcatttcaagatgtcaaggatgaaatctttgacatggtaaaaccaaaggatcctttgaaaatctctcttcaggatttaatcaacagtaatcaaggagacacagtaaccaccattctaatcgatttgaatggcttctggacttacgagaacagagaggctcttgttgcaaatgacagtgaaaactctgcagaccttgatgatacatgatctctgaaagactagactgtcttatattatgagatacttgaatgctgcatgtaaagcctttaaagcaaaatcctcagaaatggtctaaataaaacact

SEQ ID NO: 171246 - DNA, 684 bp, Homo sapiens
  Payload ID: 13688
  Gene Symbol: PPP2R3C
  Gene Name: protein phosphatase 2, regulatory subunit B'', gamma
  ENST ID: ENST00000554361
  CDS Start-End: 7-684
tcggccatggactggaaagaagttcttcgtcggcgcctagcgacgcccaacacctgtccaaacaaaaaaaaaagtgaacaagaattaaaagatgaagaaatggatttatttacaaaatattactccgaatggaaaggaggtagaaaaaacacaaatgaattctataagaccattccccggttttattataggctgcctgctgaagatgaagtcttactacagaaattaagagaggaatcaagagctgtctttctacaaagaaaaagcagagaactgttagataatgaagaattacaggttggtgaaaaggctggagcaaagtgcaagcaatttttcacagcaaaagtctttgctaaactccttcatacagattcatatggaagaatttccatcatgcagttctttaattatgtcatgagaaaagtttggcttcatcaaacaagaataggactcagtttatatgatgtcgctgggcaggggtaccttcgggaatctgatttagaaaactacatattggaacttatccctacgttgccacaattagatggtctggaaaaatctttctactccttttatgtttgtacagcagttaggaagttcttcttctttttagatcctttaagaacaggaaagataaaaattcaagatattttagcatgcagcttcctagatgatttattggag

SEQ ID NO: 171247 - DNA, 896 bp, Homo sapiens
  Payload ID: 13688
  Gene Symbol: PPP2R3C
  Gene Name: protein phosphatase 2, regulatory subunit B'', gamma
  ENST ID: ENST00000557278
  CDS Start-End: 395-896
cggcgaggaaaaaaggcagttttgaagcatttagtggcaaaaggggtaggagacggctgctgaagtgtctactacattcaggggacctggaaggcttccagatatccgcaatgaacaatgaaaagaaattgtgaaagaaggcgcttccctcaagccggaactaatgaactcctgggtcacgtggtgcgcacgcgccaaaggcacacgataaaggaaaacgcgggcttatcgtggcctttaaaatccggcttgccaagacttccgccctcgatcaagatggtggttggacggccttcctaacctttacggggcctggcggtgctgacgcctgagctggtaggggtggagcaggtaggaaacagcaaatgcagaagctgctgcgcggaagtcggccatggactggaaagaagttcttcgtcggcgcctagcgacgcccaacacctgtccaaacaaaaaaaaaagtgaacaagaattaaaagatgaagaaatggatttatttacaaaatattactccgaatggaaaggaggtagaaaaaacacaaatgaattctataagaccattccccggttttattataggctgcctgctgaagatgaagtcttactacagaaattaagagaggaatcaagagctgtctttctacaaagaaaaagcagagaactgttagataatgaagaattacagaacttatggtttttgctggacaaacaccagacaccacctatgattggagaggaagcgatgatcaattacgaaaactttttgaaggttggtgaaaaggctggagcaaagtgcaagcaatttttcacagcaaaagtctttgctaaactccttcatacagattcatatggaagaatttccatcatgcagttctttaattatgtcatgagaaaag

SEQ ID NO: 171248 - DNA, 1402 bp, Homo sapiens
  Payload ID: 13688
  Gene Symbol: PPP2R3C
  Gene Name: protein phosphatase 2, regulatory subunit B'', gamma
  ENST ID: ENST00000553273
  CDS Start-End: 183-251
ggaaaacgcgggcttatcgtggcctttaaaatccggcttgccaagacttccgccctcgatcaagatggtggttggacggccttcctaacctttacggggcctggcggtgctgacgcctgagctggtaggggtggagcaggtaggaaacagcaaatgcagaagctgctgcgcggaagtcggccatggactggaaagaagttcttcgtcggcgcctagcgacgcccaacacctgtccaaacactgcctgctgaagatgaagtcttactacagaaattaagagaggaatcaagagctgtctttctacaaagaaaaagcagagaactgttagataatgaagaattacagaacttatggtttttgctggacaaacaccagacaccacctatgattggagaggaagcgatgatcaattacgaaaactttttgaaggttggtgaaaaggctggagcaaagtgcaagcaatttttcacagcaaaagtctttgctaaactccttcatacagattcatatggaagaatttccatcatgcagttctttaattatgtcatgagaaaagtttggcttcatcaaacaagaataggactcagtttatatgatgtcgctgggcaggggtaccttcgggaatctgatttagaaaactacatattggaacttatccctacgttgccacaattagatggtctggaaaaatctttctactccttttatgtttgtacagcagttaggaagttcttcttctttttagatcctttaagaacaggaaagataaaaattcaagatattttagcatgcagcttcctagatgatttattggagctaagggatgaggaactgtccaaggagagtcaagaaacaaattggttttctgctccttctgccctaagagtttatggactataagacctacttggactttgtccttgcattagaaaacagaaaggaacctgcagctctacaatatattttcaaactgcttgatattgagaacaaaggatacctgaatgtcttttcacttaattatttctttagggccatacaggaactaatgaaaatccatggacaagatcctgtttcatttcaagatgtcaaggatgaaatctttgacatggtaaaaccaaaggatcctttgaaaatctctcttcaggatttaatcaacagtaatcaaggagacacagtaaccaccattctaatcgatttgaatggcttctggacttacgagaacagagaggctcttgttgcaaatgacagtgaaaactctgcagaccttgatgatacatgatctctgaaagactagactgtcttatattatgagatacttgaatgctgcatgtaaagcctttaaagcaaaatcctcagaaatggtctaaataaaacacttgatatgcctagagaacacagcaaa

SEQ ID NO: 171249 - DNA, 676 bp, Homo sapiens
  Payload ID: 13688
  Gene Symbol: PPP2R3C
  Gene Name: protein phosphatase 2, regulatory subunit B'', gamma
  ENST ID: ENST00000555614
  CDS Start-End: 1-676
gctgcctgctgaagatgaagtcttactacagaaattaagagaggaatcaagagctgtctttctacaaagaaaaagcagagaactgttagataatgaagaattacagacaccacctatgattggagaggaagcgatgatcaattacgaaaactttttgaaggttggtgaaaaggctggagcaaagtgcaagcaatttttcacagcaaaagtctttgctaaactccttcatacagattcatatggaagaatttccatcatgcagttctttaattatgtcatgagaaaagtttggcttcatcaaacaagaataggactcagtttatatgatgtcgctgggcaggggtaccttcgggaatctgatttagaaaactacatattggaacttatccctacgttgccacaattagatggtctggaaaaatctttctactccttttatgtttgtacagcagttaggaagttcttcttctttttagatcctttaagaacaggaaagataaaaattcaagatattttagcatgcagcttcctagatgatttattggagctaagggatgaggaactgtccaaggagagtcaagaaacaaattggttttctgctccttctgccctaagagtttatggccagtacttgaatcttgataaagatcacaatggcatgctcagtaaagaagaa

SEQ ID NO: 171250 - DNA, 1719 bp, Homo sapiens
  Payload ID: 13688
  Gene Symbol: PPP2R3C
  Gene Name: protein phosphatase 2, regulatory subunit B'', gamma
  ENST ID: ENST00000554222
  CDS Start-End: 369-437
gcatttagtggcaaaaggggtaggagacggctgctgaagtgtctactacattcaggggacctggaaggcttccagatatccgcaatgaacaatgaaaagaaattgtgaaagaaggcgcttccctcaagccggaactaatgaactcctgggtcacgtggtgcgcacgcgccaaaggcacacgataaaggaaaacgcgggcttatcgtggcctttaaaatccggcttgccaagacttccgccctcgatcaagatggtggttggacggccttcctaacctttacggggcctggcggtgctgacgcctgagctggtaggggtggagcaggtaggaaacagcaaatgcagaagctgctgcgcggaagtcggccatggactggaaagaagttcttcgtcggcgcctagcgacgcccaacacctgtccaaacactgcctgctgaagatgaagtcttactacagaaattaagagaggaatcaagagctgtctttctacaaagaaaaagcagagaactgttagataatgaagaattacagaacttatggtttttgctggacaaacaccagacaccacctatgattggagaggaagcgatgatcaattacgaaaactttttgaaggttggtgaaaaggctggagcaaagtgcaagcaatttttcacagcaaaagtctttgctaaactccttcatacagattcatatggaagaatttccatcatgcagttctttaattatgtcatgagaaaagtttggcttcatcaaacaagaataggactcagtttatatgatgtcgctgggcaggggtaccttcgggaatctgatttagaaaactacatattggaacttatccctacgttgccacaattagatggtctggaaaaatctttctactccttttatgtttgtacagcagttaggaagttcttcttctttttagatcctttaagaacaggaaagataaaaattcaagatattttagcatgcagcttcctagatgatttattggagctaagggatgaggaactgtccaaggagagtcaagaaacaaattggttttctgctccttctgccctaagagtttatggccagtacttgaatcttgataaagatcacaatggcatgctcagtaaagaagaactctcacgctatggaacagctaccatgaccaatgtcttcttagaccgtgttttccaggagtgtctcacttatgatggagaaatggactataagacctacttggactttgtccttgcattagaaaacagaaaggaacctgcagctctacaatatattttcaaactgcttgatattgagaacaaaggatacctgaatgtcttttcacttaattatttctttagggccatacaggaactaatgaaaatccatggacaagatcctgtttcatttcaagatgtcaaggatgaaatctttgacatggtaaaaccaaaggatcctttgaaaatctctcttcaggatttaatcaacagtaatcaaggagacacagtaaccaccattctaatcgatttgaatggcttctggacttacgagaacagagaggctcttgttgcaaatgacagtgaaaactctgcagaccttgatgatacatgatctctgaaagactagactgtcttatattatgagatacttgaatgctgcatgtaaagcctttaaagcaaaatcctcagaaatggtctaaataaaacacttgatatgcctagagaacac

SEQ ID NO: 171251 - DNA, 479 bp, Homo sapiens
  Payload ID: 13688
  Gene Symbol: PPP2R3C
  Gene Name: protein phosphatase 2, regulatory subunit B'', gamma
  ENST ID: ENST00000553282
  CDS Start-End: 30-191
atgcagaagctgctgcgcggaagtcggccatggactggaaagaagttcttcgtcggcgcctagcgacgcccaacacctgtccaaacagtagagaaacagtgattatgaggctgaaactccatgaggtcaggggctggggctgtcttgctcacccctcattccgtgtctactacagcgttctctgtacataaaaaaaaaagtgaacaagaattaaaagatgaagaaatggatttatttacaaaatattactccgaatggaaaggaggtagaaaaaacacaaatgaattctataagaccattccccggttttattataggctgcctgctgaagatgaagtcttactacagaaattaagagaggaatcaagagctgtctttctacaaagaaaaagcagagaactgttagataatgaagaattacagaacttatggtttttgctggacaaacaccagacaccacctatgattggagaggaagc

SEQ ID NO: 171252 - DNA, 492 bp, Homo sapiens
  Payload ID: 13688
  Gene Symbol: PPP2R3C
  Gene Name: protein phosphatase 2, regulatory subunit B'', gamma
  ENST ID: ENST00000557288
  CDS Start-End: 26-115
agaagctgctgcgcggaagtcggccatggactggaaagaagttcttcgtcggcgcctagcgacgcccaacacctgtccaaacaaaatttaccttgtattttcagctgcctgctgaagatgaagtcttactacagaaattaagagaggaatcaagagctgtctttctacaaagaaaaagcagagaactgttagataatgaagaattacagaacttatggtttttgctggacaaacaccagacaccacctatgattggagaggaagcgatgatcaattacgaaaactttttgaaggttggtgaaaaggctggagcaaagtgcaagcaatttttcacagcaaaagtctttgctaaactccttcatacagattcatatggaagaatttccatcatgcagttctttaattatgtcatgagaaaagtttggcttcatcaaacaagaataggactcagtttatatgatgtcgctgggcaggggtaccttcgggaatctg

SEQ ID NO: 171253 - DNA, 1347 bp, Homo sapiens
  Payload ID: 13688
  Gene Symbol: PPP2R3C
  Gene Name: protein phosphatase 2, regulatory subunit B'', gamma
  ENST ID: ENST00000555644
  CDS Start-End: 355-927
ctaatgaactcctgggtcacgtggtgcgcacgcgccaaaggcacacgataaaggaaaacgcgggcttatcgtggcctttaaaatccggcttggtgagcttgggtcgcctctgaaggagaaccattttccatctctttcatagttttttcccccagtcagcgtggtagcggtattctccgcggcagtgacagtaattgtttttgcctctttagccaagacttccgccctcgatcaagatggtggttggacggccttcctaacctttacggggcctggcggtgctgacgcctgagctggtaggggtggagcaggtaggaaacagcaaatgcagaagctgctgcgcggaagtcggccatggactggaaagaagttcttcgtcggcgcctagcgacgcccaacacctgtccaaacaaaaaaaaaagtgaacaagaattaaaagatgaagaaatggatttatttacaaaatattactccgaatggaaaggaggtagaaaaaacacaaatgaattctataagaccattccccggttttattataggctgcctgctgaagatgaagtcttactacagaaattaagagaggaatcaagagctgtctttctacaaagaaaaagcagagaactgttagataatgaagaattacagaacttatggtttttgctggacaaacaccagacaccacctatgattggagaggaagcgatgatcaattacgaaaactttttgaaggttggtgaaaaggctggagcaaagtgcaagcaatttttcacagcaaaagtctttgctaaactccttcatacagattcatatggaagaatttccatcatgcagttctttaattatgtcatgagaaaaggtgattcatttttactgtgcttgaactccttatctgggaatcaagtaggtttttggtctgtgcttttataagtatttcttctatgtgaaatcactctaagtttgaatagtagaatttcttatcttttgaccaagatgtgttacataaacttgggttagcataaaaaaacaaaaattttttaaaccctcatgtgtcttaaagataatagtagactagaaatattaagagctgaaccaagagttttaatgtatggtaatttgaaataattttaatttactgataattttattttaccagtatattacaagttgagttgactgatagtttcaaacccaaagctgtaatatcagtttcaaggagcatcaattaaacagcttggacttatgattcctacaagtgccataataatctgtgaaagcctattgtatacaatctttaataattggttgctgtaattaacctcagaaataaaagcagcttcactgaaggca

SEQ ID NO: 171254 - DNA, 546 bp, Homo sapiens
  Payload ID: 13688
  Gene Symbol: PPP2R3C
  Gene Name: protein phosphatase 2, regulatory subunit B'', gamma
  ENST ID: ENST00000555726
  CDS Start-End: 1-59
aagaagttcttcgtcggcgcctagcgacgcccaacacctgtccaaacactgcctgctgaagatgaagtcttactacagaaattaagagaggaatcaagagctgtctttctacaaagaaaaagcagagaactgttagataatgaagaattacaggcaatttttcacagcaaaagtctttgctaaactccttcatacagattcatatggaagaatttccatcatgcagttctttaattatgtcatgagaaaagtttggcttcatcaaacaagaataggactcagtttatatgatgtcgctgggcaggggtaccttcgggaatctgatttagaaaactacatattggaacttatccctacgttgccacaattagatggtctggaaaaatctttctactccttttatgtttgtacagcagttaggaagttcttcttctttttagatcctttaagaacaggaaagataaaaattcaagatattttagcatgcagcttcctagatgatttattggagctaagggatgaggaactgtccaaggagagtcaaga

SEQ ID NO: 171255 - DNA, 501 bp, Homo sapiens
  Payload ID: 13688
  Gene Symbol: PPP2R3C
  Gene Name: protein phosphatase 2, regulatory subunit B'', gamma
  ENST ID: ENST00000555219
  CDS Start-End: 1-387
ggccagtacttgaatcttgataaagatcacaatggcatgctcagtaaagaagaactctcacgctatggaacagctaccatgaccaatgtcttcttagaccgtgttttccaggagtgtctcacttatgatggagaaatggccatacaggaactaatgaaaatccatggacaagatcctgtttcatttcaagatgtcaaggatgaaatctttgacatggtaaaaccaaaggatcctttgaaaatctctcttcaggatttaatcaacagtaatcaaggagacacagtaaccaccattctaatcgatttgaatggcttctggacttacgagaacagagaggctcttgttgcaaatgacagtgaaaactctgcagaccttgatgatacatgatctctgaaagactagactgtcttatattatgagatacttgaatgctgcatgtaaagcctttaaagcaaaatcctcagaaatggtctaaataaaacacttgatatgcctagagaa

SEQ ID NO: 171256 - DNA, 712 bp, Homo sapiens
  Payload ID: 13688
  Gene Symbol: PPP2R3C
  Gene Name: protein phosphatase 2, regulatory subunit B'', gamma
  ENST ID: ENST00000555630
  CDS Start-End: 56-460
ggggtggagcaggtaggaaacagcaaatgcagaagctgctgcgcggaagtcggccatggactggaaagaagttcttcgtcggcgcctagcgacgcccaacacctgtccaaacaaaaaaaaaagtgaacaagaattaaaagatgaagaaatggatttatttacaaaatattactccgaatggaaaggaggtagaaaaaacacaaatgaattctataagaccattccccggttttattataggctgcctgctgaagatgaagtcttactacagaaattaagagaggaatcaagagctgtctttctacaaagaaaaagcagagaactgttagataatgaagaattacagaacttatggtttttgctggacaaacaccagacaccacctatgattggagaggaagcgatgatcaattacgaaaactttttgaaggcaatttttcacagcaaaagtctttgctaaactccttcatacagattcatatggaagaatttccatcatgcagttctttaattatgtcatgagaaaagtttggcttcatcaaacaagaataggactcagtttatatgatgtcgctgggcaggggtaccttcgggaatctgatttagaaaactacatattggaacttatccctacgttgccacaattagatggtctggaaaaatctttctactccttttatgtttgtacagcagttaggaagttcttcttctt

SEQ ID NO: 171257 - DNA, 762 bp, Homo sapiens
  Payload ID: 13688
  Gene Symbol: PPP2R3C
  Gene Name: protein phosphatase 2, regulatory subunit B'', gamma
  ENST ID: ENST00000554899
  CDS Start-End: 16-84
gcgcggaagtcggccatggactggaaagaagttcttcgtcggcgcctagcgacgcccaacacctgtccaaacactgcctgctgaagatgaagtcttactacagaaattaagagaggaatcaagagctgtctttctacaaagaaaaagcagagaactgttagataatgaagaattacagaacttatggtttttgctggacaaacaccagacaccacctatgattggagaggaagcgatgatcaattacgaaaactttttgaaggcaatttttcacagcaaaagtctttgctaaactccttcatacagattcatatggaagaatttccatcatgcagttctttaattatgtcatgagaaaaggatttagaaaactacatattggaacttatccctacgttgccacaattagatggtctggaaaaatctttctactccttttatgtttgtacagcagttaggaagttcttcttctttttagatcctttaagaacaggaaagataaaaattcaagatattttagcatgcagcttcctagatgatttattggagctaagggatgaggaactgtccaaggagagtcaagaaacaaattggttttctgctccttctgccctaagagtttatggccagtacttgaatcttgataaagatcacaatggcatgctcagtaaagaagaactctcacgctatggaacagctaccatgaccaatgtcttcttagaccgtgttttccaggagtgtctcacttatgatggagaaatg

SEQ ID NO: 171258 - DNA, 1029 bp, Homo sapiens
  Payload ID: 13688
  Gene Symbol: PPP2R3C
  Gene Name: protein phosphatase 2, regulatory subunit B'', gamma
  ENST ID: ENST00000554265
  CDS Start-End: 32-100
aaatgcagaagctgctgcgcggaagtcggccatggactggaaagaagttcttcgtcggcgcctagcgacgcccaacacctgtccaaacactgcctgctgaagatgaagtcttactacagaaattaagagaggaatcaagagctgtctttctacaaagaaaaagcagagaactgttagataatgaagaattacagaacttatggtttttgctggacaaacaccagacaccacctatgattggagaggaagcgatgatcaattacgaaaactttttgaaggttggtgaaaaggctggagcaaagtgcaagatttagaaaactacatattggaacttatccctacgttgccacaattagatggtctggaaaaatctttctactccttttatgtttgtacagcagttaggaagttcttcttctttttagatcctttaagaacaggtaaaagaaaatcttatctaacttagatattatgaggatattattatatctaaatctcaataactagagaaaactcttgaaaaatatcatttattttcctgtcactgccattaaaaatttggtgaatttcaaggagataaaaaggtagaaaaaacagtagcagtactttggttatgtttatctgaagatcttttatgatttacttgcactgaccataacctgctgtgtgacagatggggggacatcacctaacagtgaagaagtatgaactgggtagtcagtcataaatacctccttccagttctaggaagccagttatttgcatataatttgctgtctctgctgtgtgacatactgcagaattattctctttttgatgaaaaatatgtatttggaaatatgagagccatttagccagtgatgcatatttttcttattctctataaggatcggattggtaaatatggcctcattaacagtttgttttattaactgttcaaacctgcccagacttaactacatgtaactggagcagaggaaaggacagagaaggtccaaatcaaagtgcctgattgtccttctgtccttg

SEQ ID NO: 171259 - DNA, 1846 bp, Homo sapiens
  Payload ID: 13688
  Gene Symbol: PPP2R3C
  Gene Name: protein phosphatase 2, regulatory subunit B'', gamma
  ENST ID: ENST00000557217
  CDS Start-End: 559-627
gacggacgagactgacccggacttaggcgttccgcctggcccggcggcgaggaaaaaaggcagttttgaagcatttagtggcaaaaggggtaggagacggctgctgaagtgtctactacattcaggggacctggaaggcttccagatatccgcaatgaacaatgaaaagaaattgtgaaagaaggcgcttccctcaagccggaactaatgaactcctgggtcacgtggtgcgcacgcgccaaaggcacacgataaaggaaaacgcgggcttatcgtggcctttaaaatccggcttggtgagcttgggtcgcctctgaaggagaaccattttccatctctttcatagttttttcccccagtcagcgtggtagcggtattctccgcggcagtgacagtaattgtttttgcctctttagccaagacttccgccctcgatcaagatggtggttggacggccttcctaacctttacggggcctggcggtgctgacgcctgagctggtaggggtggagcaggtaggaaacagcaaatgcagaagctgctgcgcggaagtcggccatggactggaaagaagttcttcgtcggcgcctagcgacgcccaacacctgtccaaacactgcctgctgaagatgaagtcttactacagaaattaagagaggaatcaagagctgtctttctacaaagaaaaagcagagaactgttagataatgaagaattacagaacttatggtttttgctggacaaacaccagacaccacctatgattggagaggaagcgatgatcaattacgaaaactttttgaaggttggtgaaaaggctggagcaaagtgcaagcaatttttcacagcaaaagtctttgctaaactccttcatacagattcatatggaagaatttccatcatgcagttctttaattatgtcatgagaaaagtttggcttcatcaaacaagaataggactcagtttatatgatgtcgctgggcaggggtaccttcgggaatctgatttagaaaactacatattggaacttatccctacgttgccacaattagatggtctggaaaaatctttctactccttttatgtttgtacagcagttaggaagttcttcttctttttagatcctttaagaacaggaaagataaaaattcaagatattttagcatgcagcttcctagatgatttattggagctaagggatgaggaactgtccaaggagagtcaagaaacaaattggttttctgctccttctgccctaagagtttatggccagtacttgaatcttgataaagatcacaatggcatgctcagtaaagaagaactctcacgctatggaacagctaccatgaccaatgtcttcttagaccgtgttttccaggagtgtctcacttatgatggagaaatggactataagacctacttggactttgtccttgcattagaaaacagaaaggaacctgcagctctacaatatattttcaaactgcttgatattgagaacaaaggatacctgaatgtcttttcacttaattatttctttagggccatacaggaactaatgaaaatccatggacaagatcctgtttcatttcaagatgtcaaggatgaaatctttgacatggtaaaaccaaaggatcctttgaaaatctctcttcaggatttaatcaacagtaatcaaggagacacagtaaccaccattctaatcgatttgaatggcttctggacttacgagaacagagaggctcttgttgcaaatgacagtgaaaactctgcagaccttgatgatacatgatctctgaaagactagactgtcttatattatgagatacttgaatgctgcatgtaa

SEQ ID NO: 171260 - DNA, 469 bp, Homo sapiens
  Payload ID: 13688
  Gene Symbol: PPP2R3C
  Gene Name: protein phosphatase 2, regulatory subunit B'', gamma
  ENST ID: ENST00000554563
  CDS Start-End: 12-332
ggaagtcggccatggactggaaagaagttcttcgtcggcgcctagcgacgcccaacacctgtccaaacaaaaaaaaaagtgaacaagaattaaaagatgaagaaatggatttatttacaaaatattactccgaatggaaaggaggtagaaaaaacacaaatgaattctataagaccattccccggttttattataggctgcctgctgaagatgaagtcttactacagaaattaagagaggaatcaagagctgtctttctacaaagaaaaagcagagaactgttagataatgaagaattacaggcaatttttcacagcaaaagtctttgctaaactccttcatacagattcatatggaagaatttccatcatgcagttctttaattatgtcatgagaaaagtttggcttcatcaaacaagaataggactcagtttatatgatgtcgctgggcaggggtaccttcgggaat

SEQ ID NO: 171261 - DNA, 2737 bp, Homo sapiens
  Payload ID: 13689
  Gene Symbol: PPP2R4
  Gene Name: protein phosphatase 2A activator, regulatory subunit 4
  ENST ID: ENST00000348141
  CDS Start-End: 266-1255
gcactgacatggccgtcgcccggttccgcgcgtccgccgcgcgccggccgttaataggcttgctccctgagcgccccgcaccgacatggcggccgtcttcgctgtggtgactttaactctcggttttcggttatagccggccggcgctcacttgtcttcaggaagctcggagcctttggtggagccggggagaggaagggtgggtgcaagagtgaaaggcgagaggggactgcaagcatccgggtcggctcctggccggagcaagatggctgagggcgagcggcagccgccgccagattcttcagaggaggcccctccagccactcagaacttcatcattccaaaaaaggagatccacacagttccagacatgggcaaatggaagcgttctcaggtaccatttggaactgtggcatacgctgactacatcggattcatccttaccctcaacgaaggtgtgaaggggaagaagctgaccttcgagtacagagtctccgaggccattgagaaactagtcgctcttctcaacacgctggacaggtggattgatgagactcctccagtggaccagccctctcggtttgggaataaggcatacaggacctggtatgccaaacttgatgaggaagcagaaaacttggtggccacagtggtccctacccatctggcagctgctgtgcctgaggtggctgtttacctaaaggagtcagtggggaactccacgcgcattgactacggcacagggcatgaggcagccttcgctgctttcctctgctgtctctgcaagattggggtgctccgggtggatgaccaaatagctattgtcttcaaggtgttcaatcggtaccttgaggttatgcggaaactccagaaaacatacaggatggagccagccggcagccagggagtgtggggtctggatgacttccagtttctgcccttcatctggggcagttcgcagctgatagaccacccatacctggagcccagacactttgtggatgagaaggccgtgaatgagaaccacaaggactacatgttcctggagtgtatcctgtttattaccgagatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcaccgcagggaagggaggagagatacctgctgcttccattgcttttcccttcctggagtcgatgcctttctaagggttggagctgctccttgcaggggcgggtcagtttcccaggccatgccggggtggccatctatggtagggctggaagctgaggctggccgccagctgtgggctggggtggggtgggtggggtcgggtggtggagaggccttagctgtcctggctggtgcccctcccaggctccttttcaccctgccccctgggcctgaggccccctgtgtccaagcctccccctggctcttcagttctctagcccttggctctgctgggtttcctgactgtagccacatctctcccgctccctaagggtaacctagccaatggaagctgccctttgggtaggtgctgggctcctgggagggcccagatgatggggtgaggcatgtctttccagaactttccctggcagggaggggatggcagaaactcagggaggggcttggggcccattgtatctggagagcctggattcctcttggcagtcttaggcccggccacttctgctacctttgcgctgctgtgagcctcaccctgggcccctgggccctgcttctctgctcccctgggtgatgggtgggcccagaaggtggcagtcccacaccttgtcctcccacctccctgaactgtccattgcttttatagggtgaggtaagagacagcctcccaagcccaggctttggcactcagaatgggcccagtgggggctgggcaggcccattgagggccaccgccgaggtttctcctagggctgttcctgggcctggctcttacaggctcgtcccccaggcctgcccttctccactgccccctcctgtgtctgggtccacacacccttcaggaagggggagcactgagaagcacagcacaggggctcagcctgggatccggtgatggtctgggcagaggctgggtcaggagtcccaaaggtcagtgacagtttctcagaagaggcccagcgtccacctctctcccagggccagacagcccttcctggctcccccatccccctatgggctcccagccccttgcaccctcattgctgttcagattaaagcctctgttttgcacctgtca

SEQ ID NO: 171262 - DNA, 1989 bp, Homo sapiens
  Payload ID: 13689
  Gene Symbol: PPP2R4
  Gene Name: protein phosphatase 2A activator, regulatory subunit 4
  ENST ID: ENST00000347048
  CDS Start-End: 193-507
ccccgcaccgacatggcggccgtcttcgctgtggtgactttaactctcggttttcggttatagccggccggcgctcacttgtcttcaggaagctcggagcctttggtggagccggggagaggaagggtgggtgcaagagtgaaaggcgagaggggactgcaagcatccgggtcggctcctggccggagcaagatggctgagggcgagcggcagccgccgccagattcttcagaggaggcccctccagccactcagaacttcatcattccaaaaaaggagatccacacagttccagacatgggcaaatggaagcgttctcagatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcaccgcagggaagggaggagagatacctgctgcttccattgcttttcccttcctggagtcgatgcctttctaagggttggagctgctccttgcaggggcgggtcagtttcccaggccatgccggggtggccatctatggtagggctggaagctgaggctggccgccagctgtgggctggggtggggtgggtggggtcgggtggtggagaggccttagctgtcctggctggtgcccctcccaggctccttttcaccctgccccctgggcctgaggccccctgtgtccaagcctccccctggctcttcagttctctagcccttggctctgctgggtttcctgactgtagccacatctctcccgctccctaagggtaacctagccaatggaagctgccctttgggtaggtgctgggctcctgggagggcccagatgatggggtgaggcatgtctttccagaactttccctggcagggaggggatggcagaaactcagggaggggcttggggcccattgtatctggagagcctggattcctcttggcagtcttaggcccggccacttctgctacctttgcgctgctgtgagcctcaccctgggcccctgggccctgcttctctgctcccctgggtgatgggtgggcccagaaggtggcagtcccacaccttgtcctcccacctccctgaactgtccattgcttttatagggtgaggtaagagacagcctcccaagcccaggctttggcactcagaatgggcccagtgggggctgggcaggcccattgagggccaccgccgaggtttctcctagggctgttcctgggcctggctcttacaggctcgtcccccaggcctgcccttctccactgccccctcctgtgtctgggtccacacacccttcaggaagggggagcactgagaagcacagcacaggggctcagcctgggatccggtgatggtctgggcagaggctgggtcaggagtcccaaaggtcagtgacagtttctcagaagaggcccagcgtccacctctctcccagggccagacagcccttcctggctcccccatccccctatgggctcccagccccttgcaccctcattgctgttcagattaaagcctctgttttgcacctgtca

SEQ ID NO: 171263 - DNA, 2845 bp, Homo sapiens
  Payload ID: 13689
  Gene Symbol: PPP2R4
  Gene Name: protein phosphatase 2A activator, regulatory subunit 4
  Uniprot ID: Q15257
  ENST ID: ENST00000337738
  CDS Start-End: 288-1364
gcgcatgcgccccgcgcgccccgcactgacatggccgtcgcccggttccgcgcgtccgccgcgcgccggccgttaataggcttgctccctgagcgccccgcaccgacatggcggccgtcttcgctgtggtgactttaactctcggttttcggttatagccggccggcgctcacttgtcttcaggaagctcggagcctttggtggagccggggagaggaagggtgggtgcaagagtgaaaggcgagaggggactgcaagcatccgggtcggctcctggccggagcaagatggctgagggcgagcggcagccgccgccagattcttcagaggaggcccctccagccactcagaacttcatcattccaaaaaaggagatccacacagttccagacatgggcaaatggaagcgttctcaggcatacgctgactacatcggattcatccttaccctcaacgaaggtgtgaaggggaagaagctgaccttcgagtacagagtctccgagatgtggaatgaggttcatgaggaaaaggagcaggctgcaaagcagagtgtgtcctgcgatgaatgcataccattaccccgcgccgggcactgtgcaccttcggaggccattgagaaactagtcgctcttctcaacacgctggacaggtggattgatgagactcctccagtggaccagccctctcggtttgggaataaggcatacaggacctggtatgccaaacttgatgaggaagcagaaaacttggtggccacagtggtccctacccatctggcagctgctgtgcctgaggtggctgtttacctaaaggagtcagtggggaactccacgcgcattgactacggcacagggcatgaggcagccttcgctgctttcctctgctgtctctgcaagattggggtgctccgggtggatgaccaaatagctattgtcttcaaggtgttcaatcggtaccttgaggttatgcggaaactccagaaaacatacaggatggagccagccggcagccagggagtgtggggtctggatgacttccagtttctgcccttcatctggggcagttcgcagctgatagaccacccatacctggagcccagacactttgtggatgagaaggccgtgaatgagaaccacaaggactacatgttcctggagtgtatcctgtttattaccgagatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcaccgcagggaagggaggagagatacctgctgcttccattgcttttcccttcctggagtcgatgcctttctaagggttggagctgctccttgcaggggcgggtcagtttcccaggccatgccggggtggccatctatggtagggctggaagctgaggctggccgccagctgtgggctggggtggggtgggtggggtcgggtggtggagaggccttagctgtcctggctggtgcccctcccaggctccttttcaccctgccccctgggcctgaggccccctgtgtccaagcctccccctggctcttcagttctctagcccttggctctgctgggtttcctgactgtagccacatctctcccgctccctaagggtaacctagccaatggaagctgccctttgggtaggtgctgggctcctgggagggcccagatgatggggtgaggcatgtctttccagaactttccctggcagggaggggatggcagaaactcagggaggggcttggggcccattgtatctggagagcctggattcctcttggcagtcttaggcccggccacttctgctacctttgcgctgctgtgagcctcaccctgggcccctgggccctgcttctctgctcccctgggtgatgggtgggcccagaaggtggcagtcccacaccttgtcctcccacctccctgaactgtccattgcttttatagggtgaggtaagagacagcctcccaagcccaggctttggcactcagaatgggcccagtgggggctgggcaggcccattgagggccaccgccgaggtttctcctagggctgttcctgggcctggctcttacaggctcgtcccccaggcctgcccttctccactgccccctcctgtgtctgggtccacacacccttcaggaagggggagcactgagaagcacagcacaggggctcagcctgggatccggtgatggtctgggcagaggctgggtcaggagtcccaaaggtcagtgacagtttctcagaagaggcccagcgtccacctctctcccagggccagacagcccttcctggctcccccatccccctatgggctcccagccccttgcaccctcattgctgttcagattaaagcctctgttttgcacctgtc

SEQ ID NO: 171264 - DNA, 2515 bp, Homo sapiens
  Payload ID: 13689
  Gene Symbol: PPP2R4
  Gene Name: protein phosphatase 2A activator, regulatory subunit 4
  Uniprot ID: Q15257
  ENST ID: ENST00000355007
  CDS Start-End: 188-1033
caccgacatggcggccgtcttcgctgtggtgactttaactctcggttttcggttatagccggccggcgctcacttgtcttcaggaagctcggagcctttggtggagccggggagaggaagggtgggtgcaagagtgaaaggcgagaggggactgcaagcatccgggtcggctcctggccggagcaagatggctgagggcgagcggcagccgccgccagattcttcagaggaggcccctccagccactcagaacttcatcattccaaaaaaggagatccacacagttccagacatgggcaaatggaagcgttctcaggcatacgctgactacatcggattcatccttaccctcaacgaaggtgtgaaggggaagaagctgaccttcgagtacagagtctccgaggaagcagaaaacttggtggccacagtggtccctacccatctggcagctgctgtgcctgaggtggctgtttacctaaaggagtcagtggggaactccacgcgcattgactacggcacagggcatgaggcagccttcgctgctttcctctgctgtctctgcaagattggggtgctccgggtggatgaccaaatagctattgtcttcaaggtgttcaatcggtaccttgaggttatgcggaaactccagaaaacatacaggatggagccagccggcagccagggagtgtggggtctggatgacttccagtttctgcccttcatctggggcagttcgcagctgatagaccacccatacctggagcccagacactttgtggatgagaaggccgtgaatgagaaccacaaggactacatgttcctggagtgtatcctgtttattaccgagatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcaccgcagggaagggaggagagatacctgctgcttccattgcttttcccttcctggagtcgatgcctttctaagggttggagctgctccttgcaggggcgggtcagtttcccaggccatgccggggtggccatctatggtagggctggaagctgaggctggccgccagctgtgggctggggtggggtgggtggggtcgggtggtggagaggccttagctgtcctggctggtgcccctcccaggctccttttcaccctgccccctgggcctgaggccccctgtgtccaagcctccccctggctcttcagttctctagcccttggctctgctgggtttcctgactgtagccacatctctcccgctccctaagggtaacctagccaatggaagctgccctttgggtaggtgctgggctcctgggagggcccagatgatggggtgaggcatgtctttccagaactttccctggcagggaggggatggcagaaactcagggaggggcttggggcccattgtatctggagagcctggattcctcttggcagtcttaggcccggccacttctgctacctttgcgctgctgtgagcctcaccctgggcccctgggccctgcttctctgctcccctgggtgatgggtgggcccagaaggtggcagtcccacaccttgtcctcccacctccctgaactgtccattgcttttatagggtgaggtaagagacagcctcccaagcccaggctttggcactcagaatgggcccagtgggggctgggcaggcccattgagggccaccgccgaggtttctcctagggctgttcctgggcctggctcttacaggctcgtcccccaggcctgcccttctccactgccccctcctgtgtctgggtccacacacccttcaggaagggggagcactgagaagcacagcacaggggctcagcctgggatccggtgatggtctgggcagaggctgggtcaggagtcccaaaggtcagtgacagtttctcagaagaggcccagcgtccacctctctcccagggccagacagcccttcctggctcccccatccccctatgggctcccagccccttgcaccctcattgctgttcagattaaagcctctgttttgcacctgtca

SEQ ID NO: 171265 - DNA, 2653 bp, Homo sapiens
  Payload ID: 13689
  Gene Symbol: PPP2R4
  Gene Name: protein phosphatase 2A activator, regulatory subunit 4
  Uniprot ID: Q15257
  ENST ID: ENST00000357197
  CDS Start-End: 288-1172
gcgcatgcgccccgcgcgccccgcactgacatggccgtcgcccggttccgcgcgtccgccgcgcgccggccgttaataggcttgctccctgagcgccccgcaccgacatggcggccgtcttcgctgtggtgactttaactctcggttttcggttatagccggccggcgctcacttgtcttcaggaagctcggagcctttggtggagccggggagaggaagggtgggtgcaagagtgaaaggcgagaggggactgcaagcatccgggtcggctcctggccggagcaagatggctgagggcgagcggcagccgccgccagattcttcagaggaggcccctccagccactcagaacttcatcattccaaaaaaggagatccacacagttccagacatgggcaaatggaagcgttctcaggccattgagaaactagtcgctcttctcaacacgctggacaggtggattgatgagactcctccagtggaccagccctctcggtttgggaataaggcatacaggacctggtatgccaaacttgatgaggaagcagaaaacttggtggccacagtggtccctacccatctggcagctgctgtgcctgaggtggctgtttacctaaaggagtcagtggggaactccacgcgcattgactacggcacagggcatgaggcagccttcgctgctttcctctgctgtctctgcaagattggggtgctccgggtggatgaccaaatagctattgtcttcaaggtgttcaatcggtaccttgaggttatgcggaaactccagaaaacatacaggatggagccagccggcagccagggagtgtggggtctggatgacttccagtttctgcccttcatctggggcagttcgcagctgatagaccacccatacctggagcccagacactttgtggatgagaaggccgtgaatgagaaccacaaggactacatgttcctggagtgtatcctgtttattaccgagatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcaccgcagggaagggaggagagatacctgctgcttccattgcttttcccttcctggagtcgatgcctttctaagggttggagctgctccttgcaggggcgggtcagtttcccaggccatgccggggtggccatctatggtagggctggaagctgaggctggccgccagctgtgggctggggtggggtgggtggggtcgggtggtggagaggccttagctgtcctggctggtgcccctcccaggctccttttcaccctgccccctgggcctgaggccccctgtgtccaagcctccccctggctcttcagttctctagcccttggctctgctgggtttcctgactgtagccacatctctcccgctccctaagggtaacctagccaatggaagctgccctttgggtaggtgctgggctcctgggagggcccagatgatggggtgaggcatgtctttccagaactttccctggcagggaggggatggcagaaactcagggaggggcttggggcccattgtatctggagagcctggattcctcttggcagtcttaggcccggccacttctgctacctttgcgctgctgtgagcctcaccctgggcccctgggccctgcttctctgctcccctgggtgatgggtgggcccagaaggtggcagtcccacaccttgtcctcccacctccctgaactgtccattgcttttatagggtgaggtaagagacagcctcccaagcccaggctttggcactcagaatgggcccagtgggggctgggcaggcccattgagggccaccgccgaggtttctcctagggctgttcctgggcctggctcttacaggctcgtcccccaggcctgcccttctccactgccccctcctgtgtctgggtccacacacccttcaggaagggggagcactgagaagcacagcacaggggctcagcctgggatccggtgatggtctgggcagaggctgggtcaggagtcccaaaggtcagtgacagtttctcagaagaggcccagcgtccacctctctcccagggccagacagcccttcctggctcccccatccccctatgggctcccagccccttgcaccctcattgctgttcagattaaagcctctgttttgcacctgtc

SEQ ID NO: 171266 - DNA, 2664 bp, Homo sapiens
  Payload ID: 13689
  Gene Symbol: PPP2R4
  Gene Name: protein phosphatase 2A activator, regulatory subunit 4
  Uniprot ID: Q15257
  ENST ID: ENST00000358994
  CDS Start-End: 213-1184
attgagacctgtggaggaggaaggaggaggtcaccgtccagctgtctctcccctgtccccacatgtcttctaagctgttggagccggccggcgctcacttgtcttcaggaagctcggagcctttggtggagccggggagaggaagggtgggtgcaagagtgaaaggcgagaggggactgcaagcatccgggtcggctcctggccggagcaagatggctgagggcgagcggcagccgccgccagattcttcagaggaggcccctccagccactcagaacttcatcattccaaaaaaggagatccacacagttccagacatgggcaaatggaagcgttctcaggcatacgctgactacatcggattcatccttaccctcaacgaaggtgtgaaggggaagaagctgaccttcgagtacagagtctccgaggccattgagaaactagtcgctcttctcaacacgctggacaggtggattgatgagactcctccagtggaccagccctctcggtttgggaataaggcatacaggacctggtatgccaaacttgatgaggaagcagaaaacttggtggccacagtggtccctacccatctggcagctgctgtgcctgaggtggctgtttacctaaaggagtcagtggggaactccacgcgcattgactacggcacagggcatgaggcagccttcgctgctttcctctgctgtctctgcaagattggggtgctccgggtggatgaccaaatagctattgtcttcaaggtgttcaatcggtaccttgaggttatgcggaaactccagaaaacatacaggatggagccagccggcagccagggagtgtggggtctggatgacttccagtttctgcccttcatctggggcagttcgcagctgatagaccacccatacctggagcccagacactttgtggatgagaaggccgtgaatgagaaccacaaggactacatgttcctggagtgtatcctgtttattaccgagatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcaccgcagggaagggaggagagatacctgctgcttccattgcttttcccttcctggagtcgatgcctttctaagggttggagctgctccttgcaggggcgggtcagtttcccaggccatgccggggtggccatctatggtagggctggaagctgaggctggccgccagctgtgggctggggtggggtgggtggggtcgggtggtggagaggccttagctgtcctggctggtgcccctcccaggctccttttcaccctgccccctgggcctgaggccccctgtgtccaagcctccccctggctcttcagttctctagcccttggctctgctgggtttcctgactgtagccacatctctcccgctccctaagggtaacctagccaatggaagctgccctttgggtaggtgctgggctcctgggagggcccagatgatggggtgaggcatgtctttccagaactttccctggcagggaggggatggcagaaactcagggaggggcttggggcccattgtatctggagagcctggattcctcttggcagtcttaggcccggccacttctgctacctttgcgctgctgtgagcctcaccctgggcccctgggccctgcttctctgctcccctgggtgatgggtgggcccagaaggtggcagtcccacaccttgtcctcccacctccctgaactgtccattgcttttatagggtgaggtaagagacagcctcccaagcccaggctttggcactcagaatgggcccagtgggggctgggcaggcccattgagggccaccgccgaggtttctcctagggctgttcctgggcctggctcttacaggctcgtcccccaggcctgcccttctccactgccccctcctgtgtctgggtccacacacccttcaggaagggggagcactgagaagcacagcacaggggctcagcctgggatccggtgatggtctgggcagaggctgggtcaggagtcccaaaggtcagtgacagtttctcagaagaggcccagcgtccacctctctcccagggccagacagcccttcctggctcccccatccccctatgggctcccagccccttgcaccctcattgctgttcagattaaagcctctgttttgcacctgt

SEQ ID NO: 171267 - DNA, 2737 bp, Homo sapiens
  Payload ID: 13689
  Gene Symbol: PPP2R4
  Gene Name: protein phosphatase 2A activator, regulatory subunit 4
  Uniprot ID: Q15257
  ENST ID: ENST00000393370
  CDS Start-End: 284-1255
atgcgccccgcgcgccccgcactgacatggccgtcgcccggttccgcgcgtccgccgcgcgccggccgttaataggcttgctccctgagcgccccgcaccgacatggcggccgtcttcgctgtggtgactttaactctcggttttcggttatagccggccggcgctcacttgtcttcaggaagctcggagcctttggtggagccggggagaggaagggtgggtgcaagagtgaaaggcgagaggggactgcaagcatccgggtcggctcctggccggagcaagatggctgagggcgagcggcagccgccgccagattcttcagaggaggcccctccagccactcagaacttcatcattccaaaaaaggagatccacacagttccagacatgggcaaatggaagcgttctcaggcatacgctgactacatcggattcatccttaccctcaacgaaggtgtgaaggggaagaagctgaccttcgagtacagagtctccgaggccattgagaaactagtcgctcttctcaacacgctggacaggtggattgatgagactcctccagtggaccagccctctcggtttgggaataaggcatacaggacctggtatgccaaacttgatgaggaagcagaaaacttggtggccacagtggtccctacccatctggcagctgctgtgcctgaggtggctgtttacctaaaggagtcagtggggaactccacgcgcattgactacggcacagggcatgaggcagccttcgctgctttcctctgctgtctctgcaagattggggtgctccgggtggatgaccaaatagctattgtcttcaaggtgttcaatcggtaccttgaggttatgcggaaactccagaaaacatacaggatggagccagccggcagccagggagtgtggggtctggatgacttccagtttctgcccttcatctggggcagttcgcagctgatagaccacccatacctggagcccagacactttgtggatgagaaggccgtgaatgagaaccacaaggactacatgttcctggagtgtatcctgtttattaccgagatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcaccgcagggaagggaggagagatacctgctgcttccattgcttttcccttcctggagtcgatgcctttctaagggttggagctgctccttgcaggggcgggtcagtttcccaggccatgccggggtggccatctatggtagggctggaagctgaggctggccgccagctgtgggctggggtggggtgggtggggtcgggtggtggagaggccttagctgtcctggctggtgcccctcccaggctccttttcaccctgccccctgggcctgaggccccctgtgtccaagcctccccctggctcttcagttctctagcccttggctctgctgggtttcctgactgtagccacatctctcccgctccctaagggtaacctagccaatggaagctgccctttgggtaggtgctgggctcctgggagggcccagatgatggggtgaggcatgtctttccagaactttccctggcagggaggggatggcagaaactcagggaggggcttggggcccattgtatctggagagcctggattcctcttggcagtcttaggcccggccacttctgctacctttgcgctgctgtgagcctcaccctgggcccctgggccctgcttctctgctcccctgggtgatgggtgggcccagaaggtggcagtcccacaccttgtcctcccacctccctgaactgtccattgcttttatagggtgaggtaagagacagcctcccaagcccaggctttggcactcagaatgggcccagtgggggctgggcaggcccattgagggccaccgccgaggtttctcctagggctgttcctgggcctggctcttacaggctcgtcccccaggcctgcccttctccactgccccctcctgtgtctgggtccacacacccttcaggaagggggagcactgagaagcacagcacaggggctcagcctgggatccggtgatggtctgggcagaggctgggtcaggagtcccaaaggtcagtgacagtttctcagaagaggcccagcgtccacctctctcccagggccagacagcccttcctggctcccccatccccctatgggctcccagccccttgcaccctcattgctgttcagattaaagcctctgttttgcacctgtca

SEQ ID NO: 171268 - DNA, 618 bp, Homo sapiens
  Payload ID: 13689
  Gene Symbol: PPP2R4
  Gene Name: protein phosphatase 2A activator, regulatory subunit 4
  ENST ID: ENST00000435132
  CDS Start-End: 125-310
gctatttatctgaacccaagtgaatccctgtgctggagaggcgctctgaggctcctggggagtcggtgggaacgacaccagaagctcaggtggagatcttatcttcctgaggctgctggatttgatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactccc

SEQ ID NO: 171269 - DNA, 532 bp, Homo sapiens
  Payload ID: 13689
  Gene Symbol: PPP2R4
  Gene Name: protein phosphatase 2A activator, regulatory subunit 4
  ENST ID: ENST00000436883
  CDS Start-End: 145-270
agatttcagctggaagggaaggagctgacaggaaggcgctgtgcagagcctccccacccccgcccatccccccagttactgacagaggagccatttacaaaaggccgattctctggggagtggagaggcaggaacgcagcgtctatgaagactggcccatttgcagagcactccaaccagctgtggaacatcagcgccgtcccttcctggtccaaagtgaaccagggtctcatccgcatgtataaggccgaggctggcccttgtgactagttcatggcctcagacactgtactgtgggcaccatctcttgactcctggccggccttctcttctgggaaggggctgctccaggtcttcattggacccagagcttcctggatcccatcagcagaggcgggacaacggggaagggtgccagaggccagcggggtgggggagcacagatgcttccagttggcttggctccctgcacttggtcctgaaggggttaatgaggcttgaactgaacagaccgggccctcactcccttccg

SEQ ID NO: 171270 - DNA, 548 bp, Homo sapiens
  Payload ID: 13689
  Gene Symbol: PPP2R4
  Gene Name: protein phosphatase 2A activator, regulatory subunit 4
  ENST ID: ENST00000453358
  CDS Start-End: 161-548
gtgggagtccaggctgcccgaatgctgggtgggcagcgccgtggtcataagggggccttttgcatctctgggcagcgcgtgcttaaattcttcagaggaggcccctccagccactcagaacttcatcattccaaaaaaggagatccacacagttccagacatgggcaaatggaagcgttctcaggcatacgctgactacatcggattcatccttaccctcaacgaaggtgtgaaggggaagaagctgaccttcgagtacagagtctccgaggccattgagaaactagtcgctcttctcaacacgctggacaggtggattgatgagactcctccagtggaccagccctctcggtttgggaataaggcatacaggacctggtatgccaaacttgatgaggaagcagaaaacttggtggccacagtggtccctacccatctggcagctgctgtgcctgaggtggctgtttacctaaaggagtcagtggggaactccacgcgcattgactacggcacagggcatgaggcagccttcgctgctttcctctgct

SEQ ID NO: 171271 - DNA, 530 bp, Homo sapiens
  Payload ID: 13689
  Gene Symbol: PPP2R4
  Gene Name: protein phosphatase 2A activator, regulatory subunit 4
  ENST ID: ENST00000435305
  CDS Start-End: 35-490
ctctggggagtggagaggcaggaacgcagcgtctatgaagactggcccatttgcagagcactccaaccagctgtggaacatcagcgccgtcccttcctggtccaaagtgaaccagggtctcatccgcatgtataaggccgaggtgagtgggggctggccagtgtgcccgtccctgctgccgcacttggtcctgggctggggacaaagcaaaagatgtggaacctggggctcctgcttcctcctaccccactgttttgctctgaatcttaggccagcccctctgacacttggggcctcggaatctcccatctggggcatgggcagtcagagaagcaccagccaccccagccccgaaaagctgcagtccagctctgtcctgatgagcttggaggctgaggcaaggacctgctgcatggggagtgggggcgatgggggcctcccttctcctttatcaagtggccaaaggctcctcaaagctcgggcagtctgagtctggctctcccatggcatacctgggaagggtcttaccc

SEQ ID NO: 171272 - DNA, 490 bp, Homo sapiens
  Payload ID: 13689
  Gene Symbol: PPP2R4
  Gene Name: protein phosphatase 2A activator, regulatory subunit 4
  ENST ID: ENST00000440346
  CDS Start-End: 299-490
cttctgcctcagcctcccaagtagctgggaccgcaggcgcccgccaccacgcctggctaatttttttgtacttttttagtagagatgggatttcaccatgttagccaggatggtctcgatctccttaccttgtgatctgcctgccttggcctcccaaagtgctgggattacaggcgtgagccaccgcacctgacctgtttttttttcttctgtgaattgcctgtattcttcagaggaggcccctccagccactcagaacttcatcattccaaaaaaggagatccacacagttccagacatgggcaaatggaagcgttctcaggcatacgctgactacatcggattcatccttaccctcaacgaaggtgtgaaggggaagaagctgaccttcgagtacagagtctccgaggccattgagaaactagtcgctcttctcaacacgctggacaggtggattgatgagactcctccagtggaccagccctctcgg

SEQ ID NO: 171273 - DNA, 952 bp, Homo sapiens
  Payload ID: 13689
  Gene Symbol: PPP2R4
  Gene Name: protein phosphatase 2A activator, regulatory subunit 4
  ENST ID: ENST00000419582
  CDS Start-End: 274-459
cctggagggtcagactctttggcaagagggaggaccaggaatggagccgtccttgtgcctgcctctttcagctgctgtggcggccaccccttccccacctcctggccaggccaggctggctgctgcttcaggcacccctgcctcccatcggccctctcttccctgcctgcatggcaggcagagggctgtcggatacctgggtttggtcatacccaccttggtcctcttgcaaattgaccctttcctcatctcttctagctctgctggtggcagatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcaccgcagggaagggaggagagatacctgctgcttccattgcttttcccttcctggagtcgatgcctttctaagggttggagctgctccttgcaggggcgggtcagtttcccaggccatgccggggtggccatctatggtagggctgg

SEQ ID NO: 171274 - DNA, 2526 bp, Homo sapiens
  Payload ID: 13689
  Gene Symbol: PPP2R4
  Gene Name: protein phosphatase 2A activator, regulatory subunit 4
  ENST ID: ENST00000452489
  CDS Start-End: 179-1045
gtgtgggaggctcaggagggcgagagtcatgacacggaggaactggaggggcaaaagctgaggggccccgaggagggactgagttgaatggccttaggggagagattcttcagaggaggcccctccagccactcagaacttcatcattccaaaaaaggagatccacacagttccagacatgggcaaatggaagcgttctcaggcatacgctgactacatcggattcatccttaccctcaacgaaggtgtgaaggggaagaagctgaccttcgagtacagagtctccgaggccattgagaaactagtcgctcttctcaacacgctggacaggtggattgatgagactcctccagtggaccagccctctcggtttgggaataaggcatacaggacctggtatgccaaacttgatgaggaagcagaaaacttggtggccacagtggtccctacccatctggcagctgctgtgcctgaggtggctgtttacctaaaggagtcagtggggaactccacgcgcattgactacggcacagggcatgaggcagccttcgctgctttcctctgctgtctctgcaagattggggtgctccgggtggatgaccaaatagctattgtcttcaaggtgttcaatcggtaccttgaggttatgcggaaactccagaaaacatacaggatggagccagccggcagccagggagtgtggggtctggatgacttccagtttctgcccttcatctggggcagttcgcagctgatagaccacccatacctggagcccagacactttgtggatgagaaggccgtgaatgagaaccacaaggactacatgttcctggagtgtatcctgtttattaccgagatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcaccgcagggaagggaggagagatacctgctgcttccattgcttttcccttcctggagtcgatgcctttctaagggttggagctgctccttgcaggggcgggtcagtttcccaggccatgccggggtggccatctatggtagggctggaagctgaggctggccgccagctgtgggctggggtggggtgggtggggtcgggtggtggagaggccttagctgtcctggctggtgcccctcccaggctccttttcaccctgccccctgggcctgaggccccctgtgtccaagcctccccctggctcttcagttctctagcccttggctctgctgggtttcctgactgtagccacatctctcccgctccctaagggtaacctagccaatggaagctgccctttgggtaggtgctgggctcctgggagggcccagatgatggggtgaggcatgtctttccagaactttccctggcagggaggggatggcagaaactcagggaggggcttggggcccattgtatctggagagcctggattcctcttggcagtcttaggcccggccacttctgctacctttgcgctgctgtgagcctcaccctgggcccctgggccctgcttctctgctcccctgggtgatgggtgggcccagaaggtggcagtcccacaccttgtcctcccacctccctgaactgtccattgcttttatagggtgaggtaagagacagcctcccaagcccaggctttggcactcagaatgggcccagtgggggctgggcaggcccattgagggccaccgccgaggtttctcctagggctgttcctgggcctggctcttacaggctcgtcccccaggcctgcccttctccactgccccctcctgtgtctgggtccacacacccttcaggaagggggagcactgagaagcacagcacaggggctcagcctgggatccggtgatggtctgggcagaggctgggtcaggagtcccaaaggtcagtgacagtttctcagaagaggcccagcgtccacctctctcccagggccagacagcccttcctggctcccccatccccctatgggctcccagccccttgcaccctcattgctgttcagattaaagcctctgttttgcacctgtc

SEQ ID NO: 171275 - DNA, 949 bp, Homo sapiens
  Payload ID: 13689
  Gene Symbol: PPP2R4
  Gene Name: protein phosphatase 2A activator, regulatory subunit 4
  ENST ID: ENST00000455292
  CDS Start-End: 199-949
aggaggaaggaggaggtcaccgtccagctgtctctcccctgtccccacatgtcttctaagctgttggagccggccggcgctcacttgtcttcaggaagctcggagcctttggtggagccggggagaggaagggtgggtgcaagagtgaaaggcgagaggggactgcaagcatccgggtcggctcctggccggagcaagatggctgagggcgagcggcagccgccgccagattcttcagaggaggcccctccagccactcagaacttcatcattccaaaaaaggagatccacacagttccagacatgggcaaatggaagcgttctcaggcatacgctgactacatcggattcatccttaccctcaacgaaggtgtgaaggggaagaagctgaccttcgagtacagagtctccgagatgtggaatgaggttcatgaggaaaaggagcaggctgcaaagcagagtgtgtcctgcgatgaatgcataccattaccccgcgccgggcactgtgcaccttcggaggccattgagaaactagtcgctcttctcaacacgctggacaggtggattgatgagactcctccagtggaccagccctctcggtttgggaataaggcatacaggacctggtatgccaaacttgatgaggaagcagaaaacttggtggccacagtggtccctacccatctggcagctgctgtgcctgaggtggctgtttacctaaaggagtcagtggggaactccacgcgcattgactacggcacagggcatgaggcagccttcgctgctttcctctgctgtctctgcaagattggggtgctccgggtggatgaccaaatagctattgtcttcaaggtgttcaatcggtaccttgaggttatgcggaaactccagaaaacatacaggatggagccagccggcagccagggagtgtggggtctggatgacttcc

SEQ ID NO: 171276 - DNA, 645 bp, Homo sapiens
  Payload ID: 13689
  Gene Symbol: PPP2R4
  Gene Name: protein phosphatase 2A activator, regulatory subunit 4
  ENST ID: ENST00000455240
  CDS Start-End: 1-361
gtaccttgaggttatgcggaaactccagaaaacatacaggatggagccagccggcagccagggagtgtggggtctggatgacttccagtttctgcccttcatctggggcagttcgcagctgatagaccacccatacctggagcccagacactttgtggatgagaaggccgtgaatgagaaccacaaggactacatgttcctggagtgtatcctgtttattaccgaggtgaggaggaggggtgagagagaagcccatggctgcctccaggctcagatgaaccaaggctggtggccttacagtggatcagaagagccagagctgctgcccaaaatggcagggccggccggagcgggttattgaaaaggaagcaccactgggcctcttccgaaagagccgctgctgactgtcaggtcctccgcccagttctccttcagtttctcctgaacaccacaggagtcttgagatgagggtctaagacttggtcactaactggccttggtgactgctgcagcaggtctgaaagggtcggggcgggcggaggtttgtgggggagggtcagcatctttcggtggggccccacaagggtctgtagaaccatgtgctgtggatgtgtaaaatgaaaccaccagaggagatggagcgaa

SEQ ID NO: 171277 - DNA, 681 bp, Homo sapiens
  Payload ID: 13689
  Gene Symbol: PPP2R4
  Gene Name: protein phosphatase 2A activator, regulatory subunit 4
  ENST ID: ENST00000414331
  CDS Start-End: 285-681
cgctgtggtgactttaactctcggttttcggttatagccggccggcgctcacttgtcttcaggaagctcggagcctttggtggagccggggagaggaagggtgggtgcaagagtgaaaggcgagaggggactgcaagcatccgggtcggctcctggccggagcaagatggctgagggcgagcggcagccgccgccaggcatacgctgactacatcggattcatccttaccctcaacgaaggtgtgaaggggaagaagctgaccttcgagtacagagtctccgagatgtggaatgaggttcatgaggaaaaggagcaggctgcaaagcagagtgtgtcctgcgatgaatgcataccattaccccgcgccgggcactgtgcaccttcggaggccattgagaaactagtcgctcttctcaacacgctggacaggtggattgatgagactcctccagtggaccagccctctcggtttgggaataaggcatacaggacctggtatgccaaacttgatgaggaagcagaaaacttggtggccacagtggtccctacccatctggcagctgctgtgcctgaggtggctgtttacctaaaggagtcagtggggaactccacgcgcattgactacggcacagggcatgaggcagccttcgctgctttcctctgctgtctctgcaagattg

SEQ ID NO: 171278 - DNA, 567 bp, Homo sapiens
  Payload ID: 13689
  Gene Symbol: PPP2R4
  Gene Name: protein phosphatase 2A activator, regulatory subunit 4
  ENST ID: ENST00000417504
  CDS Start-End: 39-567
agagtctcgttctgttgtccaggctggagtgcagtggtatgatctcagctcactgcaacccccacctcctggactcaggtgatcctcctgcttcagcctcccaagtagctgggactacagattcttcagaggaggcccctccagccactcagaacttcatcattccaaaaaaggagatccacacagttccagacatgggcaaatggaagcgttctcaggtaccatttggaactgtggcatacgctgactacatcggattcatccttaccctcaacgaaggtgtgaaggggaagaagctgaccttcgagtacagagtctccgaggccattgagaaactagtcgctcttctcaacacgctggacaggtggattgatgagactcctccagtggaccagccctctcggtttgggaataaggcatacaggacctggtatgccaaacttgatgaggaagcagaaaacttggtggccacagtggtccctacccatctggcagctgctgtgcctgaggtggctgtttacctaaaggagtcagtggggaactccacgcgcattgactacggcacag

SEQ ID NO: 171279 - DNA, 967 bp, Homo sapiens
  Payload ID: 13689
  Gene Symbol: PPP2R4
  Gene Name: protein phosphatase 2A activator, regulatory subunit 4
  ENST ID: ENST00000417728
  CDS Start-End: 179-967
gtgtgggaggctcaggagggcgagagtcatgacacggaggaactggaggggcaaaagctgaggggccccgaggagggactgagttgaatggccttaggggagagattcttcagaggaggcccctccagccactcagaacttcatcattccaaaaaaggagatccacacagttccagacatgggcaaatggaagcgttctcaggcatacgctgactacatcggattcatccttaccctcaacgaaggtgtgaaggggaagaagctgaccttcgagtacagagtctccgaggccattgagaaactagtcgctcttctcaacacgctggacaggtggattgatgagactcctccagtggaccagccctctcggtttgggaataaggcatacaggacctggtatgccaaacttgatgaggaagcagaaaacttggtggccacagtggtccctacccatctggcagctgctgtgcctgaggtggctgtttacctaaaggagtcagtggggaactccacgcgcattgactacggcacagggcatgaggcagccttcgctgctttcctctgctgtctctgcaagattggggtgctccgggtggatgaccaaatagctattgtcttcaaggtgttcaatcggtaccttgaggttatgcggaaactccagaaaacatacaggatggagccagccggcagccagggagtgtggggtctggatgacttccagtttctgcccttcatctggggcagttcgcagctgatagaccacccatacctggagcccagacactttgtggatgagaaggccgtgaatgagaaccacaaggactacatgttcctggagtgtatcctgtttattaccgagatgaagactggcccatttgcagagcactccaaccagctgtggaacatcagcgccgtcccttcctggtccaaagtgaaccagggtctcatccgcatgtataaggccgag

SEQ ID NO: 171280 - DNA, 738 bp, Homo sapiens
  Payload ID: 13689
  Gene Symbol: PPP2R4
  Gene Name: protein phosphatase 2A activator, regulatory subunit 4
  ENST ID: ENST00000411917
  CDS Start-End: 1-656
agaaaacatacaggatggagccagccggcagccagggagtgtggggtctggatgacttccagtttctgcccttcatctggggcagttcgcagctgatagaccacccatacctggagcccagacactttgtggatgagaaggccgtgaatgagaaccacaaggactacatgttcctggagtgtatcctgtttattaccgagatgaagactggcccatttgcagagcactccaaccagctgtggaacatcagcgccgtcccttcctggtccaaagtgaaccagggtctcatccgcatgtataaggccgaggtgagtgggggctggccagtgtgcccgtccctgctgccgcacttggtcctgggctggggacaaagcaaaagatgtggaacctggggctcctgcttcctcctaccccactgttttgctctgaatcttaggccagcccctctgacacttggggcctcggaatctcccatctggggcatgggcagtcagagaagcaccagccaccccagccccgaaaagctgcagtccagctctgtcctgatgagcttggaggctgaggcaaggacctgctgcatggggagtgggggcgatgggggcctcccttctcctttatcaagtggccaaaggctcctcaaagctcgggcagtctgagtctggctctcccatggcatacctgggaagggtcttaccctttggaggcatctccaaagtgctgccttcaaatgttagtgtg

SEQ ID NO: 171281 - DNA, 949 bp, Homo sapiens
  Payload ID: 13689
  Gene Symbol: PPP2R4
  Gene Name: protein phosphatase 2A activator, regulatory subunit 4
  ENST ID: ENST00000445241
  CDS Start-End: 189-949
gcaccgacatggcggccgtcttcgctgtggtgactttaactctcggttttcggttatagccggccggcgctcacttgtcttcaggaagctcggagcctttggtggagccggggagaggaagggtgggtgcaagagtgaaaggcgagaggggactgcaagcatccgggtcggctcctggccggagcaagatggctgagggcgagcggcagccgccgccagattcttcagaggaggcccctccagccactcagaacttcatcattccaaaaaaggagatccacacagttccagacatgggcaaatggaagcgttctcaggcatacgctgactacatcggattcatccttaccctcaacgaaggtgtgaaggggaagaagctgaccttcgagtacagagtctccgagatgtggaatgaggttcatgaggaaaaggagcaggctgcaaagcagagtgtgtcctgcgatgaatgcataccattaccccgcgccgggcactgtgcaccttcggaggccattgagaaactagtcgctcttctcaacacgctggacaggtggattgatgagactcctccagtggaccagccctctcggtttgggaataaggcatacaggacctggtatgccaaacttgatgaggaagcagaaaacttggtggccacagtggtccctacccatctggcagctgctgtgcctgaggtggctgtttacctaaaggagtcagtggggaactccacgcgcattgactacggcacagggcatgaggcagccttcgctgctttcctctgctgtctctgcaagattggggtgctccgggtggatgaccaaatagctattgtcttcaaggtgttcaatcggtaccttgaggttatgcggaaactccagaaaacatacaggatggagccagccggcagccagggagtgtggggtctggatgacttccagtttctgcc

SEQ ID NO: 171282 - DNA, 988 bp, Homo sapiens
  Payload ID: 13689
  Gene Symbol: PPP2R4
  Gene Name: protein phosphatase 2A activator, regulatory subunit 4
  ENST ID: ENST00000423100
  CDS Start-End: 269-454
gaaggaacagggaggggagggcgtgcctagagttgttggctgttccgcaccttctccacaggtccgggttttcactttgggtctaggctcttgggcatggtgttcaacagtagaccctaggaggagtgtgcccaggagccggggtggctgcagcaagggcccatcttgccacgtggccgctggttgcagcacacgttgtgttggttctccagagcgcccaccctcttccacctcggagcagtgagcagcattttgcagtccctagttgatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcaccgcagggaagggaggagagatacctgctgcttccattgcttttcccttcctggagtcgatgcctttctaagggttggagctgctccttgcaggggcgggtcagtttcccaggccatgccggggtggccatctatggtagggctggaagctgaggctggccgccagctgtgggctggggtggggtgg

SEQ ID NO: 171283 - DNA, 1153 bp, Homo sapiens
  Payload ID: 13689
  Gene Symbol: PPP2R4
  Gene Name: protein phosphatase 2A activator, regulatory subunit 4
  ENST ID: ENST00000414510
  CDS Start-End: 145-330
agatttcagctggaagggaaggagctgacaggaaggcgctgtgcagagcctccccacccccgcccatccccccagttactgacagaggagccatttacaaaaggccgattctctggggagtggagaggcaggaacgcagcgtctatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcaccgcagggaagggaggagagatacctgctgcttccattgcttttcccttcctggagtcgatgcctttctaagggttggagctgctccttgcaggggcgggtcagtttcccaggccatgccggggtggccatctatggtagggctggaagctgaggctggccgccagctgtgggctggggtggggtgggtggggtcgggtggtggagaggccttagctgtcctggctggtgcccctcccaggctccttttcaccctgccccctgggcctgaggccccctgtgtccaagcctccccctggctcttcagttctctagcccttggctctgctgggtttcctgactgtagccacatctctcccgctccctaagggtaacctagccaatggaagctgccctttgggtaggtgctgggctcctgggagggcccagatgatggggtgaggcatgtctttccagaactttccctggcagggaggg

SEQ ID NO: 171284 - DNA, 870 bp, Homo sapiens
  Payload ID: 13689
  Gene Symbol: PPP2R4
  Gene Name: protein phosphatase 2A activator, regulatory subunit 4
  ENST ID: ENST00000434095
  CDS Start-End: 154-339
gctggagaggcgctctgaggctcctggggagtcggtgggaacgacaccagaagctcaggtggagatcttatcttcctgaggctgctggatttggtgggcgataggaatcaggccccctttttttggctgtgggagaaagaggggtgactgcggatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcaccgcagggaagggaggagagatacctgctgcttccattgcttttcccttcctggagtcgatgcctttctaagggttggagctgctccttgcaggggcgggtcagtttcccaggccatgccggggtggccatctatggtagggctggaagctgaggctggccgccagctgtgggctggggtgggg

SEQ ID NO: 171285 - DNA, 567 bp, Homo sapiens
  Payload ID: 13689
  Gene Symbol: PPP2R4
  Gene Name: protein phosphatase 2A activator, regulatory subunit 4
  ENST ID: ENST00000432124
  CDS Start-End: 53-286
atttacaaaaggccgattctctggggagtggagaggcaggaacgcagcgtctatgaagactggcccatttgcagagcactccaaccagctgtggaacatcagcgccgtcccttcctggtccaaagtgaaccagggtctcatccgcatgtataaggccgaggccagcccctctgacacttggggcctcggaatctcccatctggggcatgggcagtcagagaagcaccagccaccccagccccgaaaagctgcagtccagctctgtcctgatgagcttggaggctgaggcaaggacctgctgcatggggagtgggggcgatgggggcctcccttctcctttatcaagtggccaaaggctcctcaaagctcgggcagtctgagtctggctctcccatggcatacctgggaagggtcttaccctttggaggcatctccaaagtgctgccttcaaatgttagtgtgtatgatcactgagtggtgggaggtctgagggtaggccgagaattggcatttttatggaccgcttcagggattttgatgcaaatggttttccctgctctcaaatca

SEQ ID NO: 171286 - DNA, 857 bp, Homo sapiens
  Payload ID: 13689
  Gene Symbol: PPP2R4
  Gene Name: protein phosphatase 2A activator, regulatory subunit 4
  ENST ID: ENST00000432651
  CDS Start-End: 130-315
agagggggtgggcctggaggggtggggcctagctgctgctgctatttatctgaacccaagtgaatccctgtgctggagaggcgctctgaggctcctggggagtcggtgggaacgacaccagaagctcagatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcaccgcagggaagggaggagagatacctgctgcttccattgcttttcccttcctggagtcgatgcctttctaagggttggagctgctccttgcaggggcgggtcagtttcccaggccatgccggggtggccatctatggtagggctggaagctgaggctggccgccagctgtgggctggggtggggtgggtggggtc

SEQ ID NO: 171287 - DNA, 1602 bp, Homo sapiens
  Payload ID: 13690
  Gene Symbol: PP2D1
  Gene Name: protein phosphatase 2C-like domain containing 1
  Uniprot ID: A8MPX8
  ENST ID: ENST00000333083
  CDS Start-End: 196-1326
aacattccacacagggagctctaccatcaagtgaggggaatgcccaccatcgctatcatcaccatcaccactacttctgccacagccatcacattcacctctacctccaccatcaccatcactactcaagttggagaaatagaggccaggggaaggggataaagggagggcaaagaaaggtaattccaaaggaacatgagcaccaataatgctttaagagtgttttggaaatcaagagaatggaatatgaaaacatcaacatttgattcagatgaggatattctacttttacccaaaagaaaacgttttagaaagaaaaagtcaagaccagtgagacacaccaaacgccatgaagaggagcaggtctatgagcaagggaccacattaccctgttccatatgcaagcacgaaattgacctaactggtatttttctccataagaagcaacatgtagctctggccacgctgggtttccaatggatgggtagaaagaaaccacagccctcagtgattgctgttcagagacagttcatgatttctaaactattgtcatcttttatgttcactgaaaaaaccctacagagcattaataatgcttttgagctgctttggaaaaaacaaataccagcatactataagatttttgataacattgacaggagtgtcatatattctcaaaaaatatgtcatctgttaattaaaggagtgggcatttgtgaagacaggaattctacatggaaagctgacatgaatgataaattcactgtagtgagtaattttggtaacaaacctaatgtgtgtttttttggtttgtttgatggacatcacggtgcctcagcggcagagttgacatcaatggaactcccagttttacttctccatcagctttccaaatttgatccttcttaccaaatgacaactgatgagcaacaaataatcaattccttttacactgtgtttagagaagaatacgcagcaatagaagacctcttttctgccataaacaaaacagaagcagtgaggtgtgagtatgaggacacacacaaagcctttgcaaaagcattttggagaatggataggcttttaggtcttggaagaaaagaagtgtccagggttcaatggagtggctgctctgcagttacttgtatattggaaggcaaacctaaaagtccttatgctcataagaattggaaaagaaaaaatacccatgatgggttggcagagagctccccttcccaggagatgccaaaaataatttctggaatattacatgttgcaaacactggtaccaggagaaatgaacatttgcctgaatactatggctaagcatcataaataactttagaatctccttctaaacaaagaatgtttttgaaaagcccaaattaatgtgattctgggtgtcatctgtcacatttgtaaaatgagtatattatcacacaatccttcgcaactgtgccagcacttccctagcaaactgcaaacttgagtttttcaggaaaacagtttacatgagaaaaggcaagttctttcccatttcgaatgaagtaccattaaactctgtcacctagtgaaaaataataaaaatacttgcaactttta

SEQ ID NO: 171288 - DNA, 2151 bp, Homo sapiens
  Payload ID: 13690
  Gene Symbol: PP2D1
  Gene Name: protein phosphatase 2C-like domain containing 1
  Uniprot ID: A8MPX8
  ENST ID: ENST00000389050
  CDS Start-End: 259-2151
attgcttcacagtccttctgaatcataaagtgagttctgactgaggttccaggtgatgtagtgaacattccacacagggagctctaccatcaagtgaggggaatgcccaccatcgctatcatcaccatcaccactacttctgccacagccatcacattcacctctacctccaccatcaccatcactactcaagttggagaaatagaggccaggggaaggggataaagggagggcaaagaaaggtaattccaaaggaacatgagcaccaataatgctttaagagtgttttggaaatcaagagaatggaatatgaaaacatcaacatttgattcagatgaggatattctacttttacccaaaagaaaacgttttagaaagaaaaagtcaagaccagtgagacacaccaaacgccatgaagaggagcaggtctatgagcaagggaccacattaccctgttccatatgcaagcacgaaattgacctaactggtatttttctccataagaagcaacatgtagctctggccacgctgggtttccaatggatgggtagaaagaaaccacagccctcagtgattgctgttcagagacagttcatgatttctaaactattgtcatcttttatgttcactgaaaaaaccctacagagcattaataatgcttttgagctgctttggaaaaaacaaataccagcatactataagatttttgataacattgacaggagtgtcatatattctcaaaaaatatgtcatctgttaattaaaggagtgggcatttgtgaagacaggaattctacatggaaagctgacatgaatgataaattcactgtagtgagtaattttggtaacaaacctaatgtgtgtttttttggtttgtttgatggacatcacggtgcctcagcggcagagttgacatcaatggaactcccagttttacttctccatcagctttccaaatttgatccttcttaccaaatgacaactgatgagcaacaaataatcaattccttttacactgtgtttagagaagaatacgcagcaatagaagacctcttttctgccataaacaaaacagaagcagtgaggtgtgagtatgaggacacacacaaagcctttgcaaaagcattttggagaatggataggcttttaggtcttggaagaaaagaagtgtccagggttcaatggagtggctgctctgcagttacttgtatattggaaggcaaacctaaaagtccttatgctcataagaattggaaaagaaaaaatacccatgatgggttggcagagagctccccttcccaggagatgccaaaaataatttctggaatattacatgttgcaaacactggtaatgtgcaagcagtcttatgcagaaatgggaaaggtttttgcctaaccaaagaacatactacacgaaacacaaatgaaagaagaagaatacttcagaatggagcagtcattagttcaaatgaaccatacgggcttgtagaggggcaagtaaaaactacacgaggacttggatttcatggaaatctcaagctgaaaaaatccattatcccagcacctcaaactatttctgtccctatagatgacctatgtcaattccttattgtagctactaatggactttgggaagttttggataaagaggaagttactgccctggcaatgacaacatttcacatgtataaagaaacatactgtcctatcatacctaacaaatcaccatccaaagggcctctgcttttttcaaccagtgaaccaaaccttactaaatcacagagtaatatccacgtattgtttcagtataaatctgtatctgaagtacgtgtgtcaactacaaattccaaagaaaatttatccgattcaaactattctaaatactgtatttataaccctgagaatgtagaaacatttccagcagaaacgactcatcgtaaaccttgcagtgaaaaagtaactgacagaccaactagtgtaaatgatgtggcaacaaatgaaaaagaatcagacactaagagtttctatgaaggcgcagctgagtatgttagccatgaacttgtaaatgctgctttactggctggctccagagacaacattacagttatggtaatatttctcaatggaagtgaatatcagcttctgacataa

SEQ ID NO: 171289 - DNA, 4519 bp, Homo sapiens
  Payload ID: 13691
  Gene Symbol: PPP3CA
  Gene Name: protein phosphatase 3, catalytic subunit, alpha isozyme
  Uniprot ID: Q08209
  ENST ID: ENST00000323055
  CDS Start-End: 676-2085
aggagcggcgcggggaggcagaggcgagcgcgggcgatcgcggcggcgggacgtctccggcggccgcggcaccagcggcggcgctctgtgtggagaagcaggggcagcggcagcagcaacagcggcagcggcagcagcagcggcagcagcggcggccgcctctccgccgccggggacgccaaggtgcggctggtggcactgacatcggcggccctgcctctcctccctcgcccccggccttccccatgtgatcggtcttaatcctggccgtgtgtgcgcgcgtggggctccattccgcggtgctgggtctccgtgccggggtgggtgctcgtgtgtgcgcttctcctccccatcccccttcccccaagaataaaagaagaaccgggaggcgtgctcagaaaataaataaataaccaccacacacgcgcagcccggagcgagtcggcggggctggcggcagcggcggaggaggagtgaaggcggcggcggcggaggagggacgcgcggaaaaggcagcaactttaaagccagctcagagcctagacctccagccgagcggtttgcagcgcggcggcggcggcggcggcggcggcgttgagtgtctggcccgccggtccggtcggggtgtgcagtcggacggacgagcagcgcgtcgctgtcctccggcagctggagatgtccgagcccaaggcaattgatcccaagttgtcgacgaccgacagggtggtgaaagctgttccatttcctccaagtcaccggcttacagcaaaagaagtgtttgataatgatggaaaacctcgtgtggatatcttaaaggcgcatcttatgaaggagggaaggctggaagagagtgttgcattgagaataataacagagggtgcatcaattcttcgacaggaaaaaaatttgctggatattgatgcgccagtcactgtttgtggggacattcatggacaattctttgatttgatgaagctctttgaagtcgggggatctcctgccaacactcgctacctcttcttaggggactatgttgacagagggtacttcagtattgaatgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgcctttgactgccttcccctggctgccctgatgaaccaacagttcctgtgtgtgcatggtggtttgtctccagagattaacactttagatgatatcagaaaattagaccgattcaaagaaccacctgcatatggacctatgtgtgatatcctgtggtcagaccccctggaagattttggaaatgagaagactcaggaacatttcactcacaacacagtcagggggtgttcatacttctacagttacccggctgtatgtgaattcttacagcacaataacttgttatctatactccgagcccacgaagcccaagatgcagggtaccgcatgtacaggaaaagccaaacaacaggcttcccttctctaattacaattttttcagcaccaaattacttagatgtatacaataacaaagtgactgagatgctggtaaatgtcctcaacatctgctcagatgatgaactagggtcagaagaagatggatttgatggtgcaacagctgcagcccggaaagaggtgataaggaacaagatccgagcaataggcaaaatggccagagtgttctcagtgctcagagaagagagtgagagtgtgctgacgctgaaaggcttgaccccaactggcatgctccccagcggagtactttctggagggaagcaaaccctgcaaagcgctatcaaaggattttcaccacaacataagatcactagcttcgaggaagccaagggcttagaccgaattaatgagaggatgccgcctcgcagagatgccatgccctctgacgccaaccttaactccatcaacaaggctctcacctcagagactaacggcacggacagcaatggcagtaatagcagcaatattcagtgaccacttcctgttcactttttttttttttttttttttttttttttgagctgcggggcatgatggggattgctgcatatcagcagttggatgttcttgcctctgacagtagcttatttgctctgggggccaggaattggattcagtttacactatcattaaaaaagagggagagagataataaactatattttggtggggatggtgattaaacacctcttttgggtatgccttttaaaaatgcttatagagaaaaaaaattttaaaaagaaagctaatgctagtatatactgcaatgttaggggaatgaacatgttttcctactgcattggggacttctagataggttaatgaaaggccttttattctgttactggacatgaaaactttgtctaatttcttactctattgtacgtttacagtcgcagcactaaaaatggatgacatcaaacatttttaacaaaatgatgtacaaactaaggactatttattgataatgttttgctactcttgtcagacaatggctataaactgaattaggcagtcttaaaaaaaaaaaaaaacagaaaaagaaaaaaaagaacgttgcaaatttgttaaaatgccaaaaaggacagtttaattttgtacagattatgcttacctcaggtttctttagtgtgcttgaatgcccttctttccatataacacttatcttcttcttaattcggcaatggaatatcttttaagttttaaaaaaactggaataattatatctatcttttttgccgtttatatttaggggtttttgttgataaaatcaagtcttggttgtggcttgctgaattaaatatttatgagtggtgcatttttaagtatagtgaacaagacaccatattaagtacagtgataaagcatctatattctgtaaaaaaaaaaaaaatctgcctatgcatgttttttaagaaaaaaaaaatggctgtatcggcctgtatgggactgtaatgcgcttagtggtctgacatatactggaaatgtatgtatactggcgtactttatattctctaaaatgcttaatgcctttgaaattttgtaatcaaaaaaaagctttgaaaaaatctaaaggggagagtattctttaaagtttttaacataagcttgtcaatgcacatgtagatggttagcatgtttagcaaaccttgtgaaattataataagtttgtagttacatgtgaaactctaaatgcatggcaactgttaatgtcataacagtttagttattttgttctgttctgtcatgtgccacaaaatatgtacttttttcacttttttccctttgtatatcagttacgggttacaactggttcattctgaaaacaacaacaacaaaagtccattcatattttttaacaattgtataagtgcccaagtaattcactacagcctaaagccttgcctttgtaatttgacttctgacatgttggcaatcaaagcatgcacttgtaacaatgaaaaagaaaaagcattttatattactactcaataaaatgtgcatgaacttacagaattctcatccttccactgagtccgctgaagggatttatgtgcacaaccaccatgtgtcttctaggtgctggcccaccaccacacatcacaggctgatttccacaggcttcttcctaggggcctcgtgatctgaggggtggtgcctacttccactgtaagaaagaatcttggtggatttgtgtctcaaatcagataagagaagcctgtttaaagagcagatgccatcttctggcttcctcaaggagccagttaaaaaaccagagcattcctttttattgaaaaataaaattaatttgttatcaggttgtttcagttgtattggatgccctatctatctgctaaagcaaaaagtactaggctactaagtgcattttcatcacagaaaagagttgcatttgtattaacaagaaatttgtatacccacgcttcagctactatctaatcatcacccgaagatttaagatacaccaaatttcagtttgtttgtaacattgttcatctttagtgcactttgttttatataataaagtatgcctgttatattaaataataagaatatggcaattagcgatatagcatacccaaacaaagatgttctcgatacagtctggcaaagactatcccaaggttattttaatgaattcagacattttttcctgtggatatttctccatcctaaaaaaagtggcaaccaaggaaaatatttagatgcaacttactagagtgatgatgtgaaagaaatggtgattctggtatcatggtgtttattttctttcttataactgcagagaaaatatcctgactaaaaaaaattcatttttttggattcctttcttttacaaattgtgctgaggcaactatggcatagaaataaacatttgacattaaaataa

SEQ ID NO: 171290 - DNA, 3604 bp, Homo sapiens
  Payload ID: 13691
  Gene Symbol: PPP3CA
  Gene Name: protein phosphatase 3, catalytic subunit, alpha isozyme
  Uniprot ID: Q08209
  ENST ID: ENST00000394853
  CDS Start-End: 532-2067
agcagcggcggccgcctctccgccgccggggacgccaaggtgcggctggtggcactgacatcggcggccctgcctctcctccctcgcccccggccttccccatgtgatcggtcttaatcctggccgtgtgtgcgcgcgtggggctccattccgcggtgctgggtctccgtgccggggtgggtgctcgtgtgtgcgcttctcctccccatcccccttcccccaagaataaaagaagaaccgggaggcgtgctcagaaaataaataaataaccaccacacacgcgcagcccggagcgagtcggcggggctggcggcagcggcggaggaggagtgaaggcggcggcggcggaggagggacgcgcggaaaaggcagcaactttaaagccagctcagagcctagacctccagccgagcggtttgcagcgcggcggcggcggcggcggcggcggcgttgagtgtctggcccgccggtccggtcggggtgtgcagtcggacggacgagcagcgcgtcgctgtcctccggcagctggagatgtccgagcccaaggcaattgatcccaagttgtcgacgaccgacagggtggtgaaagctgttccatttcctccaagtcaccggcttacagcaaaagaagtgtttgataatgatggaaaacctcgtgtggatatcttaaaggcgcatcttatgaaggagggaaggctggaagagagtgttgcattgagaataataacagagggtgcatcaattcttcgacaggaaaaaaatttgctggatattgatgcgccagtcactgtttgtggggacattcatggacaattctttgatttgatgaagctctttgaagtcgggggatctcctgccaacactcgctacctcttcttaggggactatgttgacagagggtacttcagtattgaatgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgcctttgactgccttcccctggctgccctgatgaaccaacagttcctgtgtgtgcatggtggtttgtctccagagattaacactttagatgatatcagaaaattagaccgattcaaagaaccacctgcatatggacctatgtgtgatatcctgtggtcagaccccctggaagattttggaaatgagaagactcaggaacatttcactcacaacacagtcagggggtgttcatacttctacagttacccggctgtatgtgaattcttacagcacaataacttgttatctatactccgagcccacgaagcccaagatgcagggtaccgcatgtacaggaaaagccaaacaacaggcttcccttctctaattacaattttttcagcaccaaattacttagatgtatacaataacaaagctgcagtattgaagtatgagaacaatgttatgaatatcaggcaattcaactgttctcctcatccatactggcttccaaatttcatggatgtttttacttggtcccttccatttgttggggaaaaagtgactgagatgctggtaaatgtcctcaacatctgctcagatgatgaactagggtcagaagaagatggatttgatggtgcaacagctgcagcccggaaagaggtgataaggaacaagatccgagcaataggcaaaatggccagagtgttctcagtgctcagagaagagagtgagagtgtgctgacgctgaaaggcttgaccccaactggcatgctccccagcggagtactttctggagggaagcaaaccctgcaaagcgctatcaaaggattttcaccacaacataagatcactagcttcgaggaagccaagggcttagaccgaattaatgagaggatgccgcctcgcagagatgccatgccctctgacgccaaccttaactccatcaacaaggctctcacctcagagactaacggcacggacagcaatggcagtaatagcagcaatattcagtgaccacttcctgttcactttttttttttttttttttttttttttttgagctgcggggcatgatggggattgctgcatatcagcagttggatgttcttgcctctgacagtagcttatttgctctgggggccaggaattggattcagtttacactatcattaaaaaagagggagagagataataaactatattttggtggggatggtgattaaacacctcttttgggtatgccttttaaaaatgcttatagagaaaaaaaattttaaaaagaaagctaatgctagtatatactgcaatgttaggggaatgaacatgttttcctactgcattggggacttctagataggttaatgaaaggccttttattctgttactggacatgaaaactttgtctaatttcttactctattgtacgtttacagtcgcagcactaaaaatggatgacatcaaacatttttaacaaaatgatgtacaaactaaggactatttattgataatgttttgctactcttgtcagacaatggctataaactgaattaggcagtcttaaaaaaaaaaaaaaacagaaaaagaaaaaaaagaacgttgcaaatttgttaaaatgccaaaaaggacagtttaattttgtacagattatgcttacctcaggtttctttagtgtgcttgaatgcccttctttccatataacacttatcttcttcttaattcggcaatggaatatcttttaagttttaaaaaaactggaataattatatctatcttttttgccgtttatatttaggggtttttgttgataaaatcaagtcttggttgtggcttgctgaattaaatatttatgagtggtgcatttttaagtatagtgaacaagacaccatattaagtacagtgataaagcatctatattctgtaaaaaaaaaaaaaatctgcctatgcatgttttttaagaaaaaaaaaatggctgtatcggcctgtatgggactgtaatgcgcttagtggtctgacatatactggaaatgtatgtatactggcgtactttatattctctaaaatgcttaatgcctttgaaattttgtaatcaaaaaaaagctttgaaaaaatctaaaggggagagtattctttaaagtttttaacataagcttgtcaatgcacatgtagatggttagcatgtttagcaaaccttgtgaaattataataagtttgtagttacatgtgaaactctaaatgcatggcaactgttaatgtcataacagtttagttattttgttctgttctgtcatgtgccacaaaatatgtacttttttcacttttttccctttgtatatcagttacgggttacaactggttcattctgaaaacaacaacaacaaaagtccattcatattttttaacaattgtataagtgcccaagtaattcactacagcctaaagccttgcctttgtaatttgacttctgacatgttggcaatcaaagcatgcacttgtaacaatgaaaaagaaaaagcattttatattactactcaataaaatgtgcatgaactta

SEQ ID NO: 171291 - DNA, 4685 bp, Homo sapiens
  Payload ID: 13691
  Gene Symbol: PPP3CA
  Gene Name: protein phosphatase 3, catalytic subunit, alpha isozyme
  Uniprot ID: Q08209
  ENST ID: ENST00000394854
  CDS Start-End: 685-2250
ggtgagtggaggagcggcgcggggaggcagaggcgagcgcgggcgatcgcggcggcgggacgtctccggcggccgcggcaccagcggcggcgctctgtgtggagaagcaggggcagcggcagcagcaacagcggcagcggcagcagcagcggcagcagcggcggccgcctctccgccgccggggacgccaaggtgcggctggtggcactgacatcggcggccctgcctctcctccctcgcccccggccttccccatgtgatcggtcttaatcctggccgtgtgtgcgcgcgtggggctccattccgcggtgctgggtctccgtgccggggtgggtgctcgtgtgtgcgcttctcctccccatcccccttcccccaagaataaaagaagaaccgggaggcgtgctcagaaaataaataaataaccaccacacacgcgcagcccggagcgagtcggcggggctggcggcagcggcggaggaggagtgaaggcggcggcggcggaggagggacgcgcggaaaaggcagcaactttaaagccagctcagagcctagacctccagccgagcggtttgcagcgcggcggcggcggcggcggcggcggcgttgagtgtctggcccgccggtccggtcggggtgtgcagtcggacggacgagcagcgcgtcgctgtcctccggcagctggagatgtccgagcccaaggcaattgatcccaagttgtcgacgaccgacagggtggtgaaagctgttccatttcctccaagtcaccggcttacagcaaaagaagtgtttgataatgatggaaaacctcgtgtggatatcttaaaggcgcatcttatgaaggagggaaggctggaagagagtgttgcattgagaataataacagagggtgcatcaattcttcgacaggaaaaaaatttgctggatattgatgcgccagtcactgtttgtggggacattcatggacaattctttgatttgatgaagctctttgaagtcgggggatctcctgccaacactcgctacctcttcttaggggactatgttgacagagggtacttcagtattgaatgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgcctttgactgccttcccctggctgccctgatgaaccaacagttcctgtgtgtgcatggtggtttgtctccagagattaacactttagatgatatcagaaaattagaccgattcaaagaaccacctgcatatggacctatgtgtgatatcctgtggtcagaccccctggaagattttggaaatgagaagactcaggaacatttcactcacaacacagtcagggggtgttcatacttctacagttacccggctgtatgtgaattcttacagcacaataacttgttatctatactccgagcccacgaagcccaagatgcagggtaccgcatgtacaggaaaagccaaacaacaggcttcccttctctaattacaattttttcagcaccaaattacttagatgtatacaataacaaagctgcagtattgaagtatgagaacaatgttatgaatatcaggcaattcaactgttctcctcatccatactggcttccaaatttcatggatgtttttacttggtcccttccatttgttggggaaaaagtgactgagatgctggtaaatgtcctcaacatctgctcagatgatgaactagggtcagaagaagatggatttgatggtgcaacagctgcagcccggaaagaggtgataaggaacaagatccgagcaataggcaaaatggccagagtgttctcagtgctcagagaagagagtgagagtgtgctgacgctgaaaggcttgaccccaactggcatgctccccagcggagtactttctggagggaagcaaaccctgcaaagcgctactgttgaggctattgaggctgatgaagctatcaaaggattttcaccacaacataagatcactagcttcgaggaagccaagggcttagaccgaattaatgagaggatgccgcctcgcagagatgccatgccctctgacgccaaccttaactccatcaacaaggctctcacctcagagactaacggcacggacagcaatggcagtaatagcagcaatattcagtgaccacttcctgttcactttttttttttttttttttttttttttttgagctgcggggcatgatggggattgctgcatatcagcagttggatgttcttgcctctgacagtagcttatttgctctgggggccaggaattggattcagtttacactatcattaaaaaagagggagagagataataaactatattttggtggggatggtgattaaacacctcttttgggtatgccttttaaaaatgcttatagagaaaaaaaattttaaaaagaaagctaatgctagtatatactgcaatgttaggggaatgaacatgttttcctactgcattggggacttctagataggttaatgaaaggccttttattctgttactggacatgaaaactttgtctaatttcttactctattgtacgtttacagtcgcagcactaaaaatggatgacatcaaacatttttaacaaaatgatgtacaaactaaggactatttattgataatgttttgctactcttgtcagacaatggctataaactgaattaggcagtcttaaaaaaaaaaaaaaacagaaaaagaaaaaaaagaacgttgcaaatttgttaaaatgccaaaaaggacagtttaattttgtacagattatgcttacctcaggtttctttagtgtgcttgaatgcccttctttccatataacacttatcttcttcttaattcggcaatggaatatcttttaagttttaaaaaaactggaataattatatctatcttttttgccgtttatatttaggggtttttgttgataaaatcaagtcttggttgtggcttgctgaattaaatatttatgagtggtgcatttttaagtatagtgaacaagacaccatattaagtacagtgataaagcatctatattctgtaaaaaaaaaaaaaatctgcctatgcatgttttttaagaaaaaaaaaatggctgtatcggcctgtatgggactgtaatgcgcttagtggtctgacatatactggaaatgtatgtatactggcgtactttatattctctaaaatgcttaatgcctttgaaattttgtaatcaaaaaaaagctttgaaaaaatctaaaggggagagtattctttaaagtttttaacataagcttgtcaatgcacatgtagatggttagcatgtttagcaaaccttgtgaaattataataagtttgtagttacatgtgaaactctaaatgcatggcaactgttaatgtcataacagtttagttattttgttctgttctgtcatgtgccacaaaatatgtacttttttcacttttttccctttgtatatcagttacgggttacaactggttcattctgaaaacaacaacaacaaaagtccattcatattttttaacaattgtataagtgcccaagtaattcactacagcctaaagccttgcctttgtaatttgacttctgacatgttggcaatcaaagcatgcacttgtaacaatgaaaaagaaaaagcattttatattactactcaataaaatgtgcatgaacttacagaattctcatccttccactgagtccgctgaagggatttatgtgcacaaccaccatgtgtcttctaggtgctggcccaccaccacacatcacaggctgatttccacaggcttcttcctaggggcctcgtgatctgaggggtggtgcctacttccactgtaagaaagaatcttggtggatttgtgtctcaaatcagataagagaagcctgtttaaagagcagatgccatcttctggcttcctcaaggagccagttaaaaaaccagagcattcctttttattgaaaaataaaattaatttgttatcaggttgtttcagttgtattggatgccctatctatctgctaaagcaaaaagtactaggctactaagtgcattttcatcacagaaaagagttgcatttgtattaacaagaaatttgtatacccacgcttcagctactatctaatcatcacccgaagatttaagatacaccaaatttcagtttgtttgtaacattgttcatctttagtgcactttgttttatataataaagtatgcctgttatattaaataataagaatatggcaattagcgatatagcatacccaaacaaagatgttctcgatacagtctggcaaagactatcccaaggttattttaatgaattcagacattttttcctgtggatatttctccatcctaaaaaaagtggcaaccaaggaaaatatttagatgcaacttactagagtgatgatgtgaaagaaatggtgattctggtatcatggtgtttattttctttcttataactgcagagaaaatatcctgactaaaaaaaattcatttttttggattcctttcttttacaaattgtgctgaggcaactatggcatagaaataaacatttgacattaaaataag

SEQ ID NO: 171292 - DNA, 4007 bp, Homo sapiens
  Payload ID: 13691
  Gene Symbol: PPP3CA
  Gene Name: protein phosphatase 3, catalytic subunit, alpha isozyme
  Uniprot ID: Q08209
  ENST ID: ENST00000512215
  CDS Start-End: 682-1551
gagtggaggagcggcgcggggaggcagaggcgagcgcgggcgatcgcggcggcgggacgtctccggcggccgcggcaccagcggcggcgctctgtgtggagaagcaggggcagcggcagcagcaacagcggcagcggcagcagcagcggcagcagcggcggccgcctctccgccgccggggacgccaaggtgcggctggtggcactgacatcggcggccctgcctctcctccctcgcccccggccttccccatgtgatcggtcttaatcctggccgtgtgtgcgcgcgtggggctccattccgcggtgctgggtctccgtgccggggtgggtgctcgtgtgtgcgcttctcctccccatcccccttcccccaagaataaaagaagaaccgggaggcgtgctcagaaaataaataaataaccaccacacacgcgcagcccggagcgagtcggcggggctggcggcagcggcggaggaggagtgaaggcggcggcggcggaggagggacgcgcggaaaaggcagcaactttaaagccagctcagagcctagacctccagccgagcggtttgcagcgcggcggcggcggcggcggcggcggcgttgagtgtctggcccgccggtccggtcggggtgtgcagtcggacggacgagcagcgcgtcgctgtcctccggcagctggagatgtccgagcccaaggcaattgatcccaagttgtcgacgaccgacagggtggtgaaagctgttccatttcctccaagtcaccggcttacagcaaaagaagtgtttgataatgatggaaaacctcgtgtggatatcttaaaggcgcatcttatgaaggagggaaggctggaagagagtgttgcattgagaataataacagagggtgcatcaattcttcgacaggaaaaaaatttgctggatattgatgcgccagtcactgctgcagtattgaagtatgagaacaatgttatgaatatcaggcaattcaactgttctcctcatccatactggcttccaaatttcatggatgtttttacttggtcccttccatttgttggggaaaaagtgactgagatgctggtaaatgtcctcaacatctgctcagatgatgaactagggtcagaagaagatggatttgatggtgcaacagctgcagcccggaaagaggtgataaggaacaagatccgagcaataggcaaaatggccagagtgttctcagtgctcagagaagagagtgagagtgtgctgacgctgaaaggcttgaccccaactggcatgctccccagcggagtactttctggagggaagcaaaccctgcaaagcgctactgttgaggctattgaggctgatgaagctatcaaaggattttcaccacaacataagatcactagcttcgaggaagccaagggcttagaccgaattaatgagaggatgccgcctcgcagagatgccatgccctctgacgccaaccttaactccatcaacaaggctctcacctcagagactaacggcacggacagcaatggcagtaatagcagcaatattcagtgaccacttcctgttcactttttttttttttttttttttttttttttgagctgcggggcatgatggggattgctgcatatcagcagttggatgttcttgcctctgacagtagcttatttgctctgggggccaggaattggattcagtttacactatcattaaaaaagagggagagagataataaactatattttggtggggatggtgattaaacacctcttttgggtatgccttttaaaaatgcttatagagaaaaaaaattttaaaaagaaagctaatgctagtatatactgcaatgttaggggaatgaacatgttttcctactgcattggggacttctagataggttaatgaaaggccttttattctgttactggacatgaaaactttgtctaatttcttactctattgtacgtttacagtcgcagcactaaaaatggatgacatcaaacatttttaacaaaatgatgtacaaactaaggactatttattgataatgttttgctactcttgtcagacaatggctataaactgaattaggcagtcttaaaaaaaaaaaaaaacagaaaaagaaaaaaaagaacgttgcaaatttgttaaaatgccaaaaaggacagtttaattttgtacagattatgcttacctcaggtttctttagtgtgcttgaatgcccttctttccatataacacttatcttcttcttaattcggcaatggaatatcttttaagttttaaaaaaactggaataattatatctatcttttttgccgtttatatttaggggtttttgttgataaaatcaagtcttggttgtggcttgctgaattaaatatttatgagtggtgcatttttaagtatagtgaacaagacaccatattaagtacagtgataaagcatctatattctgtaaaaaaaaaaaaaatctgcctatgcatgttttttaagaaaaaaaaaatggctgtatcggcctgtatgggactgtaatgcgcttagtggtctgacatatactggaaatgtatgtatactggcgtactttatattctctaaaatgcttaatgcctttgaaattttgtaatcaaaaaaaagctttgaaaaaatctaaaggggagagtattctttaaagtttttaacataagcttgtcaatgcacatgtagatggttagcatgtttagcaaaccttgtgaaattataataagtttgtagttacatgtgaaactctaaatgcatggcaactgttaatgtcataacagtttagttattttgttctgttctgtcatgtgccacaaaatatgtacttttttcacttttttccctttgtatatcagttacgggttacaactggttcattctgaaaacaacaacaacaaaagtccattcatattttttaacaattgtataagtgcccaagtaattcactacagcctaaagccttgcctttgtaatttgacttctgacatgttggcaatcaaagcatgcacttgtaacaatgaaaaagaaaaagcattttatattactactcaataaaatgtgcatgaacttacagaattctcatccttccactgagtccgctgaagggatttatgtgcacaaccaccatgtgtcttctaggtgctggcccaccaccacacatcacaggctgatttccacaggcttcttcctaggggcctcgtgatctgaggggtggtgcctacttccactgtaagaaagaatcttggtggatttgtgtctcaaatcagataagagaagcctgtttaaagagcagatgccatcttctggcttcctcaaggagccagttaaaaaaccagagcattcctttttattgaaaaataaaattaatttgttatcaggttgtttcagttgtattggatgccctatctatctgctaaagcaaaaagtactaggctactaagtgcattttcatcacagaaaagagttgcatttgtattaacaagaaatttgtatacccacgcttcagctactatctaatcatcacccgaagatttaagatacaccaaatttcagtttgtttgtaacattgttcatctttagtgcactttgttttatataataaagtatgcctgttatattaaataataagaatatggcaattagcgatatagcatacccaaacaaagatgttctcgatacagtctggcaaagactatcccaaggttattttaatgaattcagacattttttcctgtggatatttctccatcctaaaaaaagtggcaaccaaggaaaatatttagatgcaacttactagagtgatgatgtgaaagaaatggtgattctggtatcatggtgtttattttctttcttataactgcagagaaaatatcctgactaaaaaaaattcatttttttggattcctttcttttacaaattgtgctgaggcaactatggcatagaaataaacatttgacattaaaataagcagttgatgtgagtattgctt

SEQ ID NO: 171293 - DNA, 1958 bp, Homo sapiens
  Payload ID: 13691
  Gene Symbol: PPP3CA
  Gene Name: protein phosphatase 3, catalytic subunit, alpha isozyme
  ENST ID: ENST00000507176
  CDS Start-End: 140-1411
cagtcggacggacgagcagcgcgtcgctgtcctccggcagctggagatgtccgagcccaaggcaattgatcccaagttgtcgacgaccgacagggtggtgaaagtttgtggggacattcatggacaattctttgatttgatgaagctctttgaagtcgggggatctcctgccaacactcgctacctcttcttaggggactatgttgacagagggtacttcagtattgaatgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgcctttgactgccttcccctggctgccctgatgaaccaacagttcctgtgtgtgcatggtggtttgtctccagagattaacactttagatgatatcagaaaattagaccgattcaaagaaccacctgcatatggacctatgtgtgatatcctgtggtcagaccccctggaagattttggaaatgagaagactcaggaacatttcactcacaacacagtcagggggtgttcatacttctacagttacccggctgtatgtgaattcttacagcacaataacttgttatctatactccgagcccacgaagcccaagatgcagggtaccgcatgtacaggaaaagccaaacaacaggcttcccttctctaattacaattttttcagcaccaaattacttagatgtatacaataacaaagctgcagtattgaagtatgagaacaatgttatgaatatcaggcaattcaactgttctcctcatccatactggcttccaaatttcatggatgtttttacttggtcccttccatttgttggggaaaaagtgactgagatgctggtaaatgtcctcaacatctgctcagatgatgaactagggtcagaagaagatggatttgatggtgcaacagctgcagcccggaaagaggtgataaggaacaagatccgagcaataggcaaaatggccagagtgttctcagtgctcagagaagagagtgagagtgtgctgacgctgaaaggcttgaccccaactggcatgctccccagcggagtactttctggagggaagcaaaccctgcaaagcgctactgttgaggctattgaggctgatgaagctatcaaaggattttcaccacaacataagatcactagcttcgaggaagccaagggcttagaccgaattaatgagaggatgccgcctcgcagagatgccatgccctctgacgccaaccttaactccatcaacaaggctctcacctcagagactaacggcacggacagcaatggcagtaatagcagcaatattcagtgaccacttcctgttcactttttttttttttttttttttttttttttgagctgcggggcatgatggggattgctgcatatcagcagttggatgttcttgcctctgacagtagcttatttgctctgggggccaggaattggattcagtttacactatcattaaaaaagagggagagagataataaactatattttggtggggatggtgattaaacacctcttttgggtatgccttttaaaaatgcttatagagaaaaaaaattttaaaaagaaagctaatgctagtatatactgcaatgttaggggaatgaacatgttttcctactgcattggggacttctagataggttaatgaaaggccttttattctgttactggacatgaaaactttgtctaatttcttactctattgtacgtttacagtcgcagcactaaaaatggatgacatcaaacatttttaacaaaatgatgtacaaactaaggactatttattgataatgttttgctactcttgtcagacaatggctataaactgaattaggcagtcttaa

SEQ ID NO: 171294 - DNA, 836 bp, Homo sapiens
  Payload ID: 13691
  Gene Symbol: PPP3CA
  Gene Name: protein phosphatase 3, catalytic subunit, alpha isozyme
  ENST ID: ENST00000492351
  CDS Start-End: 1-51
gcgccagtcactgaagctccacagatgaccccgattcacacaccaaggtaaaaacggatggctttcaaatgacacagaaaggagatttcacacatggcagggaaggaatgtaaactactgacaaccacccaaaggacttttctctgtgtaccttggtttgtggggacattcatggacaattctttgatttgatgaagctctttgaagtcgggggatctcctgccaacactcgctacctcttcttaggggactatgttgacagagggtacttcagtattgaaggtaatttgtcaaactcattaattaaaacaaaacagataacctttgaatagaggttcttccacagcctcccatctgcatctgctttagtgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgcctttgactgccttcccctggctgccctgatgaaccaacagttcctgtgtgtgcatggtggtttgtctccagagattaacactttagatgatatcagaaaattagaccgattcaaagaaccacctgcatatggacctatgtgtgatatcctgtggtcagaccccctggaagattttggaaatgagaagactcaggaacatttcactcacaacacagtcagggggtgttcatacttctacagttacccggctgtatgtgaattcttacagcacaataacttgttatctatactccgagcccacgaagccca

SEQ ID NO: 171295 - DNA, 579 bp, Homo sapiens
  Payload ID: 13691
  Gene Symbol: PPP3CA
  Gene Name: protein phosphatase 3, catalytic subunit, alpha isozyme
  ENST ID: ENST00000529324
  CDS Start-End: 139-579
aaaaacaaccgtacaccgcatcgcagtcgtagctcttctccgcaagctgttccatttcctccaagtcaccggcttacagcaaaagaagtgtttgataatgatggaaaacctcgtgtggatatcttaaaggcgcatcttatgaaggagggaaggctggaagagagtgttgcattgagaataataacagagggtgcatcaattcttcgacaggaaaaaaatttgctggatattgatgcgccagtcactgtttgtggggacattcatggacaattctttgatttgatgaagctctttgaagtcgggggatctcctgccaacactcgctacctcttcttaggggactatgttgacagagggtacttcagtattgaatgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgcctttgactgccttcccctggctgccctgatgaaccaacagttcctgtgt

SEQ ID NO: 171296 - DNA, 569 bp, Homo sapiens
  Payload ID: 13691
  Gene Symbol: PPP3CA
  Gene Name: protein phosphatase 3, catalytic subunit, alpha isozyme
  ENST ID: ENST00000525819
  CDS Start-End: 174-569
ggtgttggcggcggcggcggcggcggaggggggtaggttgtgcccgggactgtgtctgccgagctcggcggctgtgccttgctgttccatttcctccaagtcaccggcttacagcaaaagaagtgtttgataatgatggaaaacctcgtgtggatatcttaaaggcgcatcttatgaaggagggaaggctggaagagagtgttgcattgagaataataacagagggtgcatcaattcttcgacaggaaaaaaatttgctggatattgatgcgccagtcactgtttgtggggacattcatggacaattctttgatttgatgaagctctttgaagtcgggggatctcctgccaacactcgctacctcttcttaggggactatgttgacagagggtacttcagtattgaatgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgccttt

SEQ ID NO: 171297 - DNA, 2418 bp, Homo sapiens
  Payload ID: 13692
  Gene Symbol: PPP3CB
  Gene Name: protein phosphatase 3, catalytic subunit, beta isozyme
  ENST ID: ENST00000342558
  CDS Start-End: 108-1598
agagggtccgccatgttccccggcggcgccgccgcttggctctggtagccgccgcccccgcccccaaccccgcccggcccagagcctagccgagccccgggcccagcatggccgccccggagccggcccgggctgcaccgcccccacccccgcccccgccgccccctcccggggctgaccgcgtcgtcaaagctgtccctttccccccaacacatcgcttgacatctgaagaagtatttgatttggatgggatacccagggttgatgttctgaagaaccacttggtgaaagaaggtcgagtagatgaagaaattgcgcttagaattatcaatgagggtgctgccatccttcggagagagaaaaccatgatagaagtagaagctccaatcacagtgtgtggtgacatccatggccaattttttgatctgatgaaactttttgaagtaggaggatcacctgctaatacacgatacctttttcttggcgattatgtggacagaggttattttagtatagagtgtgtcttatatttatgggttctgaagattctatacccaagcacattatttcttctgagaggcaaccatgaatgcagacaccttactgaatattttacctttaagcaggaatgtaaaattaagtattcggaaagagtctatgaagcttgtatggaagcttttgatagtttgcctcttgctgcacttttaaaccaacagtttctttgtgttcatggtggactttcaccagaaatacacacactggatgatattaggagattagatagattcaaagagccacctgcatttggaccaatgtgtgacttgttatggtccgatccttctgaagattttggaaatgaaaaatcacaggaacattttagtcacaatacagttcgaggatgttcttatttttataactatccagcagtgtgtgaatttttgcaaaacaataatttgttatcgattattagagctcatgaagctcaagatgcaggctatagaatgtacagaaaaagtcaaactacagggttcccttcattaataacaattttttcggcacctaattacttagatgtctacaataataaagctgctgtattaaagtatgaaaataatgtgatgaatattcgacagtttaactgttctccacatccttactggttgcctaattttatggatgtcttcacgtggtctttaccgtttgttggagaaaaagtgacagaaatgttggtaaatgttctgagtatttgctctgatgatgaactaatgactgaaggtgaagaccagtttgatggttcagctgcagcccggaaagaaatcataagaaacaaaattcgagcaattggcaagatggcaagagtcttctctgttctcagggaggagagtgaaagtgtgctgacactcaagggcctgactcccacagggatgttgcctagtggagtgttagctggaggacggcagaccctgcaaagtggtaatgatgttatgcaacttgctgtgcctcagatggactggggcacacctcactcttttgctaacaattcacataatgcatgcagggaattccttctgttttttagttcctgtctcagcagctgacctagacagggtactgtattagctagtgtctcattaatacctgatcagggcagaaaactgatagaatgggtattcctttcaattgaaaataatggtcagttcctcagcttttcatgaaatgatatgggagcagctcatatcataatgtctgaaatatttatttattcatctgtctaattcacccttttcttttaaaagccccagtttcagaatgtgaatcagggatattcctgttactaaaatggaaatgtaattccaagtttcttttttaattttttaaatttatgtcattgtattggactatgcttatatttaaaactacttaatttagagttaactacctgcttaggccccagaacattacttatgcccttcagttaccaaaagatttgtgcaaggttttgtaccctggtaaatgatgccaaagtttgttttctgtggtgtttgtcaaatgttctatgtataattaactgtctgtaacatgctgtttccttcctctgcagatgtagctgctttcctaaatctgtctgtctttctttaggttagctgtatgtctgtaaaagtatgttcaattaaattactccatcagacacttgtctgtcttgcaatgtagaagcagctttgtagcaccttgttttgaggtttgctgcatttgttgctgcactttgtgcattctgaacatgaatgtaacattagatattaagtcattgttataaggggttgaatttaaatcctgtaagtcaaaattgaaagggtgttattaagtgtgcctttattttgcatgaaaataaaaagaattatacgtaaagcattcctgtaa

SEQ ID NO: 171298 - DNA, 3501 bp, Homo sapiens
  Payload ID: 13692
  Gene Symbol: PPP3CB
  Gene Name: protein phosphatase 3, catalytic subunit, beta isozyme
  Uniprot ID: P16298
  ENST ID: ENST00000360663
  CDS Start-End: 113-1687
gggaaagagggtccgccatgttccccggcggcgccgccgcttggctctggtagccgccgcccccgcccccaaccccgcccggcccagagcctagccgagccccgggcccagcatggccgccccggagccggcccgggctgcaccgcccccacccccgcccccgccgccccctcccggggctgaccgcgtcgtcaaagctgtccctttccccccaacacatcgcttgacatctgaagaagtatttgatttggatgggatacccagggttgatgttctgaagaaccacttggtgaaagaaggtcgagtagatgaagaaattgcgcttagaattatcaatgagggtgctgccatccttcggagagagaaaaccatgatagaagtagaagctccaatcacagtgtgtggtgacatccatggccaattttttgatctgatgaaactttttgaagtaggaggatcacctgctaatacacgatacctttttcttggcgattatgtggacagaggttattttagtatagagtgtgtcttatatttatgggttctgaagattctatacccaagcacattatttcttctgagaggcaaccatgaatgcagacaccttactgaatattttacctttaagcaggaatgtaaaattaagtattcggaaagagtctatgaagcttgtatggaagcttttgatagtttgcctcttgctgcacttttaaaccaacagtttctttgtgttcatggtggactttcaccagaaatacacacactggatgatattaggagattagatagattcaaagagccacctgcatttggaccaatgtgtgacttgttatggtccgatccttctgaagattttggaaatgaaaaatcacaggaacattttagtcacaatacagttcgaggatgttcttatttttataactatccagcagtgtgtgaatttttgcaaaacaataatttgttatcgattattagagctcatgaagctcaagatgcaggctatagaatgtacagaaaaagtcaaactacagggttcccttcattaataacaattttttcggcacctaattacttagatgtctacaataataaagctgctgtattaaagtatgaaaataatgtgatgaatattcgacagtttaactgttctccacatccttactggttgcctaattttatggatgtcttcacgtggtctttaccgtttgttggagaaaaagtgacagaaatgttggtaaatgttctgagtatttgctctgatgatgaactaatgactgaaggtgaagaccagtttgatggttcagctgcagcccggaaagaaatcataagaaacaaaattcgagcaattggcaagatggcaagagtcttctctgttctcagggaggagagtgaaagtgtgctgacactcaagggcctgactcccacagggatgttgcctagtggagtgttagctggaggacggcagaccctgcaaagtgccacagttgaggctattgaggctgaaaaagcaatacgaggattctctccaccacatagaatctgcagttttgaagaggcaaagggtttggataggatcaatgagagaatgccacctcggaaagatgctgtacagcaagatggtttcaattctctgaacaccgcacatgccactgagaaccacgggacgggcaaccatactgcccagtgacccactacttcccagggactctcacatctcgggccccaaatggacagatcacccgaggagctggaggggtcggccaagctgactgtaaatttcacagtctctctgaagaaaccattgtgcttctgagaccctagcccccttcctggatggaggcttgagggccctgggacatgtgctatctgataagattgggtcatcgctgccaaggtggagagcagtgagcaaggggcttggggcaatttccagtggagggcatccacacctccattttatgcttgtggttcacacatttaagtttacaaatcagatttcttttccccttcagtagaattagattttgtttttcaatcatgatttcaaatgcaatcctaagagctaatgtggacttttctttttccatgaaatgtctttaaaggatgaattagcatggtcttaaaatacatttctgaggttactagctgtattttgaattgtgagcaaaatgccgagaaacccagttggcatttatacaaaatgttgacctcaggtctatagttcttaaatgtggctaattctgtaacatagtcttggtattttttaattatgaatgcatatcctatttccaggcaggctctcttacttgaacacaaatccaaaaactaatttagagtcttttttgcccagatcttttaagacttacaccccagagatttaagaagaaaacctctaaatttcaaaattatgaagaattacagaattactcatttaaggtactttaaaagaagtttgtacattgtcaaagtaaattttaattcaaatcatgtctgtaaaacttgacgtattttgtgtatgcatgttttcattttgcaaatatttaatatatagacctatgatgtacaggtacgacatgtataggttacctagatgttatgagaaattttagtttattgtgagtactcaagttgcttagagagccaccagggtgatttgctgctggctttctatcatttttatgttttaatgcaaaggaaattttaaaatgttctggaagtgtttttgattaagcaatgcagcctagaagcaatggttctgttcaatcattcagatgttagtggaagcataaaagtcaagactgcatgttgaaacctttcttttgatagttactgaactgcttggttaaactaaatggaaccatgtgctaatttttcacaattattgacctgtattgattgccactgtagtttggtatttccctttactttggtggcctgcttccctcatgccctggaatacaactcagagctccaggcagcggaaccatctattgttttgtttgccagaaagtgcaccctgtatggtctcctgtctaagttggaaatattatgcatgtgcaggactattcgagtattttataaacagtagcacacaataaattccatgcatgggccgctgctcctatctctgtgttgggttttatttggaagatgcaatctgatttgtccttttgatgcaaatcagaaaatcctgttactagagctgggatgtcctccggagattatctcgtggatagttcatggtaatttgattaattaaattctttataaattttgccttaaaaaaaacttttgttatatacttgttttacatgagcattagtaactgagcactagaggactttgaatgcctactgtaggcctcctaagtctaatatttaagatcactgtttattgtcttttaattgaaagaaaatatgttattgtctagaattttgttatagtggtattgggaatttactgggtgttctaacaataagaaaaatattagtgataattgca

SEQ ID NO: 171299 - DNA, 3119 bp, Homo sapiens
  Payload ID: 13692
  Gene Symbol: PPP3CB
  Gene Name: protein phosphatase 3, catalytic subunit, beta isozyme
  Uniprot ID: P16298
  ENST ID: ENST00000394828
  CDS Start-End: 136-1683
atgccggtcttagcccctctgtagggaaagagggtccgccatgttccccggcggcgccgccgcttggctctggtagccgccgcccccgcccccaaccccgcccggcccagagcctagccgagccccgggcccagcatggccgccccggagccggcccgggctgcaccgcccccacccccgcccccgccgccccctcccggggctgaccgcgtcgtcaaagctgtccctttccccccaacacatcgcttgacatctgaagaagtatttgatttggatgggatacccagggttgatgttctgaagaaccacttggtgaaagaaggtcgagtagatgaagaaattgcgcttagaattatcaatgagggtgctgccatccttcggagagagaaaaccatgatagaagtagaagctccaatcacagtgtgtggtgacatccatggccaattttttgatctgatgaaactttttgaagtaggaggatcacctgctaatacacgatacctttttcttggcgattatgtggacagaggttattttagtatagagtgtgtcttatatttatgggttctgaagattctatacccaagcacattatttcttctgagaggcaaccatgaatgcagacaccttactgaatattttacctttaagcaggaatgtaaaattaagtattcggaaagagtctatgaagcttgtatggaagcttttgatagtttgcctcttgctgcacttttaaaccaacagtttctttgtgttcatggtggactttcaccagaaatacacacactggatgatattaggagattagatagattcaaagagccacctgcatttggaccaatgtgtgacttgttatggtccgatccttctgaagattttggaaatgaaaaatcacaggaacattttagtcacaatacagttcgaggatgttcttatttttataactatccagcagtgtgtgaatttttgcaaaacaataatttgttatcgattattagagctcatgaagctcaagatgcaggctatagaatgtacagaaaaagtcaaactacagggttcccttcattaataacaattttttcggcacctaattacttagatgtctacaataataaagctgctgtattaaagtatgaaaataatgtgatgaatattcgacagtttaactgttctccacatccttactggttgcctaattttatggatgtcttcacgtggtctttaccgtttgttggagaaaaagtgacagaaatgttggtaaatgttctgagtatttgctctgatgatgaactaatgactgaaggtgaagaccagtttgatgtaggttcagctgcagcccggaaagaaatcataagaaacaaaattcgagcaattggcaagatggcaagagtcttctctgttctcagggaggagagtgaaagtgtgctgacactcaagggcctgactcccacagggatgttgcctagtggagtgttagctggaggacggcagaccctgcaaagtgcaatacgaggattctctccaccacatagaatctgcagttttgaagaggcaaagggtttggataggatcaatgagagaatgccacctcggaaagatgctgtacagcaagatggtttcaattctctgaacaccgcacatgccactgagaaccacgggacgggcaaccatactgcccagtgacccactacttcccagggactctcacatctcgggccccaaatggacagatcacccgaggagctggaggggtcggccaagctgactgtaaatttcacagtctctctgaagaaaccattgtgcttctgagaccctagcccccttcctggatggaggcttgagggccctgggacatgtgctatctgataagattgggtcatcgctgccaaggtggagagcagtgagcaaggggcttggggcaatttccagtggagggcatccacacctccattttatgcttgtggttcacacatttaagtttacaaatcagatttcttttccccttcagtagaattagattttgtttttcaatcatgatttcaaatgcaatcctaagagctaatgtggacttttctttttccatgaaatgtctttaaaggatgaattagcatggtcttaaaatacatttctgaggttactagctgtattttgaattgtgagcaaaatgccgagaaacccagttggcatttatacaaaatgttgacctcaggtctatagttcttaaatgtggctaattctgtaacatagtcttggtattttttaattatgaatgcatatcctatttccaggcaggctctcttacttgaacacaaatccaaaaactaatttagagtcttttttgcccagatcttttaagacttacaccccagagatttaagaagaaaacctctaaatttcaaaattatgaagaattacagaattactcatttaaggtactttaaaagaagtttgtacattgtcaaagtaaattttaattcaaatcatgtctgtaaaacttgacgtattttgtgtatgcatgttttcattttgcaaatatttaatatatagacctatgatgtacaggtacgacatgtataggttacctagatgttatgagaaattttagtttattgtgagtactcaagttgcttagagagccaccagggtgatttgctgctggctttctatcatttttatgttttaatgcaaaggaaattttaaaatgttctggaagtgtttttgattaagcaatgcagcctagaagcaatggttctgttcaatcattcagatgttagtggaagcataaaagtcaagactgcatgttgaaacctttcttttgatagttactgaactgcttggttaaactaaatggaaccatgtgctaatttttcacaattattgacctgtattgattgccactgtagtttggtatttccctttactttggtggcctgcttccctcatgccctggaatacaactcagagctccaggcagcggaaccatctattgttttgtttgccagaaagtgcaccctgtatggtctcctgtctaagttggaaatattatgcatgtgcaggactattcgagtattttataaacagtagcacacaataaattccatgcatgggccgctgctcct

SEQ ID NO: 171300 - DNA, 3149 bp, Homo sapiens
  Payload ID: 13692
  Gene Symbol: PPP3CB
  Gene Name: protein phosphatase 3, catalytic subunit, beta isozyme
  Uniprot ID: P16298
  ENST ID: ENST00000394829
  CDS Start-End: 136-1713
atgccggtcttagcccctctgtagggaaagagggtccgccatgttccccggcggcgccgccgcttggctctggtagccgccgcccccgcccccaaccccgcccggcccagagcctagccgagccccgggcccagcatggccgccccggagccggcccgggctgcaccgcccccacccccgcccccgccgccccctcccggggctgaccgcgtcgtcaaagctgtccctttccccccaacacatcgcttgacatctgaagaagtatttgatttggatgggatacccagggttgatgttctgaagaaccacttggtgaaagaaggtcgagtagatgaagaaattgcgcttagaattatcaatgagggtgctgccatccttcggagagagaaaaccatgatagaagtagaagctccaatcacagtgtgtggtgacatccatggccaattttttgatctgatgaaactttttgaagtaggaggatcacctgctaatacacgatacctttttcttggcgattatgtggacagaggttattttagtatagagtgtgtcttatatttatgggttctgaagattctatacccaagcacattatttcttctgagaggcaaccatgaatgcagacaccttactgaatattttacctttaagcaggaatgtaaaattaagtattcggaaagagtctatgaagcttgtatggaagcttttgatagtttgcctcttgctgcacttttaaaccaacagtttctttgtgttcatggtggactttcaccagaaatacacacactggatgatattaggagattagatagattcaaagagccacctgcatttggaccaatgtgtgacttgttatggtccgatccttctgaagattttggaaatgaaaaatcacaggaacattttagtcacaatacagttcgaggatgttcttatttttataactatccagcagtgtgtgaatttttgcaaaacaataatttgttatcgattattagagctcatgaagctcaagatgcaggctatagaatgtacagaaaaagtcaaactacagggttcccttcattaataacaattttttcggcacctaattacttagatgtctacaataataaagctgctgtattaaagtatgaaaataatgtgatgaatattcgacagtttaactgttctccacatccttactggttgcctaattttatggatgtcttcacgtggtctttaccgtttgttggagaaaaagtgacagaaatgttggtaaatgttctgagtatttgctctgatgatgaactaatgactgaaggtgaagaccagtttgatgtaggttcagctgcagcccggaaagaaatcataagaaacaaaattcgagcaattggcaagatggcaagagtcttctctgttctcagggaggagagtgaaagtgtgctgacactcaagggcctgactcccacagggatgttgcctagtggagtgttagctggaggacggcagaccctgcaaagtgccacagttgaggctattgaggctgaaaaagcaatacgaggattctctccaccacatagaatctgcagttttgaagaggcaaagggtttggataggatcaatgagagaatgccacctcggaaagatgctgtacagcaagatggtttcaattctctgaacaccgcacatgccactgagaaccacgggacgggcaaccatactgcccagtgacccactacttcccagggactctcacatctcgggccccaaatggacagatcacccgaggagctggaggggtcggccaagctgactgtaaatttcacagtctctctgaagaaaccattgtgcttctgagaccctagcccccttcctggatggaggcttgagggccctgggacatgtgctatctgataagattgggtcatcgctgccaaggtggagagcagtgagcaaggggcttggggcaatttccagtggagggcatccacacctccattttatgcttgtggttcacacatttaagtttacaaatcagatttcttttccccttcagtagaattagattttgtttttcaatcatgatttcaaatgcaatcctaagagctaatgtggacttttctttttccatgaaatgtctttaaaggatgaattagcatggtcttaaaatacatttctgaggttactagctgtattttgaattgtgagcaaaatgccgagaaacccagttggcatttatacaaaatgttgacctcaggtctatagttcttaaatgtggctaattctgtaacatagtcttggtattttttaattatgaatgcatatcctatttccaggcaggctctcttacttgaacacaaatccaaaaactaatttagagtcttttttgcccagatcttttaagacttacaccccagagatttaagaagaaaacctctaaatttcaaaattatgaagaattacagaattactcatttaaggtactttaaaagaagtttgtacattgtcaaagtaaattttaattcaaatcatgtctgtaaaacttgacgtattttgtgtatgcatgttttcattttgcaaatatttaatatatagacctatgatgtacaggtacgacatgtataggttacctagatgttatgagaaattttagtttattgtgagtactcaagttgcttagagagccaccagggtgatttgctgctggctttctatcatttttatgttttaatgcaaaggaaattttaaaatgttctggaagtgtttttgattaagcaatgcagcctagaagcaatggttctgttcaatcattcagatgttagtggaagcataaaagtcaagactgcatgttgaaacctttcttttgatagttactgaactgcttggttaaactaaatggaaccatgtgctaatttttcacaattattgacctgtattgattgccactgtagtttggtatttccctttactttggtggcctgcttccctcatgccctggaatacaactcagagctccaggcagcggaaccatctattgttttgtttgccagaaagtgcaccctgtatggtctcctgtctaagttggaaatattatgcatgtgcaggactattcgagtattttataaacagtagcacacaataaattccatgcatgggccgctgctcct

SEQ ID NO: 171301 - DNA, 608 bp, Homo sapiens
  Payload ID: 13692
  Gene Symbol: PPP3CB
  Gene Name: protein phosphatase 3, catalytic subunit, beta isozyme
  ENST ID: ENST00000430762
  CDS Start-End: 1-564
catccttactggttgcctaattttatggatgtcttcacgtggtctttaccgtttgttggagaaaaagtgacagaaatgttggtaaatgttctgagtatttgctctgatgatgaactaatgactgaaggtgaagaccagtttgatgaacggctcatatatggcaataaaaaagtaggttcagctgcagcccggaaagaaatcataagaaacaaaattcgagcaattggcaagatggcaagagtcttctctgttctcagggaggagagtgaaagtgtgctgacactcaagggcctgactcccacagggatgttgcctagtggagtgttagctggaggacggcagaccctgcaaagtgccacagttgaggctattgaggctgaaaaagcaatacgaggattctctccaccacatagaatctgcagttttgaagaggcaaagggtttggataggatcaatgagagaatgccacctcggaaagatgctgtacagcaagatggtttcaattctctgaacaccgcacatgccactgagaaccacgggacgggcaaccatactgcccagtgacccactacttcccagggactctcacatctcgggccccaaatgga

SEQ ID NO: 171302 - DNA, 2189 bp, Homo sapiens
  Payload ID: 13693
  Gene Symbol: PPP3CC
  Gene Name: protein phosphatase 3, catalytic subunit, gamma isozyme
  Uniprot ID: P48454
  ENST ID: ENST00000240139
  CDS Start-End: 328-1866
cacgagggcccgggccgcgagcagccgcggccgtcccggtcgccacccttagcagcggtcgcggtcggtgccgaagcggtgttccccgccttagccgctggcgcctcccaagagagcggccggtgggccctcgtcctgtcagtggcgtcggaggccggcgctgcggtggccgcgcccttctggtgctcggacaccgctgaggagccggggccgggcacggctggctgacggctccgggcagctaaggctgcccgaggagaaggcggcggccgcggcgtaggcgcacgtccggcgggctcctggagcctggaggaggccgaggggaccatgtccgggaggcgcttccacctctccaccaccgaccgcgtcatcaaagctgtcccctttcctccaacccaacggcttactttcaaggaagtatttgagaatgggaaacctaaagttgatgttttaaaaaaccatttggtaaaggaaggacgactggaagaggaagtagccttaaagataatcaatgatggggctgccatcctgaggcaagagaagactatgatagaagtagatgctccaatcacagtatgtggtgatattcatggacaattctttgacctaatgaagttatttgaagttggaggatcacctagtaacacacgctacctctttctgggtgactatgtggacagaggctatttcagtatagagtgtgtgctgtatttatggagtttaaagattaatcatcccaaaacattgtttctgcttcggggaaatcatgaatgcaggcatcttacagactatttcaccttcaaacaggaatgtcgaatcaaatattcggaacaggtgtatgatgcctgtatggagacatttgactgtcttcctcttgctgccctcttaaaccagcagtttctctgtgtacatggaggaatgtcacctgaaattacttctttagatgacattaggaaattagacaggtttacggaacctcccgcctttggacctgtgtgtgacctgctttggtctgatccctcagaggattatggcaatgagaagaccttggagcactatacccacaacactgtccgagggtgctcttatttctacagttaccctgcagtttgtgaatttttgcagaacaataatttactatcaattatcagagcccatgaagcccaagatgctgggtatcgaatgtacaggaagagccaagccacaggctttccatcacttattacaattttctctgcccccaattacctagatgtctataacaataaagctgctgtgttgaaatatgaaaacaatgtcatgaatatcaggcagtttaactgttctccacacccctactggcttccaaactttatggatgttttcacatggtctttgccttttgttggggaaaaagtcacagagatgctggtaaatgtgctcaacatatgctctgatgacgaactgatttctgatgatgaagcagaaggaagcactacagttcgtaaggagatcatcaggaataagatcagagccattgggaagatggcacgggtcttttcaattcttcggcaagaaagtgagagtgtgctgactctcaagggcctgactcccacaggcacactccctctgggcgtcctctcaggaggcaagcagactatcgagacagccacagtagaagcggtagaggcccgggaagccatcagagggttctcgcttcagcacaagatccggagttttgaagaagcgcgaggtctggaccgaattaatgagcgaatgccaccccgaaaggatagcatacacgctggtgggccaatgaaatctgtaacctcagcacactcacatgctgcgcacaggagcgaccaagggaagaaagcccattcatgacttagagtcctgccgtggctcaggtggatctaaaactcaagaacaaattctatttatttattattggaaaatgaaaagcaactcaaaacaacttcaacgtggaggtgcatttataattcagtctgcatttattctgtaaaaaggtggctgttttataaattcttttaatttatgttcaatatatataaaaagtgcatctgttttgtttttcccttttttctccataattttaagaaatgaatctgattgttgtcaacacatttgtgaagtcttgtgctataaaggggaacttcccctaataaaagggccttggaaacctcaaa

SEQ ID NO: 171303 - DNA, 2135 bp, Homo sapiens
  Payload ID: 13693
  Gene Symbol: PPP3CC
  Gene Name: protein phosphatase 3, catalytic subunit, gamma isozyme
  Uniprot ID: P48454
  ENST ID: ENST00000289963
  CDS Start-End: 287-1795
gccacccttagcagcggtcgcggtcggtgccgaagcggtgttccccgccttagccgctggcgcctcccaagagagcggccggtgggccctcgtcctgtcagtggcgtcggaggccggcgctgcggtggccgcgcccttctggtgctcggacaccgctgaggagccggggccgggcacggctggctgacggctccgggcagctaaggctgcccgaggagaaggcggcggccgcggcgtaggcgcacgtccggcgggctcctggagcctggaggaggccgaggggaccatgtccgggaggcgcttccacctctccaccaccgaccgcgtcatcaaagctgtcccctttcctccaacccaacggcttactttcaaggaagtatttgagaatgggaaacctaaagttgatgttttaaaaaaccatttggtaaaggaaggacgactggaagaggaagtagccttaaagataatcaatgatggggctgccatcctgaggcaagagaagactatgatagaagtagatgctccaatcacagtatgtggtgatattcatggacaattctttgacctaatgaagttatttgaagttggaggatcacctagtaacacacgctacctctttctgggtgactatgtggacagaggctatttcagtatagagtgtgtgctgtatttatggagtttaaagattaatcatcccaaaacattgtttctgcttcggggaaatcatgaatgcaggcatcttacagactatttcaccttcaaacaggaatgtcgaatcaaatattcggaacaggtgtatgatgcctgtatggagacatttgactgtcttcctcttgctgccctcttaaaccagcagtttctctgtgtacatggaggaatgtcacctgaaattacttctttagatgacattaggaaattagacaggtttacggaacctcccgcctttggacctgtgtgtgacctgctttggtctgatccctcagaggattatggcaatgagaagaccttggagcactatacccacaacactgtccgagggtgctcttatttctacagttaccctgcagtttgtgaatttttgcagaacaataatttactatcaattatcagagcccatgaagcccaagatgctgggtatcgaatgtacaggaagagccaagccacaggctttccatcacttattacaattttctctgcccccaattacctagatgtctataacaataaagctgctgtgttgaaatatgaaaacaatgtcatgaatatcaggcagtttaactgttctccacacccctactggcttccaaactttatggatgttttcacatggtctttgccttttgttggggaaaaagtcacagagatgctggtaaatgtgctcaacatatgctctgatgacgaactgatttctgatgatgaagcagaaggaagcactacagttcgtaaggagatcatcaggaataagatcagagccattgggaagatggcacgggtcttttcaattcttcggcaagaaagtgagagtgtgctgactctcaagggcctgactcccacaggcacactccctctgggcgtcctctcaggaggcaagcagactatcgagacagccatcagagggttctcgcttcagcacaagatccggagttttgaagaagcgcgaggtctggaccgaattaatgagcgaatgccaccccgaaaggatagcatacacgctggtgggccaatgaaatctgtaacctcagcacactcacatgctgcgcacaggagcgaccaagggaagaaagcccattcatgacttagagtcctgccgtggctcaggtggatctaaaactcaagaacaaattctatttatttattattggaaaatgaaaagcaactcaaaacaacttcaacgtggaggtgcatttataattcagtctgcatttattctgtaaaaaggtggctgttttataaattcttttaatttatgttcaatatatataaaaagtgcatctgttttgtttttcccttttttctccataattttaagaaatgaatctgattgttgtcaacacatttgtgaagtcttgtgctataaaggggaacttcccctaataaaagggccttggaaacctcaaacctgggtttctgacttg

SEQ ID NO: 171304 - DNA, 2094 bp, Homo sapiens
  Payload ID: 13693
  Gene Symbol: PPP3CC
  Gene Name: protein phosphatase 3, catalytic subunit, gamma isozyme
  Uniprot ID: P48454
  ENST ID: ENST00000397775
  CDS Start-End: 275-1840
agcggtcgcggtcggtgccgaagcggtgttccccgccttagccgctggcgcctcccaagagagcggccggtgggccctcgtcctgtcagtggcgtcggaggccggcgctgcggtggccgcgcccttctggtgctcggacaccgctgaggagccggggccgggcacggctggctgacggctccgggcagctaaggctgcccgaggagaaggcggcggccgcggcgtaggcgcacgtccggcgggctcctggagcctggaggaggccgaggggaccatgtccgggaggcgcttccacctctccaccaccgaccgcgtcatcaaagctgtcccctttcctccaacccaacggcttactttcaaggaagtatttgagaatgggaaacctaaagttgatgttttaaaaaaccatttggtaaaggaaggacgactggaagaggaagtagccttaaagataatcaatgatggggctgccatcctgaggcaagagaagactatgatagaagtagatgctccaatcacagtatgtggtgatattcatggacaattctttgacctaatgaagttatttgaagttggaggatcacctagtaacacacgctacctctttctgggtgactatgtggacagaggctatttcagtatagagtgtgtgctgtatttatggagtttaaagattaatcatcccaaaacattgtttctgcttcggggaaatcatgaatgcaggcatcttacagactatttcaccttcaaacaggaatgtcgaatcaaatattcggaacaggtgtatgatgcctgtatggagacatttgactgtcttcctcttgctgccctcttaaaccagcagtttctctgtgtacatggaggaatgtcacctgaaattacttctttagatgacattaggaaattagacaggtttacggaacctcccgcctttggacctgtgtgtgacctgctttggtctgatccctcagaggattatggcaatgagaagaccttggagcactatacccacaacactgtccgagggtgctcttatttctacagttaccctgcagtttgtgaatttttgcagaacaataatttactatcaattatcagagcccatgaagcccaagatgctgggtatcgaatgtacaggaagagccaagccacaggctttccatcacttattacaattttctctgcccccaattacctagatgtctataacaataaagctgctgtgttgaaatatgaaaacaatgtcatgaatatcaggcagtttaactgttctccacacccctactggcttccaaactttatggatgttttcacatggtctttgccttttgttggggaaaaagtcacagagatgctggtaaatgtgctcaacatatgctctgatgacgaactgatttctgatgatgaagcagaagatcactacattccaagctatcagaaaggaagcactacagttcgtaaggagatcatcaggaataagatcagagccattgggaagatggcacgggtcttttcaattcttcggcaagaaagtgagagtgtgctgactctcaagggcctgactcccacaggcacactccctctgggcgtcctctcaggaggcaagcagactatcgagacagccacagtagaagcggtagaggcccgggaagccatcagagggttctcgcttcagcacaagatccggagttttgaagaagcgcgaggtctggaccgaattaatgagcgaatgccaccccgaaaggatagcatacacgctggtgggccaatgaaatctgtaacctcagcacactcacatgctgcgcacaggagcgaccaagggaagaaagcccattcatgacttagagtcctgccgtggctcaggtggatctaaaactcaagaacaaattctatttatttattattggaaaatgaaaagcaactcaaaacaacttcaacgtggaggtgcatttataattcagtctgcatttattctgtaaaaaggtggctgttttataaattcttttaatttatgttcaatatatataaaaagtgcatctgttttgtttttcccttttttctccataattttaagaaatgaatctgattgttgtc

SEQ ID NO: 171305 - DNA, 460 bp, Homo sapiens
  Payload ID: 13693
  Gene Symbol: PPP3CC
  Gene Name: protein phosphatase 3, catalytic subunit, gamma isozyme
  ENST ID: ENST00000522000
  CDS Start-End: 1-460
gcacgtccggcgggctcctggagcctggaggaggccgaggggaccatgtccgggaggcgcttccacctctccaccaccgaccgcgtcatcaaagctgtcccctttcctccaacccaacggcttactttcaaggaagtatttgagaatgggaaacctaaagttgatgttttaaaaaaccatttggtaaaggaaggacgactggaagaggaagtagccttaaagataatcaatgatggggctgccatcctgaggcaagagaagactatgatagaagtagatgctccaatcacagtatgtggtgatattcatggacaattctttgacctaatgaagttatttgaagttggaggatcacctagtaacacacgctacctctttctgggtgactatgtggacagaggctatttcagtatagaggtaaaaattaaactggatatgttgggactattatattgtcttt

SEQ ID NO: 171306 - DNA, 680 bp, Homo sapiens
  Payload ID: 13693
  Gene Symbol: PPP3CC
  Gene Name: protein phosphatase 3, catalytic subunit, gamma isozyme
  ENST ID: ENST00000521651
  CDS Start-End: 1-608
agtgtgtgctgtatttatggagtttaaagattaatcatcccaaaacattgtttctgcttcggggaaatcatgaatgcaggcatcttacagactatttcaccttcaaacaggaatgtcgaatcaaatattcggaacaggtgtatgatgcctgtatggagacatttgactgtcttcctcttgctgccctcttaaaccagcagtttctctgtgtacatggaggaatgtcacctgaaattacttctttagatgacattaggaaattagacaggtttacggaacctcccgcctttggacctgtgtgtgacctgctttggtctgatccctcagaggattatggcaatgagaagaccttggagcactatacccacaacactgtccgagggtgctcttatttctacagttaccctgcagtttgtgaatttttgcagaacaataatttactatcaattatcagagcccatgaagcccaagatgctgggtatcgaatgtacaggaagagccaagccacaggctttccatcacttattacaattttctctgcccccaattacctagatgtctataacaataaagagtctgcgacacattcttttgattatcctcaatgatgggaaatcttcgtcctttgagggtggatttgatttttggacagccaaaagtcattcggagtcaagactgat

SEQ ID NO: 171307 - DNA, 1598 bp, Homo sapiens
  Payload ID: 13693
  Gene Symbol: PPP3CC
  Gene Name: protein phosphatase 3, catalytic subunit, gamma isozyme
  ENST ID: ENST00000518852
  CDS Start-End: 592-1572
gttccgggcccgggtaggggctggcaggagagaaggggccggctgcggggagggctggctgagaagaagcgaaaatgggcggttagcagcagggacccggagccggaggagccgagagcagcgcgtgcgccgagctctactgcctcgcgggaaggcggaagggtggggagggcggcgctcggggcgggaggcccggccgggtccgctaggacagcggggccgctgggaagttgtgagagcggcgctcgggggcgcgcttgcgtgcacgagggcccgggccgcgagcagccgcggccgtcccggtcgccacccttagcagcggtcgcggtcggtgccgaagcggtgttccccgccttagccgctggcgcctcccaagagagcggccggtgggccctcgtcctgtcagtggcgtcggaggccggcgctgcggtggccgcgcccttctggtgctcggacaccgctgaggagccggggccgggcacggctggctgacggctccgggcagctaaggctgcccgaggagaaggcggcggccgcggcgtaggcgcacgtccggcgggctcctggagcctggaggaggccgaggggaccatgtccgggaggcgcttccacctctccaccaccgaccgcgtcatcaaagctgtcccctttcctccaacccaacggcttactttcaaggaagtatttgagaatgggaaacctaaagttgatgttttaaaaaaccatttggtaaaggaaggacgactggaagaggaagtagccttaaagataatcaatgatggggctgccatcctgaggcaagagaagactatgatagaagtagatgctccaatcacagtatgtggtgatattcatggacaattctttgacctaatgaagttatttgaagttggaggatcacctagtaacacacgctacctctttctgggtgactatgtggacagaggctatttcagtatagagtgtgtgctgtatttatggagtttaaagattaatcatcccaaaacattgtttctgcttcggggaaatcatgaatgcaggcatcttacagactatttcaccttcaaacaggaatgtcgaatcaaatattcggaacaggtgtatgatgcctgtatggagacatttgactgtcttcctcttgctgccctcttaaaccagcagtttctctgtgtacatggaggaatgtcacctgaaattacttctttagatgacattaggaaattagacaggtttacggaacctcccgcctttggacctgtgtgtgacctgctttggtctgatccctcagaggattatggcaatgagaagaccttggagcactatacccacaacactgtccgagggtgctcttatttctacagttaccctgcagtttgtgaatttttgcagaacaataatttactatcaattatcagagcccatgaagcccaagatgctgggtatcgaatgtacaggaagagccaagccacaggctttccatcacttattacaattttctctgcccccaattacctagatgtctataacaataaaggtaaaggaatccagcaatatttgagtttgaatttatgagtaaacgtgagctctggtttaattgt

SEQ ID NO: 171308 - DNA, 619 bp, Homo sapiens
  Payload ID: 13693
  Gene Symbol: PPP3CC
  Gene Name: protein phosphatase 3, catalytic subunit, gamma isozyme
  ENST ID: ENST00000523620
  CDS Start-End: 217-619
gaggtattgttaacctattatccacaacttttcaaaagtatctttacaaagataattgtgctttcaaatcatctaaaataaatggctctaaagtagcttcatattctcctggcctatatcctttttcaaatgtgatacgttttagttcttccattgactggttttccttttttgttaggtcgaatcaaatattcggaacaggtgtatgatgcctgtatggagacatttgactgtcttcctcttgctgccctcttaaaccagcagtttctctgtgtacatggaggaatgtcacctgaaattacttctttagatgacattaggaaattagacaggtttacggaacctcccgcctttggacctgtgtgtgacctgctttggtctgatccctcagaggattatggcaatgagaagaccttggagcactatacccacaacactgtccgagggtgctcttatttctacagttaccctgcagtttgtgaatttttgcagaacaataatttactatcaattatcagagcccatgaagcccaagatgctgggtatcgaatgtacaggaagagccaagccacaggctttccatcacttattacaattttctctgcccccaattacctag

SEQ ID NO: 171309 - DNA, 626 bp, Homo sapiens
  Payload ID: 13693
  Gene Symbol: PPP3CC
  Gene Name: protein phosphatase 3, catalytic subunit, gamma isozyme
  ENST ID: ENST00000522034
  CDS Start-End: 1-626
gactatgtggacagaggctatttcagtatagaggtcgaatcaaatattcggaacaggtgtatgatgcctgtatggagacatttgactgtcttcctcttgctgccctcttaaaccagcagtttctctgtgtacatggaggaatgtcacctgaaattacttctttagatgacattaggaaattagacaggtttacggaacctcccgcctttggacctgtgtgtgacctgctttggtctgatccctcagaggattatggcaatgagaagaccttggagcactatacccacaacactgtccgagggtgctcttatttctacagttaccctgcagtttgtgaatttttgcagaacaataatttactatcaattatcagagcccatgaagcccaagatgctgggtatcgaatgtacaggaagagccaagccacaggctttccatcacttattacaattttctctgcccccaattacctagatgtctataacaataaagctgctgtgttgaaatatgaaaacaatgtcatgaatatcaggcagtttaactgttctccacacccctactggcttccaaactttatggatgttttcacatggtctttgccttttgttggggaaaaaggtaagaga

SEQ ID NO: 171310 - DNA, 3023 bp, Homo sapiens
  Payload ID: 13694
  Gene Symbol: PPP3R1
  Gene Name: protein phosphatase 3, regulatory subunit B, alpha
  Uniprot ID: P63098
  ENST ID: ENST00000234310
  CDS Start-End: 405-917
tgccttgaggttgcgggtcagcgcgagccgctgcagtgagtccgtcacggctccggcgcgagcgcgaggctgcagcccccgagtttcccggccgtcttcgccccctctccccctcctttcttcttctctgcctctcctgcctctcgccgctgctcctcccgcgctctccggctctgaatctcgaccttaatttatttccccctaccctgcccgctccctcgcgtgcccaatcgcccggccggcgcgggccccgcggcgccgcctcccctcccccacgcgcgccccctccccgccggcgacccgagggccgcagctgggccgccgccgccgtttcctgcgagccagcctgagcgcaacacttctccgagccagcgagccagcgagccgccgacccgccgagcaaaatgggaaatgaggcaagttatcctttggaaatgtgctcacactttgatgcggatgaaattaaaaggctaggaaagagatttaagaagcttgatttggacaattctggttctttgagtgtggaagagttcatgtctctgcctgagttacaacagaatcctttagtacagcgagtaatagatatattcgacacagatgggaatggagaagtagactttaaagaattcattgagggcgtctctcagttcagtgtcaaaggagataaggagcagaaattgaggtttgctttccgtatctatgacatggataaagatggctatatttccaatggggaactcttccaggtattgaagatgatggtggggaacaatctgaaagatacacagttacagcaaattgtagacaaaaccataataaatgcagataaggatggagatggaagaatatcctttgaagaattctgtgctgttgtaggtggcctagatatccacaaaaagatggtggtagatgtgtgactcttatcagagagtaccacccaacacttttgctttcttctccatctctgaagatctgctcaagacgtccagcaatgctctctgtgtatttaaatggaagtatttttctctgtgaagccacattttccaacatgagcctcatgaagccaactaagtgttattgaactgtaattctctcaataactcagtgtagcactttaaagtctgaaggacagcaacatgaaaagagcatatcaatgtggtggagaaagggaaggggttggctttttaatttatttttcttcatcttttataacaagaaagtatctatatatacatatgtaaatatttatatatagatatatgtagctttctatatatgtagtaggttggctttaatttaatatacttgattcagaaacaaaacaatagagtacaaaagtgccaagcagaacataaaacatccttacttttatttcacacagttttatatatagatagaagactgtacaatttgagccgggtgttaggccagctattttccttttcctgtgctttctcctttgagagattgacaaagcatttgttaacgtcctattatttaccttaattacatttttgtaacaaaggagtctgtaactttatttatacttatgaatatatccagggactacttctcattgctgagcagcttttaatacacctctgcttgaggagaaagtctagttcattgctactgccaagagctagttcttgtgttcatatagtaactgcacagggcttatagctgcttcattctgctactttgtaactaggagccattgcatttattaaatgtccctcagtaacgttaagtgctagttgtgattttatacataaaggccagaagctgtctgaggcaatcatgattgattgtatgtatcacttactgaagaatacctgaagtgatcatgtaactacttataagggatatccatttgtttgattacatgggtaaataatttgtcattaaacttgtgtttgaatcatgaattcccttgtttcaaaagacttgcagctaatctaaaaaactggtgatatttaatatgcatgtatgtatctaaacacccacatatatttgtggtttaagtgtgagaaatcttgctaatctatatgccacagaagagcaaaattgtatccaaatttatgccacttaaatttctttaccacgagggatagagcatgcatactggtttttttttcttgatttgcccatataattggtaatggataacttaataaatttgtgtgatataaaagtagtgtatcatgttctactgtttgatcttatcccttcccatttctgcaaaggtactgttagctggaagaaaaacattttggttagctttgtatgacagtagtctttccctttatagtttctctataaaaactggttttaaaatcagtggaaaagggcaggttgaatcaaggtgaatcaatctgaaattgagcacacctgcctgccatcgctgttccttcaactgagtgctgcacatcatgggctctgtctgtgagagaaaaatcccggtgcttggtgtccttgcatgacatggagttttgcatgtagatcaatttaaaatgtacctcttgtttacataatttgcataattttaaaagataatgttgccaaactttggaaatgttaatgttcagactgaaaatctccactacatgtaactttcttcctctggatcagtggcatggcttataatcccagccagtggtttgaactgttccagtgtcaactgccatgtgctctgcttcaagggggaactagccttttgtgaattttttgtacataagtatttgttacaaatattttagcaaatgctttctatttctcttgcttgtgcatatcttggctggcgttacagaaaaatagtgtaaacattatttccttaccggggaatgagggttttttctttttctttttttttttttttttttttagtttgtgtgtgggggtgggtaagggaggggatggtttatgttgaatgtttagtttttcttctgcatgatacgtcatgttgtgggatctttagaaaacttcatactgtatgaataagaaaataaaatatttgaaacttg

SEQ ID NO: 171311 - DNA, 684 bp, Homo sapiens
  Payload ID: 13694
  Gene Symbol: PPP3R1
  Gene Name: protein phosphatase 3, regulatory subunit B, alpha
  ENST ID: ENST00000409377
  CDS Start-End: 186-668
agtcgttagtttcctctttgtaatcaagagttgtatacacagtagagaaagttcagagtgctattccgcgtatatcagatactccatcatgcgattcagttattaggctttctctaaaagtctttgaacagttgtcagaagacttaaactggttgacgggaaatgaggcaagttatcctttggaaatgtgctcacactttgatgcggatgaaattaaaaggctaggaaagagatttaagaagcttgatttggacaattctggttctttgagtgtggaagagttcatgtctctgcctgagttacaacagaatcctttagtacagcgagtaatagatatattcgacacagatgggaatggagaagtagactttaaagaattcattgagggcgtctctcagttcagtgtcaaaggagataaggagcagaaattgaggtttgctttccgtatctatgacatggataaagatggctatatttccaatggggaactcttccaggtattgaagatgatggtggggaacaatctgaaagatacacagttacagcaaattgtagacaaaaccataataaatgcagataaggatggagatggaagaatatcctttgaagaattctgtgctgttgtaggtggcctagatatccacaaaaagatggtggtagatgtgtgactcttatcagagagta

SEQ ID NO: 171312 - DNA, 851 bp, Homo sapiens
  Payload ID: 13694
  Gene Symbol: PPP3R1
  Gene Name: protein phosphatase 3, regulatory subunit B, alpha
  ENST ID: ENST00000409752
  CDS Start-End: 123-692
ttggcatctcaggtgcctgggagccctttctcaaccacaccctggagtagggggctagcttgcatccctgcgttctcctcattacaaaaaagaattctgagaaggaaggtgatctattccctatgcaacctcagtgtccactgagaagggaatcttgtggtatggaactatgtggcaaaaagggaaatgaggcaagttatcctttggaaatgtgctcacactttgatgcggatgaaattaaaaggctaggaaagagatttaagaagcttgatttggacaattctggttctttgagtgtggaagagttcatgtctctgcctgagttacaacagaatcctttagtacagcgagtaatagatatattcgacacagatgggaatggagaagtagactttaaagaattcattgagggcgtctctcagttcagtgtcaaaggagataaggagcagaaattgaggtttgctttccgtatctatgacatggataaagatggctatatttccaatggggaactcttccaggtattgaagatgatggtggggaacaatctgaaagatacacagttacagcaaattgtagacaaaaccataataaatgcagataaggatggagatggaagaatatcctttgaagaattctgtgctgttgtaggtggcctagatatccacaaaaagatggtggtagatgtgtgactcttatcagagagtaccacccaacacttttgctttcttctccatctctgaagatctgctcaagacgtccagcaatgctctctgtgtatttaaatggaagtatttttctctgtgaagccacattttccaacatgagcctcatgaagccaactaagtgtt

SEQ ID NO: 171313 - DNA, 3387 bp, Homo sapiens
  Payload ID: 13695
  Gene Symbol: PPP3R2
  Gene Name: protein phosphatase 3, regulatory subunit B, beta
  Uniprot ID: Q96LZ3
  ENST ID: ENST00000374806
  CDS Start-End: 72-593
gggcacgagccccgcccgagctcaccgcccctgctcccctctccgaccctttgagccgtggccgttgccagatgtccacaatgggaaacgaggccagttacccggcggagatgtgctcccactttgacaatgatgaaattaaaaggctgggcaggaggtttaagaagttggacttggacaaatcagggtctctgagcgtggaggagttcatgtccctgccggagctgcgccacaacccgttggtgcggcgagtgatcgacgtcttcgacaccgacggtgatggagaagtggacttcaaggaattcatcctggggacctcccagttcagcgtcaagggcgacgaggagcagaagttgaggtttgcgttcagcatttacgacatggataaagatggctacatttccaacggggagctcttccaggtgctgaagatgatggtgggcaacaacctgacggactggcagctccagcagctggtcgacaaaaccatcatcatcctggacaaggatggcgatgggaagatatcctttgaggaattcagtgctgtggtcagagacctggagatccacaagaagctggtcctcatcgtatgagcctttttcttacaagcaccacccaacaacttctgctttcttccctatctctttcaagatttgctcaagacgtccaactgtctctctgacttatctggaagtatttctttttgtgaagccatatgtcctaacaggagcttcatcaccaactcagtgctattaattctccttctctgaatgactcagggtaccctatagggggaagagcaagtcaaatgagcatagtggggaaagaaaaggaaatggcttttataaacatcttttactttgttttgattcaaagaccaaactagaactttaaaagttcaaaaataagaaagtatacatttttgctgttatttctcatcattttgtatatgggaggaaatttataatttgcatgggtgttaggtgaactgttttcatttgcttgtgttcagatatcttgccagattgttaacttcctattgtagcaacagggacaaatatatttgtctttgctgggcatctcgtaatcacttttcttaggggacagaatcccatcttttccttcggcagattgcagccccattccccacaatgcatccagaaatcgctgtgcatgtttgaggggtaggagttcatttggcctcctcctgacttgttgctccagctcctgaacagaaactagcttcagggctcttataggaaatgctaagcctggactaagtgcccagctcagccatcatcctcattagcagtgggtttccagggttggcagcccacaccagcattaatttcaatgaaggggacctccagctaaatagggcaagcaaagtgttctcccagaaagtgctctcacctccgacactggtccctacccccaggtggagacaatgagacatttagttagttgtcctacggaggagaggcagtagagtcaggctgcagtggaatctccctaggatgccaaagtggcattatgtctgttgctcacagatgcagagactgacaattgtgtctccacagcagaggtggatgctagctacaccagctatgctgattttgaaaatcagatctgaggcctagaagagaaactgagagctctctcattccaggaagccttttccctagtggaacattcagtgcagaagtcctcacacactaacagatctccaccattgggtgagccggagcctgtggttccaggggagatccagaatgcatgtgtctcttcccacgcatttatgtcatgttggtagctttagatcagccatggtgagaaaagaacaaaagcttttagttgtttttgttttgttttggagaatttgtttaccagtaaatacatcactgcctgtaccccaaatgttaccagctccctgaggtgtcccacatactattgtgagttctcagagcatgaactgtcctcagaagagcagggctaggacttgtcccagcatctgtgcctccataccaatcctctttctcacagagaaccacttcccatataagatgcttaaggctctcaaaacagcagaacaatgaaacatactctccctacacttgcttagccaagagataccactcaggtaacttttttcaggacatggaagatctgtttcaaggagatttactgctattttatttggaagaagctggcaactggtcttgaccaaaatagaaaaaaaaaaaaaaagtccacaaatttaatcacttgtagggaacccatctatcaaggtaccctaccatatacttttgtatttaatagattacttagaaaccacaaaaataggaatccttaccccttcaattcctgttcaaccctaaaaactgtgataaacgctcccaaccctgtggtgatcagggttatgtaatgttcaaagattcagacacacctgggtttggattcagttgcaactgggttgttatcacactcacttctttttagctgtgtgagcatgaataatttacttagcctctctgtgtctttccacctaattaaagaggatccaccccagggttattttgaggattcaaaaaggcatgcaacacacctggagcacaattccactttcattcaactaattcccttcccttcccccttcttccccttctacaagatcaatatgtaaaggagacatgaggcttactggttgcttttgaacacttacttagttcttagctacacccactctaaaattaactggacattagtgtacagcccatgtccaagcccagagagaaaacaatgggaacaatttcaaggtcctcaccactccttcatttgcagaggggacaacagactttctgacctgagaactggagaatttttaaaacaaaatctctcattccagcccaacctatttaactttttgtggaggaattttacatggaggaagtgagcacatgtcatgctagccaagaggacattattgtcattaaagagaggcattatttatacaccctgcaatgtgcacattaaaatatggaaattttaaaattatgaccaagggcttgaaacatattggattacatgctcacatttaacaaagagaggaaatgtgtttcagtttctggagtggctggaatttacaagctaattgttcaataaatctactcaagatagttacctaaggctttgtggcaatgaccttgaactgagagcctgtatctggatttagcacttgaaagatctaactggatatttgggttaaaagaatcacatttattcccaaatcggaatgctttgtttttcctgtcagttaattgccagttgccaacaaatctagttctatacagtttcttgggatgatgataataaacatttattgagcaa

SEQ ID NO: 171314 - DNA, 1407 bp, Homo sapiens
  Payload ID: 13696
  Gene Symbol: PPP4C
  Gene Name: protein phosphatase 4, catalytic subunit
  Uniprot ID: P60510
  ENST ID: ENST00000279387
  CDS Start-End: 169-1092
cggggccggaagtaggagcggcggcggcggcggcggcggcggtcgaaagcggagtgaaagagggaggcagggagccggagagccggaaccggagtcgcagcggcggagacccctgtgcggtgcggagggggcggcggccccgactctgacccgcgccgggggtgggccatggcggagatcagcgacctggaccggcagatcgagcagctgcgtcgctgcgagctcatcaaggagagcgaagtcaaggccctgtgcgctaaggccagagagatcttggtagaggagagcaacgtgcagagggtggactcgccagtcacagtgtgcggcgacatccatggacaattctatgacctcaaagagctgttcagagtaggtggcgacgtccctgagaccaactacctcttcatgggggactttgtggaccgtggcttctatagcgtcgaaacgttcctcctgctgctggcacttaaggttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaagatcttctgcgtgcacgggggcctctccccctccatccagaccctggatcagattcggacaatcgaccgaaagcaagaggtgcctcatgatgggcccatgtgtgacctcctctggtctgacccagaagacaccacaggctggggcgtgagcccccgaggagccggctacctatttggcagtgacgtggtggcccagttcaacgcagccaatgacattgacatgatctgccgtgcccaccaactggtgatggaaggttacaagtggcacttcaatgagacggtgctcactgtgtggtcggcacccaactactgctaccgctgtgggaatgtggcagccatcttggagctggacgagcatctccagaaagatttcatcatctttgaggctgctccccaagagacacggggcatcccctccaagaagcccgtggccgactacttcctgtgaccccgcccggcccctgccccctccaacccttctggccctcgcaccactgtgactctgccatcttcctcagacggaggctgggcgtggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattctaataaaagaagaaaaatggtt

SEQ ID NO: 171315 - DNA, 846 bp, Homo sapiens
  Payload ID: 13696
  Gene Symbol: PPP4C
  Gene Name: protein phosphatase 4, catalytic subunit
  ENST ID: ENST00000563732
  CDS Start-End: 181-333
ttgcttccgcggcggggccggaagtaggagcggcggcggcggcggcggcggcggtcgaaagcggagtgaaagagggaggcagggagccggagagccggaaccggagtcgcagcggcggagacccctgtgcggtgcggagggggcggcggccccgactctgacccgcgccgggggtgggccatggcggagatcagcgacctggaccggcagatcgagcagctgcgtcgctgcgagctcatcaaggagagcgaagtcaaggccctgtgcgctaaggccaggtgtgcggcgacatccatggacaattctatgacctcaaagagctgttcagagtaggtggcgacgtccctgagaccaactacctcttcatgggggactttgtggaccgtggcttctatagcgtcgaaacgttcctcctgctgctggcacttaaggttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaagatcttctgcgtgcacgggggcctctccccctccatccagaccctggatcagattcggacaatcgaccgaaagcaagaggtgcctcatgatgggcccatgtgtgacctcctctggtctgacccagaagacaccacaggctggggcgtgagcccccgaggagccggctacctatttggcagtgacgtggtggcccagttcaacgcagccaatgacattgacatgatctgccgtgcccaccaac

SEQ ID NO: 171316 - DNA, 1333 bp, Homo sapiens
  Payload ID: 13696
  Gene Symbol: PPP4C
  Gene Name: protein phosphatase 4, catalytic subunit
  Uniprot ID: P60510
  ENST ID: ENST00000561610
  CDS Start-End: 154-1077
gtgggggagccgggccggctctagaatcgagttgtccgctccgagccccggacggacactgatccgcgggctcgtcttggcctttcccaggagacccctgtgcggtgcggagggggcggcggccccgactctgacccgcgccgggggtgggccatggcggagatcagcgacctggaccggcagatcgagcagctgcgtcgctgcgagctcatcaaggagagcgaagtcaaggccctgtgcgctaaggccagagagatcttggtagaggagagcaacgtgcagagggtggactcgccagtcacagtgtgcggcgacatccatggacaattctatgacctcaaagagctgttcagagtaggtggcgacgtccctgagaccaactacctcttcatgggggactttgtggaccgtggcttctatagcgtcgaaacgttcctcctgctgctggcacttaaggttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaagatcttctgcgtgcacgggggcctctccccctccatccagaccctggatcagattcggacaatcgaccgaaagcaagaggtgcctcatgatgggcccatgtgtgacctcctctggtctgacccagaagacaccacaggctggggcgtgagcccccgaggagccggctacctatttggcagtgacgtggtggcccagttcaacgcagccaatgacattgacatgatctgccgtgcccaccaactggtgatggaaggttacaagtggcacttcaatgagacggtgctcactgtgtggtcggcacccaactactgctaccgctgtgggaatgtggcagccatcttggagctggacgagcatctccagaaagatttcatcatctttgaggctgctccccaagagacacggggcatcccctccaagaagcccgtggccgactacttcctgtgaccccgcccggcccctgccccctccaacccttctggccctcgcaccactgtgactctgccatcttcctcagacggaggctgggcgtggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttctgtttgttt

SEQ ID NO: 171317 - DNA, 941 bp, Homo sapiens
  Payload ID: 13696
  Gene Symbol: PPP4C
  Gene Name: protein phosphatase 4, catalytic subunit
  ENST ID: ENST00000562664
  CDS Start-End: 141-941
ggcggcggcggcggtcgaaagcggagtgaaagagggaggcagggagccggagagccggaaccggagtcgcagcggcggagacccctgtgcggtgcggagggggcggcggccccgactctgacccgcgccgggggtgggccatggcggagatcagcgacctggaccggcagatcgagcagctgcgtcgctgcgagctcatcaaggagagcgaagtcaaggccctgtgcgctaaggccagagagatcttggtagaggagagcaacgtgcagagggtggactcgccagtcacagtgtgcggcgacatccatggacaattctatgacctcaaagagctgttcagagttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaagatcttctgcgtgcacgggggcctctccccctccatccagaccctggatcagattcggacaatcgaccgaaagcaagaggtgcctcatgatgggcccatgtgtgacctcctctggtctgacccagaagacaccacaggctggggcgtgagcccccgaggagccggctacctatttggcagtgacgtggtggcccagttcaacgcagccaatgacattgacatgatctgccgtgcccaccaactggtgatggaaggttacaagtggcacttcaatgagacggtgctcactgtgtggtcggcacccaactactgctaccgctgtgggaatgtggcagccatcttggagctggacgagcatctccagaaagatttcatcatctttgaggctgctccccaagagacacggggcatcccctccaagaagccc

SEQ ID NO: 171318 - DNA, 742 bp, Homo sapiens
  Payload ID: 13696
  Gene Symbol: PPP4C
  Gene Name: protein phosphatase 4, catalytic subunit
  ENST ID: ENST00000562222
  CDS Start-End: 133-742
tcgaaagcggagtgaaagagggaggcagggagccggagagccggaaccggagtcgcagcggcggtaatagagacccctgtgcggtgcggagggggcggcggccccgactctgacccgcgccgggggtgggccatggcggagatcagcgacctggaccggcagatcgagcagctgcgtcgctgcgagctcatcaaggagagcgaagtcaaggccctgtgcgctaaggccagagagatcttggtagaggagagcaacgtgcagagggtggactcgccagtcacagtgtgcggcgacatccatggacaattctatgacctcaaagagctgttcagagttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaagatcttctgcgtgcacgggggcctctccccctccatccagaccctggatcagattcggacaatcgaccgaaagcaagaggtgcctcatgatgggcccatgtgtgacctcctctggtctgacccagaagacaccacaggctggggcgtgagcccccgaggagccggctacctatttggcagtgacgtggtggcccagttcaacgcagccaatgacattgacatgatctgccgtgccc

SEQ ID NO: 171319 - DNA, 815 bp, Homo sapiens
  Payload ID: 13696
  Gene Symbol: PPP4C
  Gene Name: protein phosphatase 4, catalytic subunit
  ENST ID: ENST00000563597
  CDS Start-End: 154-324
gagcggcggcggcggcggcggcggcggtcgaaagcggagtgaaagagggaggcagggagccggagagccggaaccggagtcgcagcggcggagacccctgtgcggtgcggagggggcggcggccccgactctgacccgcgccgggggtgggccatggcggagatcagcgacctggaccggcagatcgagcagctgcgtcgctgcgagctcatcaaggagagcgaagtcaaggccctgtgcgctaaggccaggtcaggaattgggctgggctggcctggctgtggtgaccctggtcttctcctgtctccagagagatcttggtagaggagagcaacgtgcagagggtggactcgccagtcacagtgtgcggcgacatccatggacaattctatgacctcaaagagctgttcagagtaggtggcgacgtccctgagaccaactacctcttcatgggggactttgtggaccgtggcttctatagcgtcgaaacgttcctcctgctgctggcacttaaggttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaagatcttctgcgtgcacgggggcctctccccctccatccagaccctggatcagattcggacaatcgaccgaaagcaagaggtgcctcatgatgggcccatgtgtgacctcctctggtctgacccagaa

SEQ ID NO: 171320 - DNA, 1490 bp, Homo sapiens
  Payload ID: 13696
  Gene Symbol: PPP4C
  Gene Name: protein phosphatase 4, catalytic subunit
  ENST ID: ENST00000566749
  CDS Start-End: 142-504
cggcggcggcggcggtcgaaagcggagtgaaagagggaggcagggagccggagagccggaaccggagtcgcagcggcggagacccctgtgcggtgcggagggggcggcggccccgactctgacccgcgccgggggtgggccatggcggagatcagcgacctggaccggcagatcgagcagctgcgtcgctgcgagctcatcaaggagagcgaagtcaaggccctgtgcgctaaggccagagagatcttggtagaggagagcaacgtgcagagggtggactcgccagtcacagtgtgcggcgacatccatggacaattctatgacctcaaagagctgttcagagtaggtggcgacgtccctgagaccaactacctcttcatgggggactttgtggaccgtggcttctatagcgtcgaaacgttcctcctgctgctggcacttaaggtggcagtccccggcttctgcacccccaacctgggcgacctcgggccgggcctgtcttagtccgttccgccctcatctcctatcgtgaccagccccaccttggagctgtgtcactggttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaagatcttctgcgtgcacgggggcctctccccctccatccagaccctggatcagattcggacaatcgaccgaaagcaagaggtgcctcatgatgggcccatgtgtgacctcctctggtctgacccagaagacaccacaggctggggcgtgagcccccgaggagccggctacctatttggcagtgacgtggtggcccagttcaacgcagccaatgacattgacatgatctgccgtgcccaccaactggtgatggaaggttacaagtggcacttcaatgagacggtgctcactgtgtggtcggcacccaactactgctaccgctgtgggaatgtggcagccatcttggagctggacgagcatctccagaaagatttcatcatctttgaggctgctccccaagagacacggggcatcccctccaagaagcccgtggccgactacttcctgtgaccccgcccggcccctgccccctccaacccttctggccctcgcaccactgtgactctgccatcttcctcagacggaggctgggcgtggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattctaataaaagaagaaaa

SEQ ID NO: 171321 - DNA, 1301 bp, Homo sapiens
  Payload ID: 13696
  Gene Symbol: PPP4C
  Gene Name: protein phosphatase 4, catalytic subunit
  ENST ID: ENST00000627746
  CDS Start-End: 136-288
cggcggcggtcgaaagcggagtgaaagagggaggcagggagccggagagccggaaccggagtcgcagcggcggagacccctgtgcggtgcggagggggcggcggccccgactctgacccgcgccgggggtgggccatggcggagatcagcgacctggaccggcagatcgagcagctgcgtcgctgcgagctcatcaaggagagcgaagtcaaggccctgtgcgctaaggccaggtgtgcggcgacatccatggacaattctatgacctcaaagagctgttcagagtaggtggcgacgtccctgagaccaactacctcttcatgggggactttgtggaccgtggcttctatagcgtcgaaacgttcctcctgctgctggcacttaaggttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaagatcttctgcgtgcacgggggcctctccccctccatccagaccctggatcagattcggacaatcgaccgaaagcaagaggtgcctcatgatgggcccatgtgtgacctcctctggtctgacccagaagacaccacaggctggggcgtgagcccccgaggagccggctacctatttggcagtgacgtggtggcccagttcaacgcagccaatgacattgacatgatctgccgtgcccaccaactggtgatggaaggttacaagtggcacttcaatgagacggtgctcactgtgtggtcggcacccaactactgctaccgctgtgggaatgtggcagccatcttggagctggacgagcatctccagaaagatttcatcatctttgaggctgctccccaagagacacggggcatcccctccaagaagcccgtggccgactacttcctgtgaccccgcccggcccctgccccctccaacccttctggccctcgcaccactgtgactctgccatcttcctcagacggaggctgggcgtggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattct

SEQ ID NO: 171322 - DNA, 2917 bp, Homo sapiens
  Payload ID: 13697
  Gene Symbol: PPP4R1
  Gene Name: protein phosphatase 4, regulatory subunit 1
  ENST ID: ENST00000285124
  CDS Start-End: 22-276
ggaggagggggcgaccacaagatggcggacctctcgctgcttcaggaggacctgcaggaggacgcagacggatccctggactttgtctcacaagatgaaatgttgacgcccctggggagattggacaagtatgctgcaagtgagaacatatttaacagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttgatgtggagaccaaagtgtgccctgtcctcatagagctgacagccccagatagcaatgatgatgtgaaaacagaagctgtggctataatgtgcaaaatggctcccatggttgggaaggatattacagagcgtcttatcctccctaggttttgtgagatgtgctgcgattgcagaatgtttcacgttcgaaaggtctgtgctgccaattttggagatatttgcagtgtagttggccagcaagctactgaagaaatgttgctgcccagatttttccagctttgttctgataatgtatggggagtccgaaaggcttgtgctgaatgcttcatggcggtttcatgtgcaacatgtcaagaaatccgacggaccaaattatcagcactttttattaatttgatcagtgatccttcacgttgggttcgccaagcagcttttcagtctctgggacctttcatatctacttttgctaatccatctagctcaggccagtattttaaagaagaaagcaaaagttcagaagagatgtcagtagaaaacaaaaataggaccagagatcaagaagccccagaggatgtacaagtcaggccagaggatactccttcagatctcagtgttagtaattccagtgtcatactggaaaacacgatggaagaccatgctgctgaggcatccgggaagcctctaggtgaaattagtgttccactggacagctctttactttgtactttgtcctcagaatctcaccaggaagcagctagtaatgagaatgataaaaaacctggtaactacaaatctatgttacgaccagaggttggcaccacttcacaagattcagctctcttagatcaggaattgtataactccttccatttctggaggactcctcttcctgaaatagatctagacatagagcttgaacagaactctgggggaaaacccagcccagagggaccagaggaagaatctgagggccctgtgcccagttctccaaacatcaccatggccaccagaaaggaactggaagaaatgatagaaaatctagagccccacattgatgatccagatgttaaagcacaagtggaagtgctgtccgctgcactacgtgcttccagcctggatgcacatgaagagaccatcagtatagaaaagagaagtgatttgcaagatgaactggatataaatgagctaccaaattgtaaaataaatcaagaagattctgtgcctttaatcagcgatgctgttgagaggtgctttgtttctgatcggaccatttcactgcagcaagcaacacagtattctgagcagaagatcgggacttgaggccatgttgcggagggccagtgacattatctggactctggagtgtgaggaatatggactccactcttcactatattcacagcgattcagacttgagcaacaatagcagttttagccctgatgaggaaaggagaactaaagtacaagatgttgtacctcaggcgttgttagatcagtatttatctatgactgacccttctcgtgcacagacggttgacactgaaattgctaagcactgtgcatatagcctccctggtgtggccttgacactcggaagacagaattggcactgcctgagagagacgtatgagactctggcctcagacatgcagtggaaagttcgacgaactctagcattctccatccacgagcttgcagttattcttggagatcaattgacagctgcagatctggttccaatttttaatggatttttaaaagacctcgatgaagtcaggataggtgttcttaaacacttgcatgattttctgaagcttcttcatattgacaaaagaagagaatatctttatcaacttcaggagtttttggtgacagataatagtagaaattggcggtttcgagctgaactggctgaacagctgattttacttctagagttatatagtcccagagatgtttatgactatttacgtcccattgctctgaatctgtgtgcagacaaagtttcttctgttcgttggatttcctacaagttggtcagcgagatggtgaagaagctgcacgcggcaacaccaccaacgttcggagtggacctcatcaatgagcttgtggagaactttggcagatgtcccaagtggtctggtcggcaagcctttgtctttgtctgccagactgtcattgaggatgactgccttcccatggaccagtttgctgtgcatctcatgccgcatctgctaaccttagcaaatgacagggttcctaacgtgcgagtgctgcttgcaaagacattaagacaaactctactagaaaaagactatttcttggcctctgccagctgccaccaggaggctgtggagcagaccatcatggctcttcagatggaccgtgacagcgatgtcaagtattttgcaagcatccaccctgccagtaccaaaatctccgaagatgccatgagcacagcgtcctcaacctactagaaggcttgaatctcggtgtctttcctgcttccatgagagccgaggttcagtgggcattcgccacgcatgtgacctg

SEQ ID NO: 171323 - DNA, 3885 bp, Homo sapiens
  Payload ID: 13697
  Gene Symbol: PPP4R1
  Gene Name: protein phosphatase 4, regulatory subunit 1
  Uniprot ID: Q8TF05
  ENST ID: ENST00000400555
  CDS Start-End: 86-2887
gcgcgcgtccaccggctccccggctcgcgccgctccatgtagccccggctccccgggcggccgcggaggagggggcgaccacaagatggcggacctctcgctgcttcaggaggacctgcaggaggacgcagacggatccctggactttgtctcacaagatgaaatgttgacgcccctggggagattggacaagtatgctgcaagtgagaacatatttaacagacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttgatgtggagaccaaagtgtgccctgtcctcatagagctgacagccccagatagcaatgatgatgtgaaaacagaagctgtggctataatgtgcaaaatggctcccatggttgggaaggatattacagagcgtcttatcctccctaggttttgtgagatgtgctgcgattgcagaatgtttcacgttcgaaaggtctgtgctgccaattttggagatatttgcagtgtagttggccagcaagctactgaagaaatgttgctgcccagatttttccagctttgttctgataatgtatggggagtccgaaaggcttgtgctgaatgcttcatggcggtttcatgtgcaacatgtcaagaaatccgacggaccaaattatcagcactttttattaatttgatcagtgatccttcacgttgggttcgccaagcagcttttcagtctctgggacctttcatatctacttttgctaatccatctagctcaggccagtattttaaagaagaaagcaaaagttcagaagagatgtcagtagaaaacaaaaataggaccagagatcaagaagccccagaggatgtacaagtcaggccagaggatactccttcagatctcagtgttagtaattccagtgtcatactggaaaacacgatggaagaccatgctgctgaggcatccgggaagcctctaggtgaaattagtgttccactggacagctctttactttgtactttgtcctcagaatctcaccaggaagcagctagtaatgagaatgataaaaaacctggtaactacaaatctatgttacgaccagaggttggcaccacttcacaagattcagctctcttagatcaggaattgtataactccttccatttctggaggactcctcttcctgaaatagatctagacatagagcttgaacagaactctgggggaaaacccagcccagagggaccagaggaagaatctgagggccctgtgcccagttctccaaacatcaccatggccaccagaaaggaactggaagaaatgatagaaaatctagagccccacattgatgatccagatgttaaagcacaagtggaagtgctgtccgctgcactacgtgcttccagcctggatgcacatgaagagaccatcagtatagaaaagagaagtgatttgcaagatgaactggatataaatgagctaccaaattgtaaaataaatcaagaagattctgtgcctttaatcagcgatgctgttgagaatatggactccactcttcactatattcacagcgattcagacttgagcaacaatagcagttttagccctgatgaggaaaggagaactaaagtacaagatgttgtacctcaggcgttgttagatcagtatttatctatgactgacccttctcgtgcacagacggttgacactgaaattgctaagcactgtgcatatagcctccctggtgtggccttgacactcggaagacagaattggcactgcctgagagagacgtatgagactctggcctcagacatgcagtggaaagttcgacgaactctagcattctccatccacgagcttgcagttattcttggagatcaattgacagctgcagatctggttccaatttttaatggatttttaaaagacctcgatgaagtcaggataggtgttcttaaacacttgcatgattttctgaagcttcttcatattgacaaaagaagagaatatctttatcaacttcaggagtttttggtgacagataatagtagaaattggcggtttcgagctgaactggctgaacagctgattttacttctagagttatatagtcccagagatgtttatgactatttacgtcccattgctctgaatctgtgtgcagacaaagtttcttctgttcgttggatttcctacaagttggtcagcgagatggtgaagaagctgcacgcggcaacaccaccaacgttcggagtggacctcatcaatgagcttgtggagaactttggcagatgtcccaagtggtctggtcggcaagcctttgtctttgtctgccagactgtcattgaggatgactgccttcccatggaccagtttgctgtgcatctcatgccgcatctgctaaccttagcaaatgacagggttcctaacgtgcgagtgctgcttgcaaagacattaagacaaactctactagaaaaagactatttcttggcctctgccagctgccaccaggaggctgtggagcagaccatcatggctcttcagatggaccgtgacagcgatgtcaagtattttgcaagcatccaccctgccagtaccaaaatctccgaagatgccatgagcacagcgtcctcaacctactagaaggcttgaatctcggtgtctttcctgcttccatgagagccgaggttcagtgggcattcgccacgcatgtgacctgggatagctttcgggggaggagagaccttcctctcctgcggacttcattgcaggtgcaagttgcctacacccaataccagggatttcaagagtcaagagaaagtacagtaaacactattatcttatcttgactttaaggggaaataatttctcagaggattataattgtcaccgaagccttaaatccttctgtcttcctgactgaatgaaacttgaattggcagagcattttccttatggaagggatgagattcccagagacctgcattgctttctcctggttttatttaacaatcgacaaatgaaattcttacagcctgaaggcagacgtgtgcccagatgtgaaagagaccttcagtatcagccctaactcttctctcccaggaaggacttgctgggctctgtggccagctgtccagcccagccctgtgtgtgaatcgtttgtgacgtgtgcaaatgggaaaggaggggtttttacatctcctaaaggacctgatgccaacacaagtaggattgacttaaactcttaagcgcagcatattgctgtacacatttacagaatggttgctgagtgtctgtgtctgattttttcatgctggtcatgacctgaaggaaatttattagacgtataatgtatgtctggtgtttttaacttgatcatgatcagctctgaggtgcaacttcttcacatactgtacatacctgtgaccactcttgggagtgctgcagtctttaatcatgctgtttaaactgttgtggcacaagttctcttgtccaaataaaatttattaataagatctatagagagagatatatacacttttgattgttttctagatgtctaccaataaatgcaatttgtgacctgtattaatgatttaaagtggggaaactagattaaaatatttgtcttttaactagtt

SEQ ID NO: 171324 - DNA, 3925 bp, Homo sapiens
  Payload ID: 13697
  Gene Symbol: PPP4R1
  Gene Name: protein phosphatase 4, regulatory subunit 1
  Uniprot ID: Q8TF05
  ENST ID: ENST00000400556
  CDS Start-End: 75-2927
ccggctccccggctcgcgccgctccatgtagccccggctccccgggcggccgcggaggagggggcgaccacaagatggcggacctctcgctgcttcaggaggacctgcaggaggacgcagacggatttggtgtggatgactacagctcagagtctgatgtgattattataccttcagccctggactttgtctcacaagatgaaatgttgacgcccctggggagattggacaagtatgctgcaagtgagaacatatttaacagacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttgatgtggagaccaaagtgtgccctgtcctcatagagctgacagccccagatagcaatgatgatgtgaaaacagaagctgtggctataatgtgcaaaatggctcccatggttgggaaggatattacagagcgtcttatcctccctaggttttgtgagatgtgctgcgattgcagaatgtttcacgttcgaaaggtctgtgctgccaattttggagatatttgcagtgtagttggccagcaagctactgaagaaatgttgctgcccagatttttccagctttgttctgataatgtatggggagtccgaaaggcttgtgctgaatgcttcatggcggtttcatgtgcaacatgtcaagaaatccgacggaccaaattatcagcactttttattaatttgatcagtgatccttcacgttgggttcgccaagcagcttttcagtctctgggacctttcatatctacttttgctaatccatctagctcaggccagtattttaaagaagaaagcaaaagttcagaagagatgtcagtagaaaacaaaaataggaccagagatcaagaagccccagaggatgtacaagtcaggccagaggatactccttcagatctcagtgttagtaattccagtgtcatactggaaaacacgatggaagaccatgctgctgaggcatccgggaagcctctaggtgaaattagtgttccactggacagctctttactttgtactttgtcctcagaatctcaccaggaagcagctagtaatgagaatgataaaaaacctggtaactacaaatctatgttacgaccagaggttggcaccacttcacaagattcagctctcttagatcaggaattgtataactccttccatttctggaggactcctcttcctgaaatagatctagacatagagcttgaacagaactctgggggaaaacccagcccagagggaccagaggaagaatctgagggccctgtgcccagttctccaaacatcaccatggccaccagaaaggaactggaagaaatgatagaaaatctagagccccacattgatgatccagatgttaaagcacaagtggaagtgctgtccgctgcactacgtgcttccagcctggatgcacatgaagagaccatcagtatagaaaagagaagtgatttgcaagatgaactggatataaatgagctaccaaattgtaaaataaatcaagaagattctgtgcctttaatcagcgatgctgttgagaatatggactccactcttcactatattcacagcgattcagacttgagcaacaatagcagttttagccctgatgaggaaaggagaactaaagtacaagatgttgtacctcaggcgttgttagatcagtatttatctatgactgacccttctcgtgcacagacggttgacactgaaattgctaagcactgtgcatatagcctccctggtgtggccttgacactcggaagacagaattggcactgcctgagagagacgtatgagactctggcctcagacatgcagtggaaagttcgacgaactctagcattctccatccacgagcttgcagttattcttggagatcaattgacagctgcagatctggttccaatttttaatggatttttaaaagacctcgatgaagtcaggataggtgttcttaaacacttgcatgattttctgaagcttcttcatattgacaaaagaagagaatatctttatcaacttcaggagtttttggtgacagataatagtagaaattggcggtttcgagctgaactggctgaacagctgattttacttctagagttatatagtcccagagatgtttatgactatttacgtcccattgctctgaatctgtgtgcagacaaagtttcttctgttcgttggatttcctacaagttggtcagcgagatggtgaagaagctgcacgcggcaacaccaccaacgttcggagtggacctcatcaatgagcttgtggagaactttggcagatgtcccaagtggtctggtcggcaagcctttgtctttgtctgccagactgtcattgaggatgactgccttcccatggaccagtttgctgtgcatctcatgccgcatctgctaaccttagcaaatgacagggttcctaacgtgcgagtgctgcttgcaaagacattaagacaaactctactagaaaaagactatttcttggcctctgccagctgccaccaggaggctgtggagcagaccatcatggctcttcagatggaccgtgacagcgatgtcaagtattttgcaagcatccaccctgccagtaccaaaatctccgaagatgccatgagcacagcgtcctcaacctactagaaggcttgaatctcggtgtctttcctgcttccatgagagccgaggttcagtgggcattcgccacgcatgtgacctgggatagctttcgggggaggagagaccttcctctcctgcggacttcattgcaggtgcaagttgcctacacccaataccagggatttcaagagtcaagagaaagtacagtaaacactattatcttatcttgactttaaggggaaataatttctcagaggattataattgtcaccgaagccttaaatccttctgtcttcctgactgaatgaaacttgaattggcagagcattttccttatggaagggatgagattcccagagacctgcattgctttctcctggttttatttaacaatcgacaaatgaaattcttacagcctgaaggcagacgtgtgcccagatgtgaaagagaccttcagtatcagccctaactcttctctcccaggaaggacttgctgggctctgtggccagctgtccagcccagccctgtgtgtgaatcgtttgtgacgtgtgcaaatgggaaaggaggggtttttacatctcctaaaggacctgatgccaacacaagtaggattgacttaaactcttaagcgcagcatattgctgtacacatttacagaatggttgctgagtgtctgtgtctgattttttcatgctggtcatgacctgaaggaaatttattagacgtataatgtatgtctggtgtttttaacttgatcatgatcagctctgaggtgcaacttcttcacatactgtacatacctgtgaccactcttgggagtgctgcagtctttaatcatgctgtttaaactgttgtggcacaagttctcttgtccaaataaaatttattaataagatctatagagagagatatatacacttttgattgttttctagatgtctaccaataaatgcaatttgtgacctgtattaatgatttaaagtggggaaactagattaaaatatttgtcttttaactagtt

SEQ ID NO: 171325 - DNA, 379 bp, Homo sapiens
  Payload ID: 13697
  Gene Symbol: PPP4R1
  Gene Name: protein phosphatase 4, regulatory subunit 1
  ENST ID: ENST00000581835
  CDS Start-End: 89-379
ctctcccctcggcgcagacctctcgctgcttcaggaggacctgcaggaggacgcagacggatccctggactttgtctcacaagatgaaatgttgacgcccctggggagattggacaagtatgctgcaagtgagaacatatttaacagacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagatacctt

SEQ ID NO: 171326 - DNA, 578 bp, Homo sapiens
  Payload ID: 13697
  Gene Symbol: PPP4R1
  Gene Name: protein phosphatase 4, regulatory subunit 1
  ENST ID: ENST00000581250
  CDS Start-End: 148-578
cctttcttctctcccctcggcgcagacctctcgctgcttcaggaggacctgcaggaggacgcagacggatttggtgtggatgactacagctcagagtctgatgtgattattataccttcagccctggactttgtctcacaagatgaaatgttgacgcccctggggagattggacaagtatgctgcaagtgagaacatatttaacagacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttgatgtggagaccaaagtgtgccctgtcctcatagagctgacagccccagatagcaatga

SEQ ID NO: 171327 - DNA, 554 bp, Homo sapiens
  Payload ID: 13697
  Gene Symbol: PPP4R1
  Gene Name: protein phosphatase 4, regulatory subunit 1
  ENST ID: ENST00000583092
  CDS Start-End: 50-103
atgtagccccggctccccgggcggccgcggaggagggggcgaccacaagatggcggacctctcgctgcttcaggaggacctgcaggaggacgcagacggatgattggagaaatggccctgattatgttacctcgaggagggctttttatatttatgttcgacttcgtaaatagaagattcatttattcagcaagtatttatgactggagcaaaaacttctcactcctgaaggatgaaatgcagtctcagtttcttccttagcccccaagaagcacagtgtagaggggaaggcatacctgtgaaaaattcaaccatgagtttcaacactctgccagccctggactttgtctcacaagatgaaatgttgacgcccctggggagattggacaagtatgctgcaagtgagaacatatttaacagacaaatggtggcccggagtttgctcgataccttgagggaagtctgcgatgatgaaagagattgtattgctgttttggaaagaattagcagattggccgatgattcagaaccaactgtgagagcggagctgatgg

SEQ ID NO: 171328 - DNA, 580 bp, Homo sapiens
  Payload ID: 13697
  Gene Symbol: PPP4R1
  Gene Name: protein phosphatase 4, regulatory subunit 1
  ENST ID: ENST00000578875
  CDS Start-End: 50-355
atgtagccccggctccccgggcggccgcggaggagggggcgaccacaagatggcggacctctcgctgcttcaggaggacctgcaggaggacgcagacggatttggtgtggatgactacagctcagagtctgatgtgattattataccttcagccctggactttgtctcacaagatgaaatgttgacgcccctggggagattggacaagtatgctgcaagtgagaacatatttaacagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttgatgtggagaccaaagtgtgccctgtcctcatagagctgacagccccagatagcaatgatgatgtgaaaacagaagctgtggctataatgtgcaaaatggctcccatggttgggaaggatattacagagcgtcttat

SEQ ID NO: 171329 - DNA, 535 bp, Homo sapiens
  Payload ID: 13697
  Gene Symbol: PPP4R1
  Gene Name: protein phosphatase 4, regulatory subunit 1
  ENST ID: ENST00000580745
  CDS Start-End: 129-535
agtaaaaacccggcgccccagccttcaccgtgctgcacgaggaagctggctaggcagacctctcgctgcttcaggaggacctgcaggaggacgcagacggatccctggactttgtctcacaagatgaaatgttgacgcccctggggagattggacaagtatgctgcaagtgagaacatatttaacagacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttgatgtggagaccaaagtgtgccctgtcctcataga

SEQ ID NO: 171330 - DNA, 625 bp, Homo sapiens
  Payload ID: 13697
  Gene Symbol: PPP4R1
  Gene Name: protein phosphatase 4, regulatory subunit 1
  ENST ID: ENST00000584074
  CDS Start-End: 172-625
gcccggccgggttccggcactcgccgcagggtcccggccggcggcaggttgcgcgcccccgtccgcagcgctcggcgtgagggcggctcgggaggagggtacctctcgctgcttcaggaggacctgcaggaggacgcagacggatccctggactttgtctcacaagatgaaatgttgacgcccctggggagattggacaagtatgctgcaagtgagaacatatttaacagacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttgatgtggagaccaaagtgtgccctgtcctcatagagctgacagccccagatagcaatgatgatgtgaaaacagaagctgtgg

SEQ ID NO: 171331 - DNA, 578 bp, Homo sapiens
  Payload ID: 13697
  Gene Symbol: PPP4R1
  Gene Name: protein phosphatase 4, regulatory subunit 1
  ENST ID: ENST00000582240
  CDS Start-End: 9-578
aggcaggcatgactttgtcagtcaaccatcccgcagccgggccctgggctttgttagcagccacttggcgagggccccgggcgggtggggaggcggcgcttcctccaagaggaggtgggaccccggccccgacgacctcggagccgcccccggccccggatcgccgacgacacctctcgctgcttcaggaggacctgcaggaggacgcagacggatccctggactttgtctcacaagatgaaatgttgacgcccctggggagattggacaagtatgctgcaagtgagaacatatttaacagacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttg

SEQ ID NO: 171332 - DNA, 582 bp, Homo sapiens
  Payload ID: 13697
  Gene Symbol: PPP4R1
  Gene Name: protein phosphatase 4, regulatory subunit 1
  ENST ID: ENST00000580182
  CDS Start-End: 76-303
accggctccccggctcgcgccgctccatgtagccccggctccccgggcggccgcggaggagggggcgaccacaagatggcggacctctcgctgcttcaggaggacctgcaggaggacgcagacggatccctggactttgtctcacaagatgaaatgttgacgcccctggggagattggacaagtatgctgcaagtgagaacatatttaacagatatcggccaggtgcagtgactcatgcctgtaatcccagcactttgggaggccaagacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttg

SEQ ID NO: 171333 - DNA, 4984 bp, Homo sapiens
  Payload ID: 13698
  Gene Symbol: PPP4R2
  Gene Name: protein phosphatase 4, regulatory subunit 2
  Uniprot ID: Q9NY27
  ENST ID: ENST00000356692
  CDS Start-End: 254-1507
agggagcgtgcgcgcggtgacgtaccgggcgccatgttggagggttggtggtagcggcttggggaggtgctcgctctgtcggtcttgctctctcgcacgcttcccccggctcccttcgtttcccccccccggtcgcctgcgtgccggagtgtgtgcgagggagggggagggcgtcgggggggtggggggaggcgttccggtccccaagagacccgcggagggaggcggaggctgtgagggactccgggaagccatggacgtcgagaggctccaggaggcgctgaaagattttgagaagagggggaaaaaggaagtttgtcctgtcctggatcagtttctttgtcatgtagccaagactggagaaacaatgattcagtggtcccaatttaaaggctattttattttcaaactggagaaagtgatggatgatttcagaacttcagctcctgagccaagaggtcctcccaaccctaatgtcgaatatattccctttgatgaaatgaaggaaagaatactgaaaattgtcactggatttaatggtatcccttttactattcagcgactatgtgaattgttaacagatccaaggagaaactatacaggaacagacaaatttctcagaggagtagaaaagaatgtgatggttgttagctgtgtttatccttcttcagagaaaaacaattccaatagtttaaatcgaatgaatggtgttatgtttcctggaaattcaccaagctatactgagaggtctaatataaatgggcctgggacacccaggccacttaatcgaccaaaggtttctttgtcagcccccatgacaacaaatgggttgcctgagagcacagacagcaaagaggcaaatttgcagcaaaatgaggagaaaaatcacagtgactcttcgacctctgaatcagaagtttcctcagtgagccctttgaaaaataaacatccagatgaagatgctgtggaagctgaggggcatgaggtaaaaagactcaggtttgacaaagaaggtgaagtcagagaaacagccagtcaaacgacttccagcgaaatttcttcagttatggtaggagaaacagaagcatcatcttcatctcaggataaagacaaagatagccgttgtacccggcagcactgtacagaagaggatgaagaagaggatgaagaggaagaagaagagtcttttatgacatcaagagaaatgatcccagaaagaaaaaatcaagaaaaagaatctgatgatgccttaactgtgaatgaagagacttctgaggaaaataatcaaatggaggaatctgatgtgtctcaagctgagaaagatttgctacattctgaaggtagtgaaaacgaaggccctgtaagtagtagttcttctgactgccgtgaaacagaagaattagtaggatccaattccagtaaaactggagagattctttcagaatcatccatggaaaatgatgacgaagccacagaagtcaccgatgaaccaatggaacaagactaactatttagaaacatttagatgcagtattttacatacagttctggttttaacactgtataaaacttttgtgtaataaaatggacctttagttttacaagagaagcaggttgtaaaataaagtactttatggataattcctgaaagagttgtacatgtaagaactgtgaatatcagctcctctgggtcctgcttaccttaccgctgacttttctttctttctttttttggtctgggcaaatcagtggtttgtgtatagatttttttttttttttaatttaggattgaagtttttaaactggaaagtaattacaattttgaaaagttttttgagattatcacatttagtttatacatatgcaagaagctttttgtcttgtctctttctgatagctctagcagttttcatattttggtcatagtttcaacattttaacatgtgaattatagggtttcatgctggtttccagattttattgtttggctacgtacaatggaactttaagtcatatatacatacatatatatatatatatatatataattctaaggggggaaatgttatatttttctgtttctataagagatgaatacagtggatactttttctattggtaatgattgagttcacctctttcagaagacattttctttctcttctgagtaattgaaataaaatctggcccttgtgaaaccctggaaatcttaagtctgttgaaataccaggttaaacacattccaagagatctgttcaaactcaaattcttttgtatacttctgaggtgcctgagaaaaagacttcattatttatgagaaaatatgctttatcttggaaattgtgttcaaatgttagcttactattttgtagaatgaatgtttatgaagctgatatgagaccatctcagaagaaccaagtaggttccttgaccttttgcttgcttttctgaacattgtgaatattacacatgtctttctaaattattctagggtatgcaaatgtcaatggtatgaaacaccactgtactggaagaattaatatattactttagtatgtacctgagctaaatgactgaagctttaggggtgcatagaaaccaccataatttgtatgacattttgaagtgaattaaatatttttgaacatgcttcttcgacagccagtgttatatttttcagatcaacacaaagcacaatgattactcgaaattcagtattttcaaatttacatatttaaagtcatgcaagctgtaacttccctgtcaaaattactggctgccaaatttatacctgtttcttcagctgtaccttttgatatttaaagtttttaaatttctgtaaagtagattttgtagaatgtaatgtgttcactgcctttgtgaagcggtatataattgtataatttctgtgtgtaaactgaatgcttgggctttcaatacagtattcatataaagcaataaatattaatgttatgaaatatttgactacatttttatcaaaatatgaaagaatccccccttttttagtttcagatacctgaactacacagatgagcttctaaaactgatgcaaacagtttctgacactgtataatatgcttttgggtgatttggggggcaaccacaagttttgcgttttgactacttaaatcatcatggctataaataccaaaacgatttggatccatttatgtttgtaggataatatactactgactgacttgactgtcaggttcacaacagctagatgatatatttatgactatgtctaatagttgaaataaaatctgaatattgatttactatacccaagaggggagaaaaattaaccattgtaaatttttaaaaaatttttcaaaaatgttaaaatgaggcaaatttaagtttacaaattttgaaattttcttttgaatatttatgaaattgtcagtaaacttacctaagatcctgtgaccttttgatattttttattttaattgtagtgccatggaccatttgtaaacaaattgatttacttttgttggttgtaagttgaagatttagcattatgactttgaggtctgtggttttatttgtaaacttgcaattgctatatttgcaagggcaaatgtatttctttattaaataaagtacaataatggtgaatgtaccaaaatgacatcacttaactctatgagagatctgcattttaatctatagtttaatagttttaatatttattagatattcatatgttgatcatagatcaaacttgttgctgtttatacagataattgtagaatgctcatggaatatctttagggtaggtggaatacttctgtagttaaattgggaaaccttgttcagctggttttagatattgatggccatttggaagtaaatttccgcaggtattcataggtgcacttaacacagactttgcttaatgaaaatgtcagttctaatagtaactgattcacttctgaacagaagtgattttaggcatatttcttaacatatatcaagcaaagtcctgttaaaagatctaaatgaagaatggagacctcagtgattaaagatattttgtttctgaccttgagcagattgcttacctgttctctagactataacccaacatgtaaaaaaaatttgaagatggtgatgaggaaagtgagatatatatatatatatgtattatgtttctagcacttttcccttttaaaaagtgaaaatatccttgtacatttttgaaaaatatattttcagttctgaaaaatgtagcagaagtagtgaaaatgtcatattttaaatgttgattattagataaatttaacctgcttagggtttattgtaactacacctttcagacgtgtgttttggagtagtggaattgccagccaggccctgtggcttggaaaggcatcccagaaatcctcggccagaaggtgtggcttgttaaagcattgagattcagagtattttgttttgccggtgtagataggcatgtatttatgcatttttgcatttgtaaaatcaacttttcaaataatgtaaatgtaatatactagtttacttaaaggtacttgggcagaatctaaagctgctacaatgtttgattatgaaaaaaatgtaacatggtaaggatgaaaatgcaacttacaaaaccaaaggaattaaaaattttcggtagtgtttcaaattgtcttctgaacaggaatttaacattggttttgatgaaggtgagggtcagttctcaagatttgtgctaatcataaaatgaatgaatgcaaaacaccttgtaatttcatatggaattataaaaattaggtttgctgggttttggcctaataagagtgctagtatgtattggttagactacatcttactatttcacattttaaaaatcagtacactcttcaggattttcttttatttcaacttggagcctagattactttgccaaatgtattattttcataatgcaataaaatataaattagaatat

SEQ ID NO: 171334 - DNA, 771 bp, Homo sapiens
  Payload ID: 13698
  Gene Symbol: PPP4R2
  Gene Name: protein phosphatase 4, regulatory subunit 2
  ENST ID: ENST00000482242
  CDS Start-End: 236-586
gacgtaccgggcgccatgttggagggttggtggtagcggcttggggaggtgctcgctctgtcggtcttgctctctcgcacgcttcccccggctcccttcgtttcccccccccggtcgcctgcgtgccggagtgtgtgcgagggagggggagggcgtcgggggggtggggggaggcgttccggtccccaagagacccgcggagggaggcggaggctgtgagggactccgggaagccatggacgtcgagaggctccaggaggcgctgaaagattttgagaagagggggaaaaaggaagtttgtcctgtcctggatcagtttctttgtcatgtagccaagactggagaaacaattatcccttttactattcagcgactatgtgaattgttaacagatccaaggagaaactatacaggaacagacaaatttctcagaggagtagaaaagaatgtgatggttgttagctgtgtttatccttcttcagagaaaaacaattccaatagtttaaatcgaatgaatggtgttatgtttcctggaaattcaccaagctatactgagagcccccatgacaacaaatgggttgcctgagagcacagacagcaaagaggcaaatttgcagcaaaatgaggagaaaaatcacagtgactcttcgacctctgaatcagaagtttcctcagtgagccctttgaaaaataaacatccagatgaagatgctgtggaagctgaggggcatgaggtaaaaagactcaggtttgacaaagaaggtgaagtca

SEQ ID NO: 171335 - DNA, 559 bp, Homo sapiens
  Payload ID: 13698
  Gene Symbol: PPP4R2
  Gene Name: protein phosphatase 4, regulatory subunit 2
  ENST ID: ENST00000495566
  CDS Start-End: 62-271
cgttccggtccccaagagacccgcggagggaggcggaggctgtgagggactccgggaagccatggacgtcgagaggctccaggaggcgctgaaagattttgagaagagggggaaaaaggaagtttgtcctgtcctggatcagtttctttgtcatgtagccaagactggagaaacaatgctggcctcgaaaccctggcctcaagtgatccacctgcctcaacttcccaaactgcggggattgcagattagagacggggtttcaccatgttagccaggacggtctcgatctcctgacctcgtgatctacctgctttggcctcccaaagtgctgggattacagacgtgaactactgcacccgccctgtttttttgagtagagacagggtttcaccatgttatccaggctggtctcgaactcctgacctcaagtatctgcctgcttcggcctcccaaagtgctgggaatacaggtgtgagccaccatgcctggcctctactatctgaaacatagttttaaatgacatattttaatctaaatataaataaaacatttaatttga

SEQ ID NO: 171336 - DNA, 877 bp, Homo sapiens
  Payload ID: 13698
  Gene Symbol: PPP4R2
  Gene Name: protein phosphatase 4, regulatory subunit 2
  ENST ID: ENST00000488810
  CDS Start-End: 200-877
cggcttggggaggtgctcgctctgtcggtcttgctctctcgcacgcttcccccggctcccttcgtttcccccccccggtcgcctgcgtgccggagtgtgtgcgagggagggggagggcgtcgggggggtggggggaggcgttccggtccccaagagacccgcggagggaggcggaggctgtgagggactccgggaagccatggacgtcgagaggctccaggaggcgctgaaagattttgagaagagggggaaaaaggaagtttgtcctgtcctggatcagtttctttgtcatgtagccaagactggagaaacaatgattcagtggtcccaatttaaaggctattttattttcaaactggagaaagtgatggatgatttcagaacttcagctcctgagccaagaggtcctcccaaccctaatgtcgaatatattccctttgatgaaatgaaggaaagaatactgaaaattgtcactggatttaatggtatcccttttactattcagcgactatgtgaattgttaacagatccaaggagaaactatacaggaacagacaaatttctcagaggagtagaaaagaatgtgatggttgttagctgtgtttatccttcttcagagtctaatataaatgggcctgggacacccaggccacttaatcgaccaaaggtttctttgtcagcccccatgacaacaaatgggttgcctgagagcacagacagcaaagaggcaaatttgcagcaaaatgaggagaaaaatcacagtgactcttcgacctctgaatcagaagtttcctcagtgagccctttgaaaaataaacatccagatgaagatgctgtggaagctgaggggcatgaggtaaaaagactcaggtttgac

SEQ ID NO: 171337 - DNA, 572 bp, Homo sapiens
  Payload ID: 13698
  Gene Symbol: PPP4R2
  Gene Name: protein phosphatase 4, regulatory subunit 2
  ENST ID: ENST00000460360
  CDS Start-End: 1-431
atgggcctgggacacccaggccacttaatcgaccaaaggtttctttgtcagcccccatgacaacaaatgggttgcctgagagcacagacagcaaagaggcaaatttgcagcaaaatgaggagaaaaatcacagtgactcttcgacctctgaatcagaagtttcctcagtgagccctttgaaaaataaacatccagatgaagatgctgtggaagctgaggggcatgaggtaaaaagactcaggtttgacaaagaaggtgaagtcagagaaacagccagtcaaacgacttccagcgaaatttcttcagttatggtaggagaaacagaagcatcatcttcatctcaggataaagacaaagatagccgttgtacccggcagcactgtacagaagaggatgaagaagaggatgaagaggaagaagaaggtatttagagaccatctgtaaaagggtggagtaaggagatcctcaaattcttgtacttcatttttttcgtgaaagaattttacgtaatggaactccttataatgctgatgttgggcttttctcccacctgtatgtagttgctgctgaat

SEQ ID NO: 171338 - DNA, 323 bp, Homo sapiens
  Payload ID: 13698
  Gene Symbol: PPP4R2
  Gene Name: protein phosphatase 4, regulatory subunit 2
  ENST ID: ENST00000476505
  CDS Start-End: 136-323
gcggacccgcagacccctccctcccagatatcctcttttctccaccaggctacccattttgagaagagggggaaaaaggaagtttgtcctgtcctggatcagtttctttgtcatgtagccaagactggagaaacaatgattcagtggtcccaatttaaaggctattttattttcaaactggagaaagtgatggatgatttcagaacttcagctcctgagccaagaggtcctcccaaccctaatgtcgaatatattccctttgatgaaatgaaggaaagaatactgaaaattgtcactggatttaatggtatcccttttactat

SEQ ID NO: 171339 - DNA, 534 bp, Homo sapiens
  Payload ID: 13699
  Gene Symbol: PPP4R3A
  Gene Name: protein phosphatase 4, regulatory subunit 3A
  ENST ID: ENST00000557018
  CDS Start-End: 84-534
acacaccgcccagcgctcgcacgacgggcccctttcctgggcgtctactggcggggcccccgccccggttcccgggcggcacgatgaccgacacccggcggcgggtgaaggtgtacacgctcaacgaggaccggcagtgggacgaccggggcaccgggcatgtgtcgtctggctacgtggagcggctgaagggcatgtccctgcttgtcagggctgagagcgacggttctctacttttagagtcgaaaataaatcctaacactgcataccagaaacaacaggacactctgattgtgtggtctgaagcagaaaattatgacttggcccttagctttcaagaaaaagctggatgtgatgaaatttgggagaaaatatgtcaggttcaaggaaaggacccttccgtggacatcactcaggaccttgtggatgaatctgaagaggagcgttttgatgatatgtcatcgccaggcttagaattgccatcttgtgaattaagtcgccttgaagaaattgcagaacttgtggcatcatctt

SEQ ID NO: 171340 - DNA, 2515 bp, Homo sapiens
  Payload ID: 13699
  Gene Symbol: PPP4R3A
  Gene Name: protein phosphatase 4, regulatory subunit 3A
  ENST ID: ENST00000554308
  CDS Start-End: 1-1630
cggcacgatgaccgacacccggcggcgggtgaaggtgtacacgctcaacgaggaccggcagtgggacgaccggggcaccgggcatgtgtcgtctggctacgtggagcggctgaagggcatgtccctgcttgtcagggctgagagcgacggttctctacttttagagtcgaaaataaatcctaacactgcataccagaaacaacaggacactctgattgtgtggtctgaagcagaaaattatgacttggcccttagctttcaagaaaaagctggatgtgatgaaatttgggagaaaatatgtcaggttcaaggaaaggacccttccgtggacatcactcaggaccttgtggatgaatctgaagaggagcgttttgatgatatgtcatcgccaggcttagaattgccatcttgtgaattaagtcgccttgaagaaattgcagaacttgtggcatcatctttaccttcacctcttcgtcgtgaaaaacttgcactggcactagaaaatgagggttatattaaaaagctcctggagctttttcatgtgtgtgaagatttggaaaatattgaaggactgcaccacttgtatgaaattatcaaaggcatctttctcttgaatcgaactgctctttttgaagttatgttctctgaagaatgtataatggacgtcattggatgtttagaatatgatcctgctttatcacaaccacgaaaacacagggaatttctaacaaaaacagccaagtttaaagaagtgattcccatatcagatcctgagctgaaacaaaaaattcatcagacatacagagttcagtatatacaagatatggttctaccaactccttcggtctttgaagaaaacatgttatcaacacttcactcttttatctttttcaataaggtagagattgttggcatgttgcaggaagatgaaaaatttctgacagatttgtttgcacaactaacagatgaagcaacagatgaggaaaaaagacaggaattggttaactttttaaaagaattttgtgcgttttcccaaacgctacagcctcaaaacagagatgcttttttcaagactttgtcaaacatgggcatattaccagctttagaagtcatccttggcatggatgatacacaggtgcgaagtgctgctactgatatattctcatacttggttgaatataatccatccatggtacgagagtttgtcatgcaggaggcacaacagaatgatgatgatattttgctcatcaacctcattatagaacatatgatttgtgatacagatcctgaacttggaggagcagtccagcttatgggcctgcttcgaactttagttgacccagagaacatgctagccactgccaataaaacagaaaagactgaatttctgggtttcttctacaagcactgtatgcatgttctcactgctcctttactagcaaatacaacagaagacaaacctagtaaagatgattttcagactgcccaactattggcacttgtattggaattgttaacattttgtgtggagcaccatacctaccacataaagaactacattattaataaggatatcctccggagagtgctagttcttatggcctcgaagcatgctttcttggcattataaaccgtgtcagcatggttgcctggctacctgctcatgaaggacttgattaatagcaaattggcaatttaacgagccacttccatgatctccaaagaaaccaaaatacaaacacaatatttaatcttgccaaccgaagacgatgtgactgcatgaagtgcccttcgttttaaaagaaagattattggattaaaagatgagttttacaaccgctacataatgaaaagttttttgtttgaaccagtagtgaaagcatttctcaacaatggatcccgctacaatctgatgaactctgccataatagagatgtttgaatttattagagtggaagatataaaatcattaactgctcatgtaattgaaaattactggaaagcactggaagatgtagattatgtacagacatttaaaggattaaaactgagatttgaacaacaaagagaaaggcaagataatcccaaacttgacagtatgcgttccattttgaggaatcacagatatcgaagagatgccagaacactagaagatgaagaagagatgtggtttaacacagatgaagatgacatggaagatggagaagctgtagtgtctccatctgacaaaactaaaaatgatgatgatattatggatccaataagtaaattcatggaaaggaagaaattaaaagaaagtgaggaaaaggaagtgcttctgaaaacaaacctttctggacggcagagcccaagtttcaagctttccctgtccagtggaacgaagactaacctcaccagccagtcatctacaacaaatctgcctggttctccgggatcacctggatccccaggatctccaggctctcctggatccgtacctaaaaatacatctcagacggcagctattactacaaag

SEQ ID NO: 171341 - DNA, 4108 bp, Homo sapiens
  Payload ID: 13699
  Gene Symbol: PPP4R3A
  Gene Name: protein phosphatase 4, regulatory subunit 3A
  Uniprot ID: Q6IN85
  ENST ID: ENST00000554684
  CDS Start-End: 498-2960
cgcctgtcggcttctgacgtttaaaacagggggagcggaagggagccactggccgcggtggcagggccaggtataaggaaggaaaatatggcggcggcggcggcggcctgaggaggcggcggcggcgcgggaagctgcttcgcggagatcatggcggaggcgggagcagggcagtgacgggagccccgagttcctagcgctgcggggcgggaggctacgaagcgctgcgcggccccctcggggctgccgggcgccgggctcgccaggcctggacaatagcgccggggagccggaggcgaggaaaggcggcggcccagagctcggtccctggagcgggccatgcaggcggcggcgcggccccgcggcgcccagcggcggcagtgaggccggggagccctccgctcgcgggcgccctcacgcctcgcccctcgcctctccagggcccctttcctgggcgtctactggcggggcccccgccccggttcccgggcggcacgatgaccgacacccggcggcgggtgaaggtgtacacgctcaacgaggaccggcagtgggacgaccggggcaccgggcatgtgtcgtctggctacgtggagcggctgaagggcatgtccctgcttgtcagggctgagagcgacggttctctacttttagagtcgaaaataaatcctaacactgcataccagaaacaacaggacactctgattgtgtggtctgaagcagaaaattatgacttggcccttagctttcaagaaaaagctggatgtgatgaaatttgggagaaaatatgtcaggttcaaggaaaggacccttccgtggacatcactcaggaccttgtggatgaatctgaagaggagcgttttgatgatatgtcatcgccaggcttagaattgccatcttgtgaattaagtcgccttgaagaaattgcagaacttgtggcatcatctttaccttcacctcttcgtcgtgaaaaacttgcactggcactagaaaatgagggttatattaaaaagctcctggagctttttcatgtgtgtgaagatttggaaaatattgaaggactgcaccacttgtatgaaattatcaaaggcatctttctcttgaatcgaactgctctttttgaagttatgttctctgaagaatgtataatggacgtcattggatgtttagaatatgatcctgctttatcacaaccacgaaaacacagggaatttctaacaaaaacagccaagtttaaagaagtgattcccatatcagatcctgagctgaaacaaaaaattcatcagacatacagagttcagtatatacaagatatggttctaccaactccttcggtctttgaagaaaacatgttatcaacacttcactcttttatctttttcaataaggtagagattgttggcatgttgcaggaagatgaaaaatttctgacagatttgtttgcacaactaacagatgaagcaacagatgaggaaaaaagacaggaattggttaactttttaaaagaattttgtgcgttttcccaaacgctacagcctcaaaacagagatgcttttttcaagactttgtcaaacatgggcatattaccagctttagaagtcatccttggcatggatgatacacaggtgcgaagtgctgctactgatatattctcatacttggttgaatataatccatccatggtacgagagtttgtcatgcaggaggcacaacagaatgatgatgatattttgctcatcaacctcattatagaacatatgatttgtgatacagatcctgaacttggaggagcagtccagcttatgggcctgcttcgaactttagttgacccagagaacatgctagccactgccaataaaacagaaaagactgaatttctgggtttcttctacaagcactgtatgcatgttctcactgctcctttactagcaaatacaacagaagacaaacctagtaaagatgattttcagactgcccaactattggcacttgtattggaattgttaacattttgtgtggagcaccatacctaccacataaagaactacattattaataaggatatcctccggagagtgctagttcttatggcctcgaagcatgctttcttggcattatgtgcccttcgttttaaaagaaagattattggattaaaagatgagttttacaaccgctacataatgaaaagttttttgtttgaaccagtagtgaaagcatttctcaacaatggatcccgctacaatctgatgaactctgccataatagagatgtttgaatttattagagtggaagatataaaatcattaactgctcatgtaattgaaaattactggaaagcactggaagatgtagattatgtacagacatttaaaggattaaaactgagatttgaacaacaaagagaaaggcaagataatcccaaacttgacagtatgcgttccattttgaggaatcacagatatcgaagagatgccagaacactagaagatgaagaagagatgtggtttaacacagatgaagatgacatggaagatggagaagctgtagtgtctccatctgacaaaactaaaaatgatgatgatattatggatccaataagtaaattcatggaaaggaagaaattaaaagaaagtgaggaaaaggaagtgcttctgaaaacaaacctttctggacggcagagcccaagtttcaagctttccctgtccagtggaacgaagactaacctcaccagccagtcatctacaacaaatctgcctggttctccgggatcacctggatccccaggatctccaggctctcctggatccgtacctaaaaatacatctcagacggcagctattactacaaagggaggcctcgtgggtctggtagattatcctgatgatgatgaagatgatgatgaggatgaagataaggaagatacgttaccattgtcaaagaaagcaaaatttgattcataataatggcaacggcctaggatcagtacctgttgaaaaaaactggttctccacccctcccccatacaaaatccacaacaaagcgcagtggtctcttgtgaatgactgacacagatcagcctcttacacttgacttctgctcatcaagtgccaattcaatggagcaggaggaggggatatcatatatttaggggaaagacttaagcctttgagctctccagcttggaccacacattgcccttttctcagggaaggaaatggaaacaaaaagccaacagggcaggggttttgtaagtggaactctggattgactggtcagttgctacaatcagaatatgctttcttggaccatgtttgagactcagaagaatgggcctttctgccataattcttcactagtcaagaatgccagcagtttctttgtataaagagacctgcctttaaaatcatacattctgaacattttagtcaagctacaacaggtttggaaaacctctgtgggggaggggcgagtataaagttttcctcttttttaactgttccctttgcccttcaaactgcagatatttttttttttaagtggggacttctccctacttgattaaagattgagtggaattctagatgtggtcatttgtgtcataatttttttgttttattttgtttttgattttttttttcctcccctgagtgtatgcttagttgttgagtatatatatttgggaccattaaaactttttttgatgtaatataacctaacgttgtgctggtacctgttttaccatgtgtaatttttgttctacatcacagttcttaatttgtttagagttttatgaaagatggtatagtttttattgacaaaagcaaagtaatcttacaactatgtgcatacaaaagcaatactattttgtgactaaatattttatattaaaatttacatcagcaactgtcttgagaattcagggaaatagaatggaatttaaaacttcaacagttttgttaaatctagaaacatgaaattagtattccaaagagattctgaaatttcttttcttggggaaatgacggtacattaaatcaaaattgaggatggatgatttaaaaacatttgacttttgaataataaaaagaaaagtgaagagtaagagaaa

SEQ ID NO: 171342 - DNA, 3369 bp, Homo sapiens
  Payload ID: 13699
  Gene Symbol: PPP4R3A
  Gene Name: protein phosphatase 4, regulatory subunit 3A
  Uniprot ID: Q6IN85
  ENST ID: ENST00000554943
  CDS Start-End: 117-2618
tgaggccggggagccctccgctcgcgggcgccctcacgcctcgcccctcgcctctccagggcccctttcctgggcgtctactggcggggcccccgccccggttcccgggcggcacgatgaccgacacccggcggcgggtgaaggtgtacacgctcaacgaggaccggcagtgggacgaccggggcaccgggcatgtgtcgtctggctacgtggagcggctgaagggcatgtccctgcttgtcagggctgagagcgacggttctctacttttagagtcgaaaataaatcctaacactgcataccagaaacaacaggacactctgattgtgtggtctgaagcagaaaattatgacttggcccttagctttcaagaaaaagctggatgtgatgaaatttgggagaaaatatgtcaggttcaaggaaaggacccttccgtggacatcactcaggaccttgtggatgaatctgaagaggagcgttttgatgatatgtcatcgccaggcttagaattgccatcttgtgaattaagtcgccttgaagaaattgcagaacttgtggcatcatctttaccttcacctcttcgtcgtgaaaaacttgcactggcactagaaaatgagggttatattaaaaagctcctggagctttttcatgtgtgtgaagatttggaaaatattgaaggactgcaccacttgtatgaaattatcaaaggcatctttctcttgaatcgaactgctctttttgaagttatgttctctgaagaatgtataatggacgtcattggatgtttagaatatgatcctgctttatcacaaccacgaaaacacagggaatttctaacaaaaacagccaagtttaaagaagtgattcccatatcagatcctgagctgaaacaaaaaattcatcagacatacagagttcagtatatacaagatatggttctaccaactccttcggtctttgaagaaaacatgttatcaacacttcactcttttatctttttcaataaggtagagattgttggcatgttgcaggaagatgaaaaatttctgacagatttgtttgcacaactaacagatgaagcaacagatgaggaaaaaagacaggaattggttaactttttaaaagaattttgtgcgttttcccaaacgctacagcctcaaaacagagatgcttttttcaagactttgtcaaacatgggcatattaccagctttagaagtcatccttggcatggatgatacacaggtgcgaagtgctgctactgatatattctcatacttggttgaatataatccatccatggtacgagagtttgtcatgcaggaggcacaacagaatgatgatgtaagtaagaagttaacagagcaaaaaataaccagcaaggatattttgctcatcaacctcattatagaacatatgatttgtgatacagatcctgaacttggaggagcagtccagcttatgggcctgcttcgaactttagttgacccagagaacatgctagccactgccaataaaacagaaaagactgaatttctgggtttcttctacaagcactgtatgcatgttctcactgctcctttactagcaaatacaacagaagacaaacctagtaaagatgattttcagactgcccaactattggcacttgtattggaattgttaacattttgtgtggagcaccatacctaccacataaagaactacattattaataaggatatcctccggagagtgctagttcttatggcctcgaagcatgctttcttggcattatgtgcccttcgttttaaaagaaagattattggattaaaagatgagttttacaaccgctacataatgaaaagttttttgtttgaaccagtagtgaaagcatttctcaacaatggatcccgctacaatctgatgaactctgccataatagagatgtttgaatttattagagtggaagatataaaatcattaactgctcatgtaattgaaaattactggaaagcactggaagatgtagattatgtacagacatttaaaggattaaaactgagatttgaacaacaaagagaaaggcaagataatcccaaacttgacagtatgcgttccattttgaggaatcacagatatcgaagagatgccagaacactagaagatgaagaagagatgtggtttaacacagatgaagatgacatggaagatggagaagctgtagtgtctccatctgacaaaactaaaaatgatgatgatattatggatccaataagtaaattcatggaaaggaagaaattaaaagaaagtgaggaaaaggaagtgcttctgaaaacaaacctttctggacggcagagcccaagtttcaagctttccctgtccagtggaacgaagactaacctcaccagccagtcatctacaacaaatctgcctggttctccgggatcacctggatccccaggatctccaggctctcctggatccgtacctaaaaatacatctcagacggcagctattactacaaagggaggcctcgtgggtctggtagattatcctgatgatgatgaagatgatgatgaggatgaagataaggaagatacgttaccattgtcaaagaaagcaaaatttgattcataataatggcaacggcctaggatcagtacctgttgaaaaaaactggttctccacccctcccccatacaaaatccacaacaaagcgcagtggtctcttgtgaatgactgacacagatcagcctcttacacttgacttctgctcatcaagtgccaattcaatggagcaggaggaggggatatcatatatttaggggaaagacttaagcctttgagctctccagcttggaccacacattgcccttttctcagggaaggaaatggaaacaaaaagccaacagggcaggggttttgtaagtggaactctggattgactggtcagttgctacaatcagaatatgctttcttggaccatgtttgagactcagaagaatgggcctttctgccataattcttcactagtcaagaatgccagcagtttctttgtataaagagacctgcctttaaaatcatacattctgaacattttagtcaagctacaacaggtttggaaaacctctgtgggggaggggcgagtataaagttttcctcttttttaactgttccctttgcccttcaaactgcagatatttttttttttaagtggggacttctccctacttgattaaagattgagtggaattctagatgtggtcatttgtgtcataatttttttgttttattttgtttttgattttttttttcctcccctgagtgtatgcttagttgttgagtatatatatttgggaccattaaaactttttttgatgtaatataa

SEQ ID NO: 171343 - DNA, 3236 bp, Homo sapiens
  Payload ID: 13699
  Gene Symbol: PPP4R3A
  Gene Name: protein phosphatase 4, regulatory subunit 3A
  Uniprot ID: Q6IN85
  ENST ID: ENST00000555462
  CDS Start-End: 832-2616
gcgtcccgcctcctccgctccctgcgctcccgccacctcggcaactccgcgcccgcctcccgcctccgtcggaagcctccgccgcagtaaggctcccggtctcgctgctgtctctttaaatggtggggctacgagccgcccctgcagctgctccctgggtggccccgcgcgccgcttttgaggggcgaaccaagatggcggcggttttggctgtgtgaggaagacggaagagacggcggcggagggaaaccgacttccactagtccgggtcgcttgggcggccgggggccctcagagtctcccgggcagtggtagcagttgcagcaggatcaggcgcctgtcggcttctgacgtttaaaacagggggagcggaagggagccactggccgcggtggcagggccaggtataaggaaggaaaatatggcggcggcggcggcggcctgaggaggcggcggcggcgcgggaagctgcttcgcggagatcatggcggaggcgggagcagggcagtgacgggagccccgagttcctagcgctgcggggcgggaggctacgaagcgctgcgcggccccctcggggctgccgggcgccgggctcgccaggcctggacaatagcgccggggagccggaggcgaggaaaggcggcggcccagagctcggtccctggagcgggccatgcaggcggcggcgcggccccgcggcgcccagcggcggcagtgaggccggggagccctccgctcgcgggcgccctcacgcctcgcccctcgcctctccagggcccctttcctgggcgtctactggcggggcccccgccccggttcccgggcggcacgatgaccgacacccggcggcgggtgaaggtgtacacgctcaacgaggaccggcagtgggacgaccggggcaccgggcatgtgtcgtctggctacgtggagcggctgaagggcatgtccctgcttgtcagggctgagagcgacggttctctacttttagagtcgaaaataaatcctaacactgcataccagaaacaacaggaagatgaaaaatttctgacagatttgtttgcacaactaacagatgaagcaacagatgaggaaaaaagacaggaattggttaactttttaaaagaattttgtgcgttttcccaaacgctacagcctcaaaacagagatgcttttttcaagactttgtcaaacatgggcatattaccagctttagaagtcatccttggcatggatgatacacaggtgcgaagtgctgctactgatatattctcatacttggttgaatataatccatccatggtacgagagtttgtcatgcaggaggcacaacagaatgatgatgtaagtaagaagttaacagagcaaaaaataaccagcaaggatattttgctcatcaacctcattatagaacatatgatttgtgatacagatcctgaacttggaggagcagtccagcttatgggcctgcttcgaactttagttgacccagagaacatgctagccactgccaataaaacagaaaagactgaatttctgggtttcttctacaagcactgtatgcatgttctcactgctcctttactagcaaatacaacagaagacaaacctagtaaagatgattttcagactgcccaactattggcacttgtattggaattgttaacattttgtgtggagcaccatacctaccacataaagaactacattattaataaggatatcctccggagagtgctagttcttatggcctcgaagcatgctttcttggcattatgtgcccttcgttttaaaagaaagattattggattaaaagatgagttttacaaccgctacataatgaaaagttttttgtttgaaccagtagtgaaagcatttctcaacaatggatcccgctacaatctgatgaactctgccataatagagatgtttgaatttattagagtggaagatataaaatcattaactgctcatgtaattgaaaattactggaaagcactggaagatgtagattatgtacagacatttaaaggattaaaactgagatttgaacaacaaagagaaaggcaagataatcccaaacttgacagtatgcgttccattttgaggaatcacagatatcgaagagatgccagaacactagaagatgaagaagagatgtggtttaacacagatgaagatgacatggaagatggagaagctgtagtgtctccatctgacaaaactaaaaatgatgatgatattatggatccaataagtaaattcatggaaaggaagaaattaaaagaaagtgaggaaaaggaagtgcttctgaaaacaaacctttctggacggcagagcccaagtttcaagctttccctgtccagtggaacgaagactaacctcaccagccagtcatctacaacaaatctgcctggttctccgggatcacctggatccccaggatctccaggctctcctggatccgtacctaaaaatacatctcagacggcagctattactacaaagggaggcctcgtgggtctggtagattatcctgatgatgatgaagatgatgatgaggatgaagataaggaagatacgttaccattgtcaaagaaagcaaaatttgattcataataatggcaacggcctaggatcagtacctgttgaaaaaaactggttctccacccctcccccatacaaaatccacaacaaagcgcagtggtctcttgtgaatgactgacacagatcagcctcttacacttgacttctgctcatcaagtgccaattcaatggagcaggaggaggggatatcatatatttaggggaaagacttaagcctttgagctctccagcttggaccacacattgcccttttctcagggaaggaaatggaaacaaaaagccaacagggcaggggttttgtaagtggaactctggattgactggtcagttgctacaatcagaatatgctttcttggaccatgtttgagactcagaagaatgggcctttctgccataattcttcactagtcaagaatgccagcagtttctttgtataaagagacctgcctttaaaatcatacattctgaacattttagtcaagctacaacaggtttggaaaacctctgtgggggaggggcgagtataaagttttcctcttttttaactgttccctttgcccttcaaactgcagatatttttttttttaagtggggacttctccctacttgattaaagattgagtggaattcta

SEQ ID NO: 171344 - DNA, 595 bp, Homo sapiens
  Payload ID: 13699
  Gene Symbol: PPP4R3A
  Gene Name: protein phosphatase 4, regulatory subunit 3A
  ENST ID: ENST00000555470
  CDS Start-End: 1-595
tctttttgaagttatgttctctgaagaatgtataatggacgtcattggatgtttagaatatgatcctgctttatcacaaccacgaaaacacagggaatttctaacaaaaacagccaagtttaaagaagtgattcccatatcagatcctgagctgaaacaaaaaattcatcagacatacagagttcagtatatacaagatatggttctaccaactccttcggtctttgaagaaaacatgttatcaacacttcactcttttatctttttcaataaggtagagattgttggcatgttgcaggaagatgaaaaatttctgacagatttgtttgcacaactaacagatgaagcaacagatgaggaaaaaagacaggaattgcctcaaaacagagatgcttttttcaagactttgtcaaacatgggcatattaccagctttagaagtcatccttggcatggatgatacacaggtgcgaagtgctgctactgatatattctcatacttggttgaatataatccatccatggtacgagagtttgtcatgcaggaggcacaacagaatgatgatgtaagtaagaagttaacagagcaaaaaata

SEQ ID NO: 171345 - DNA, 580 bp, Homo sapiens
  Payload ID: 13699
  Gene Symbol: PPP4R3A
  Gene Name: protein phosphatase 4, regulatory subunit 3A
  ENST ID: ENST00000554511
  CDS Start-End: 284-580
tgaggggcgaaccaagatggcggcggttttggctgtgtgaggaagacggaagagacggcggcggagggaaaccgacttccactagtccgggtcgcttgggcggccgggggccctcagagtctcccgggcagtggtagcagttgcagcaggatcaggcgcctgtcggcttctgacgtttaaaacagggggagcggaagggagccactggccgcggtggcagggccagggcccctttcctgggcgtctactggcggggcccccgccccggttcccgggcggcacgatgaccgacacccggcggcgggtgaaggtgtacacgctcaacgaggaccggcagtgggacgaccggggcaccgggcatgtgtcgtctggctacgtggagcggctgaagggcatgtccctgcttgtcagggctgagagcgacggttctctacttttagagtcgaaaataaatcctaacactgcataccagaaacaacaggacactctgattgtgtggtctgaagcagaaaattatgacttggcccttagctttcaagaaaaagctggatgtgatgaaatttgggagaaaatatgtcag

SEQ ID NO: 171346 - DNA, 571 bp, Homo sapiens
  Payload ID: 13699
  Gene Symbol: PPP4R3A
  Gene Name: protein phosphatase 4, regulatory subunit 3A
  ENST ID: ENST00000555029
  CDS Start-End: 1-571
atgaccgacacccggcggcgggtgaaggtgtacacgctcaacgaggaccggcagtgggacgaccggggcaccgggcatgtgtcgtctggctacgtggagcggctgaagggcatgtccctgcttgtcagggctgagagcgacggttctctacttttagagtcgaaaataaatcctaacactgcataccagaaacaacaggaagatgaaaaatttctgacagatttgtttgcacaactaacagatgaagcaacagatgaggaaaaaagacaggaattggttaactttttaaaagaattttgtgcgttttcccaaacgctacagcctcaaaacagagatgcttttttcaagactttgtcaaacatgggcatattaccagctttagaagtcatccttggcatggatgatacacaggtgcgaagtgctgctactgatatattctcatacttggttgaatataatccatccatggtacgagagtttgtcatgcaggaggcacaacagaatgatgatgtaagtaagaagttaacagagcaaaaaataaccagcaaggatattttgctcatcaacctca

SEQ ID NO: 171347 - DNA, 2953 bp, Homo sapiens
  Payload ID: 13699
  Gene Symbol: PPP4R3A
  Gene Name: protein phosphatase 4, regulatory subunit 3A
  ENST ID: ENST00000554390
  CDS Start-End: 834-2953
ctgcgtcccgcctcctccgctccctgcgctcccgccacctcggcaactccgcgcccgcctcccgcctccgtcggaagcctccgccgcagtaaggctcccggtctcgctgctgtctctttaaatggtggggctacgagccgcccctgcagctgctccctgggtggccccgcgcgccgcttttgaggggcgaaccaagatggcggcggttttggctgtgtgaggaagacggaagagacggcggcggagggaaaccgacttccactagtccgggtcgcttgggcggccgggggccctcagagtctcccgggcagtggtagcagttgcagcaggatcaggcgcctgtcggcttctgacgtttaaaacagggggagcggaagggagccactggccgcggtggcagggccaggtataaggaaggaaaatatggcggcggcggcggcggcctgaggaggcggcggcggcgcgggaagctgcttcgcggagatcatggcggaggcgggagcagggcagtgacgggagccccgagttcctagcgctgcggggcgggaggctacgaagcgctgcgcggccccctcggggctgccgggcgccgggctcgccaggcctggacaatagcgccggggagccggaggcgaggaaaggcggcggcccagagctcggtccctggagcgggccatgcaggcggcggcgcggccccgcggcgcccagcggcggcagtgaggccggggagccctccgctcgcgggcgccctcacgcctcgcccctcgcctctccagggcccctttcctgggcgtctactggcggggcccccgccccggttcccgggcggcacgatgaccgacacccggcggcgggtgaaggtgtacacgctcaacgaggaccggcagtgggacgaccggggcaccgggcatgtgtcgtctggctacgtggagcggctgaagggcatgtccctgcttgtcagggctgagagcgacggttctctacttttagagtcgaaaataaatcctaacactgcataccagaaacaacaggacactctgattgtgtggtctgaagcagaaaattatgacttggcccttagctttcaagaaaaagctggatgtgatgaaatttgggagaaaatatgtcaggttcaaggaaaggacccttccgtggacatcactcaggaccttgtggatgaatctgaagaggagcgttttgatgatatgtcatcgccaggcttagaattgccatcttgtgaattaagtcgccttgaagaaattgcagaacttgtggcatcatctttaccttcacctcttcgtcgtgaaaaacttgcactggcactagaaaatgagggttatattaaaaagctcctggagctttttcatgtgtgtgaagatttggaaaatattgaaggactgcaccacttgtatgaaattatcaaaggcatctttctcttgaatcgaactgctctttttgaagttatgttctctgaagaatgtataatggacgtcattggatgtttagaatatgatcctgctttatcacaaccacgaaaacacagggaatttctaacaaaaacagccaagtttaaagaagtgattcccatatcagatcctgagctgaaacaaaaaattcatcagacatacagagttcagtatatacaagatatggttctaccaactccttcggtctttgaagaaaacatgttatcaacacttcactcttttatctttttcaataaggtagagattgttggcatgttgcaggaagatgaaaaatttctgacagatttgtttgcacaactaacagatgaagcaacagatgaggaaaaaagacaggaattggttaactttttaaaagaattttgtgcgttttcccaaacgctacagcctcaaaacagagatgcttttttcaagactttgtcaaacatgggcatattaccagctttagaagtcatccttggcatggatgatacacaggtgcgaagtgctgctactgatatattctcatacttggttgaatataatccatccatggtacgagagtttgtcatgcaggaggcacaacagaatgatgatgatattttgctcatcaacctcattatagaacatatgatttgtgatacagatcctgaacttggaggagcagtccagcttatgggcctgcttcgaactttagttgacccagagaacatgctagccactgccaataaaacagaaaagactgaatttctgggtttcttctacaagcactgtatgcatgttctcactgctcctttactagcaaatacaacagaagacaaacctagtaaagatgattttcagactgcccaactattggcacttgtattggaattgttaacattttgtgtggagcaccatacctaccacataaagaactacattattaataaggatatcctccggagagtgctagttcttatggcctcgaagcatgctttcttggcattatgtgcccttcgttttaaaagaaagattattggattaaaagatgagttttacaaccgctacataatgaaaagttttttgtttgaaccagtagtgaaagcatttctcaacaatggatcccgctacaatctgatgaactctgccataatagagatgtttgaatttattagagtggaagatataaaatcattaactgctcatgtaattgaaaattactggaaagcactggaagatgtagattatgtacagacatttaaaggattaaaactgagatttgaacaacaaagagaaaggcaagataatcccaaacttgacagtatgcgttccattttgaggaatcacagatatcgaagagatgccagaacactagaagatgaagaagagatgtggtttaacacagatgaagatgacatggaagatggagaagctgtagtgtctccatctgacaaaactaaaaatgatgatgatattatggatccaataagtaaattcatggaaaggaa

SEQ ID NO: 171348 - DNA, 5243 bp, Homo sapiens
  Payload ID: 13700
  Gene Symbol: PPP4R3B
  Gene Name: protein phosphatase 4, regulatory subunit 3B
  Uniprot ID: Q5MIZ7
  ENST ID: ENST00000611717
  CDS Start-End: 330-2624
aggcagagagagtcgggttacaagatggcggatctgtagtagttaccgcggcggcgggagagcaagcgagccctggggggcaaagagacgggagagtgggtgtatgcgcgggtgaagtgagaggtaacggggcctccgggcggagaggcctcagtggctcttgtcaccccttctcgcggctgaacctttggagccatggtgaattcgggcctctccgaagccgccgccgccgccaccgccactactgcctttaccgtctcctaagagtgaggagcgcggacgaggtaagcgaggaggcggcggctagagcggtggagacagcagccaccatgtcggatacgcggcggcgagtgaaggtctataccctgaacgaagaccggcaatgggacgaccgaggcaccgggcacgtctcctccacttacgtggaggagctcaaggggatgtcgctgctggttcgggcagagtccgacggatcactactcttggaatcaaagataaatccaaatactgcatatcagaaacaacaggatacattaattgtttggtcagaagcagagaactatgatttggctctgagttttcaggagaaagctggctgtgatgagatctgggaaaaaatttgtcaggttcaaggtaaagacccatcagtggaagtcacacaggacctcattgatgaatctgaagaagaacgatttgaagaaatgcctgaaactagtcatctgattgacctgcccacatgtgaactcaataaacttgaagagattgctgacttagttacctcagtgctctcctcacctatccgtagggaaaagctggctctcgccttggaaaatgaaggctatattaaaaaactattgcagctgttccaagcttgcgagaacctagaaaacactgaaggcttacaccatttgtatgaaattattagaggaatcttattcctaaataaggcaactctttttgaggtaatgttttctgatgagtgtatcatggatgtcgtgggatgccttgaatatgaccctgctttggctcagccaaaaagacatagagaattcttgaccaaaactgcaaagttcaaggaagttataccaataacagactctgaactaaggcaaaaaatacatcagacttacagggtacagtacattcaggacatcattttgcccacaccatctgtttttgaagagaattttctttctactcttacgtcttttattttcttcaacaaagttgagatagtcagcatgttgcaggaagatgagaagtttttgtctgaagtttttgcacaattaacagatgaggctacagatgatgataaacggcgtgaattggttaattttttcaaggagttttgtgcattttctcagacattacaacctcaaaacagggatgcatttttcaaaacattggcaaaattgggaattcttcctgctcttgaaattgtaatgggcatggatgatttgcaagtcagatcagctgctacagatatattttcttatctagtagaatttagtccatctatggtccgagagtttgtaatgcaagaagctcagcagagtgatgacgatattcttcttattaatgtggtaattgaacaaatgatctgtgatactgatcctgagctaggaggcgctgttcagttaatgggacttcttcgtactctaattgatccagagaacatgctggctacaactaataaaaccgaaaaaagtgaatttctaaattttttctacaaccattgtatgcatgttctcacagcaccacttttgaccaatacttcagaagacaaatgtgaaaaggataatatagttggatcaaacaaaaacaacacaatttgtcccggtgcccttcgctttatgaggcggataattggacttaaagatgaattttataatcgttacatcaccaagggaaatctttttgagccagttataaatgcacttctggataatggaactcggtataatctgttgaattcagctgttattgagttgtttgaatttataagagtggaagatatcaagtctcttactgcccatatagttgaaaacttttataaagcacttgaatcgattgaatatgttcagacattcaaaggattgaagactaaatatgagcaagaaaaagacagacaaaatcagaaactgaacagtgtaccatctatattgcgtagtaacagatttcgcagagatgcaaaagccttggaagaggatgaagaaatgtggtttaatgaagatgaagaagaggaaggaaaagcagttgtggcaccagtggaaaaacctaagccagaagatgattttccagataattatgaaaagtttatggagactaaaaaagcaaaagaaagtgaagacaaggaaaaccttcccaaaaggacatctcctggtggcttcaaatttactttctcccactctgccagtgctgctaatggaacaaacagtaaatctgtagtggctcagataccaccagcaacttctaatggatcctcttccaaaaccacaaacttgcctacgtcagtaacagccaccaagggaagtttggttggcttagtggattatccagatgatgaagaggaagatgaagaagaagaatcgtcccccaggaaaagacctcgtcttggctcataaaatatttattaggggaccctcaacatgtggtcttacaatgctgcaactgttcagtgagctgaaaatctgaatcagaaagctttctcaattgaacttataaaatatacaaggagtagcaaaagacagtatatcagctaagagagtttagttctaataaaaatcaggcttcccaggaacttgattgcttgctagtaattaaggggtttgccttttaggctgtcaaaacaaacattagtaaccagaacctgggagacagcttctcagcaaggaaaagtcacaggtttggggacggtttaggggaggggaaaaggttgatataataatgcagggttgctcctcggggtgtcgatctagaaacaattttacagaacttcagttgtaaactcaataacattacttgtataatggtgctggccatgttgttgttttaatcagttgcctctttttaaaagaaatttttatggaaaacacattcaactatcattaaaaaaatgaagttaagctgttgggaccatttctttaagatttaacaaaagttcagccttttaggtagttgaagggaagtacaccccgtattcagcacatgttgagttttctacaccaggaattttcaatatgtatattgatgaaaacaagctcaattcaaactggacagttttaagataatgttaaaatcagcacttttagagacaacgaaggccaagaatcagtacagtagtattccaaaatgattttctctagaaatttgaaagtagatcgaacagaatgttgtcaaccgcctaccagtacaatcttttgtggaagatactttgaaatcactttctactttgttagtaaagttctgtctttccagagctgcaagttttaaagtgttacttatacagaccaaccaagaatagtgctgaattaagtggcatttagtatctagaagccattttgatccaagaagctacttaagtgtcaaagtcagcatgcagcacatgtagcttttctgtaaacaagggtgtgatatgaaagctgcttttttaagaagagtaaaagcacattccatatacgtaagtgaattttaaaaataaattgaggcaaacagttaagttttatttttagagcaacaagttaactgtaaatattttaatgttagtttgctcatctatgatctgagatcatgccgaagtgagaaaaatctccccaaaatacaatttaatgcattgggaaaaaaaaactttaacagtaattccagccacaatctttagatcacccttgtaatgtgttacgggtccatttttcctggaatcgtttaatctaaagcagtttcccctgttttggagattttgtagttaattttaattttggctattgtttggaaaagatgagctgtctgtgtagatatgaagtatagttttttccataaaacagatgtttattttgtattaaaaaataccactgtacttgttttacaccatttgtatacatgtggtgatattaatgctaaactgtaaaattcaggaattaaaatgtgaccctgtaattccataattgatgtttgtgtttggtttgttgtaaatataaattaactccattttgagatatgtcaattttacagtatcttttaaaagccaataaaattatccataaatatttattataaactgctagatcataccccaattttaatgaaataattctaaacaaatgcgggtcaatggcactttatcagtgactacttatagaaggtaagccttggggaaatcatagcatcacagtatggagcttttctcaccttttcaattaaaggtgtacatatagtaagaaagaaagaccttccacctcataaggcaggtgactcaggatattttaaactaagatcagtaaagttcccatccactttctttgaatcatcaaattttatcgagacccatctctcagcttttagtaaatttcttcttaaaataagcccacatgtaaaacactttcctagttactttttgtttgtttgtttgagtctcgctctgttgcccaggctggagtgtagttgcacgatttcggcttattgcaacatccgccacctgggttcaagcaattctctgcctcagcctgagtagctgggattacaggtgcccgtcaccatgccaggctaatttttgtattttcagtagagacggggtttcaccatcttggccaggctggtcttaaactcctgacctcacaatccacccgcctcagcctccctatctctgtatcttatgaagacttcctttttctttctgaagagctgccataagtcttaaacatttaaatcatcagaaccttttcttgtagcagaaatgtgaatgttttcttgaagtacaggttacggttttcatggtacaagtgcttacctacgacgataagagaacaaggcttaaaatatccctcaaaagaacaattgtgagaattccatgttagcggctgtctttaaacgactaccctcaggcagatctgggtttttatatctttatcttcattcagtgaagcaagccaaaagcccacatttgtatgccttaggtcttcttaaaatggtatctgtaaacatgtgtccaatataaaaactatttttaataaaaagttacatgaaacaga

SEQ ID NO: 171349 - DNA, 4385 bp, Homo sapiens
  Payload ID: 13700
  Gene Symbol: PPP4R3B
  Gene Name: protein phosphatase 4, regulatory subunit 3B
  Uniprot ID: Q5MIZ7
  ENST ID: ENST00000616407
  CDS Start-End: 304-2853
ggcggatctgtagtagttaccgcggcggcgggagagcaagcgagccctggggggcaaagagacgggagagtgggtgtatgcgcgggtgaagtgagaggtaacggggcctccgggcggagaggcctcagtggctcttgtcaccccttctcgcggctgaacctttggagccatggtgaattcgggcctctccgaagccgccgccgccgccaccgccactactgcctttaccgtctcctaagagtgaggagcgcggacgaggtaagcgaggaggcggcggctagagcggtggagacagcagccaccatgtcggatacgcggcggcgagtgaaggtctataccctgaacgaagaccggcaatgggacgaccgaggcaccgggcacgtctcctccacttacgtggaggagctcaaggggatgtcgctgctggttcgggcagagtccgacggatcactactcttggaatcaaagataaatccaaatactgcatatcagaaacaacaggatacattaattgtttggtcagaagcagagaactatgatttggctctgagttttcaggagaaagctggctgtgatgagatctgggaaaaaatttgtcaggttcaaggtaaagacccatcagtggaagtcacacaggacctcattgatgaatctgaagaagaacgatttgaagaaatgcctgaaactagtcatctgattgacctgcccacatgtgaactcaataaacttgaagagattgctgacttagttacctcagtgctctcctcacctatccgtagggaaaagctggctctcgccttggaaaatgaaggctatattaaaaaactattgcagctgttccaagcttgcgagaacctagaaaacactgaaggcttacaccatttgtatgaaattattagaggaatcttattcctaaataaggcaactctttttgaggtaatgttttctgatgagtgtatcatggatgtcgtgggatgccttgaatatgaccctgctttggctcagccaaaaagacatagagaattcttgaccaaaactgcaaagttcaaggaagttataccaataacagactctgaactaaggcaaaaaatacatcagacttacagggtacagtacattcaggacatcattttgcccacaccatctgtttttgaagagaattttctttctactcttacgtcttttattttcttcaacaaagttgagatagtcagcatgttgcaggaagatgagaagtttttgtctgaagtttttgcacaattaacagatgaggctacagatgatgataaacggcgtgaattggttaattttttcaaggagttttgtgcattttctcagacattacaacctcaaaacagggatgcatttttcaaaacattggcaaaattgggaattcttcctgctcttgaaattgtaatgggcatggatgatttgcaagtcagatcagctgctacagatatattttcttatctagtagaatttagtccatctatggtccgagagtttgtaatgcaagaagctcagcagagtgatgacgatattcttcttattaatgtggtaattgaacaaatgatctgtgatactgatcctgagctaggaggcgctgttcagttaatgggacttcttcgtactctaattgatccagagaacatgctggctacaactaataaaaccgaaaaaagtgaatttctaaattttttctacaaccattgtatgcatgttctcacagcaccacttttgaccaatacttcagaagacaaatgtgaaaaggatttttttttaaaacattacagatatagttggagtttcatatgtaccccttcacattcccattcccattctaccccctcttcctccatctctcaagataatatagttggatcaaacaaaaacaacacaatttgtcccgataattatcaaacagcacagctacttgccttaattttagagttactcacattttgtgtggaacatcacacatatcacataaaaaactatattatgaacaaggacttgctaagaagagtcttggtcttgatgaattcaaagcacacttttctggccttgtgtgcccttcgctttatgaggcggataattggacttaaagatgaattttataatcgttacatcaccaagggaaatctttttgagccagttataaatgcacttctggataatggaactcggtataatctgttgaattcagctgttattgagttgtttgaatttataagagtggaagatatcaagtctcttactgcccatatagttgaaaacttttataaagcacttgaatcgattgaatatgttcagacattcaaaggattgaagactaaatatgagcaagaaaaagacagacaaaatcagaaactgaacagtgtaccatctatattgcgtagtaacagatttcgcagagatgcaaaagccttggaagaggatgaagaaatgtggtttaatgaagatgaagaagaggaaggaaaagcagttgtggcaccagtggaaaaacctaagccagaagatgattttccagataattatgaaaagtttatggagactaaaaaagcaaaagaaagtgaagacaaggaaaaccttcccaaaaggacatctcctggtggcttcaaatttactttctcccactctgccagtgctgctaatggaacaaacagtaaatctgtagtggctcagataccaccagcaacttctaatggatcctcttccaaaaccacaaacttgcctacgtcagtaacagccaccaagggaagtttggttggcttagtggattatccagatgatgaagaggaagatgaagaagaagaatcgtcccccaggaaaagacctcgtcttggctcataaaatatttattaggggaccctcaacatgtggtcttacaatgctgcaactgttcagtgagctgaaaatctgaatcagaaagctttctcaattgaacttataaaatatacaaggagtagcaaaagacagtatatcagctaagagagtttagttctaataaaaatcaggcttcccaggaacttgattgcttgctagtaattaaggggtttgccttttaggctgtcaaaacaaacattagtaaccagaacctgggagacagcttctcagcaaggaaaagtcacaggtttggggacggtttaggggaggggaaaaggttgatataataatgcagggttgctcctcggggtgtcgatctagaaacaattttacagaacttcagttgtaaactcaataacattacttgtataatggtgctggccatgttgttgttttaatcagttgcctctttttaaaagaaatttttatggaaaacacattcaactatcattaaaaaaatgaagttaagctgttgggaccatttctttaagatttaacaaaagttcagccttttaggtagttgaagggaagtacaccccgtattcagcacatgttgagttttctacaccaggaattttcaatatgtatattgatgaaaacaagctcaattcaaactggacagttttaagataatgttaaaatcagcacttttagagacaacgaaggccaagaatcagtacagtagtattccaaaatgattttctctagaaatttgaaagtagatcgaacagaatgttgtcaaccgcctaccagtacaatcttttgtggaagatactttgaaatcactttctactttgttagtaaagttctgtctttccagagctgcaagttttaaagtgttacttatacagaccaaccaagaatagtgctgaattaagtggcatttagtatctagaagccattttgatccaagaagctacttaagtgtcaaagtcagcatgcagcacatgtagcttttctgtaaacaagggtgtgatatgaaagctgcttttttaagaagagtaaaagcacattccatatacgtaagtgaattttaaaaataaattgaggcaaacagttaagttttatttttagagcaacaagttaactgtaaatattttaatgttagtttgctcatctatgatctgagatcatgccgaagtgagaaaaatctccccaaaatacaatttaatgcattgggaaaaaaaaactttaacagtaattccagccacaatctttagatcacccttgtaatgtgttacgggtccatttttcctggaatcgtttaatctaaagcagtttcccctgttttggagattttgtagttaattttaattttggctattgtttggaaaagatgagctgtctgtgtagatatgaagtatagttttttccataaaacagatgtttattttgtattaaaaaataccactgtacttgttttacaccatttgtatacatgtggtgatattaatgctaaactgtaaaattcaggaattaaaatgtgaccctgtaattcc

SEQ ID NO: 171350 - DNA, 4310 bp, Homo sapiens
  Payload ID: 13700
  Gene Symbol: PPP4R3B
  Gene Name: protein phosphatase 4, regulatory subunit 3B
  Uniprot ID: Q5MIZ7
  ENST ID: ENST00000616288
  CDS Start-End: 324-2777
agagagtcgggttacaagatggcggatctgtagtagttaccgcggcggcgggagagcaagcgagccctggggggcaaagagacgggagagtgggtgtatgcgcgggtgaagtgagaggtaacggggcctccgggcggagaggcctcagtggctcttgtcaccccttctcgcggctgaacctttggagccatggtgaattcgggcctctccgaagccgccgccgccgccaccgccactactgcctttaccgtctcctaagagtgaggagcgcggacgaggtaagcgaggaggcggcggctagagcggtggagacagcagccaccatgtcggatacgcggcggcgagtgaaggtctataccctgaacgaagaccggcaatgggacgaccgaggcaccgggcacgtctcctccacttacgtggaggagctcaaggggatgtcgctgctggttcgggcagagtccgacggatcactactcttggaatcaaagataaatccaaatactgcatatcagaaacaacaggatacattaattgtttggtcagaagcagagaactatgatttggctctgagttttcaggagaaagctggctgtgatgagatctgggaaaaaatttgtcaggttcaaggtaaagacccatcagtggaagtcacacaggacctcattgatgaatctgaagaagaacgatttgaagaaatgcctgaaactagtcatctgattgacctgcccacatgtgaactcaataaacttgaagagattgctgacttagttacctcagtgctctcctcacctatccgtagggaaaagctggctctcgccttggaaaatgaaggctatattaaaaaactattgcagctgttccaagcttgcgagaacctagaaaacactgaaggcttacaccatttgtatgaaattattagaggaatcttattcctaaataaggcaactctttttgaggtaatgttttctgatgagtgtatcatggatgtcgtgggatgccttgaatatgaccctgctttggctcagccaaaaagacatagagaattcttgaccaaaactgcaaagttcaaggaagttataccaataacagactctgaactaaggcaaaaaatacatcagacttacagggtacagtacattcaggacatcattttgcccacaccatctgtttttgaagagaattttctttctactcttacgtcttttattttcttcaacaaagttgagatagtcagcatgttgcaggaagatgagaagtttttgtctgaagtttttgcacaattaacagatgaggctacagatgatgataaacggcgtgaattggttaattttttcaaggagttttgtgcattttctcagacattacaacctcaaaacagggatgcatttttcaaaacattggcaaaattgggaattcttcctgctcttgaaattgtaatgggcatggatgatttgcaagtcagatcagctgctacagatatattttcttatctagtagaatttagtccatctatggtccgagagtttgtaatgcaagaagctcagcagagtgatgacgatattcttcttattaatgtggtaattgaacaaatgatctgtgatactgatcctgagctaggaggcgctgttcagttaatgggacttcttcgtactctaattgatccagagaacatgctggctacaactaataaaaccgaaaaaagtgaatttctaaattttttctacaaccattgtatgcatgttctcacagcaccacttttgaccaatacttcagaagacaaatgtgaaaaggataatatagttggatcaaacaaaaacaacacaatttgtcccgataattatcaaacagcacagctacttgccttaattttagagttactcacattttgtgtggaacatcacacatatcacataaaaaactatattatgaacaaggacttgctaagaagagtcttggtcttgatgaattcaaagcacacttttctggccttgtgtgcccttcgctttatgaggcggataattggacttaaagatgaattttataatcgttacatcaccaagggaaatctttttgagccagttataaatgcacttctggataatggaactcggtataatctgttgaattcagctgttattgagttgtttgaatttataagagtggaagatatcaagtctcttactgcccatatagttgaaaacttttataaagcacttgaatcgattgaatatgttcagacattcaaaggattgaagactaaatatgagcaagaaaaagacagacaaaatcagaaactgaacagtgtaccatctatattgcgtagtaacagatttcgcagagatgcaaaagccttggaagaggatgaagaaatgtggtttaatgaagatgaagaagaggaaggaaaagcagttgtggcaccagtggaaaaacctaagccagaagatgattttccagataattatgaaaagtttatggagactaaaaaagcaaaagaaagtgaagacaaggaaaaccttcccaaaaggacatctcctggtggcttcaaatttactttctcccactctgccagtgctgctaatggaacaaacagtaaatctgtagtggctcagataccaccagcaacttctaatggatcctcttccaaaaccacaaacttgcctacgtcagtaacagccaccaagggaagtttggttggcttagtggattatccagatgatgaagaggaagatgaagaagaagaatcgtcccccaggaaaagacctcgtcttggctcataaaatatttattaggggaccctcaacatgtggtcttacaatgctgcaactgttcagtgagctgaaaatctgaatcagaaagctttctcaattgaacttataaaatatacaaggagtagcaaaagacagtatatcagctaagagagtttagttctaataaaaatcaggcttcccaggaacttgattgcttgctagtaattaaggggtttgccttttaggctgtcaaaacaaacattagtaaccagaacctgggagacagcttctcagcaaggaaaagtcacaggtttggggacggtttaggggaggggaaaaggttgatataataatgcagggttgctcctcggggtgtcgatctagaaacaattttacagaacttcagttgtaaactcaataacattacttgtataatggtgctggccatgttgttgttttaatcagttgcctctttttaaaagaaatttttatggaaaacacattcaactatcattaaaaaaatgaagttaagctgttgggaccatttctttaagatttaacaaaagttcagccttttaggtagttgaagggaagtacaccccgtattcagcacatgttgagttttctacaccaggaattttcaatatgtatattgatgaaaacaagctcaattcaaactggacagttttaagataatgttaaaatcagcacttttagagacaacgaaggccaagaatcagtacagtagtattccaaaatgattttctctagaaatttgaaagtagatcgaacagaatgttgtcaaccgcctaccagtacaatcttttgtggaagatactttgaaatcactttctactttgttagtaaagttctgtctttccagagctgcaagttttaaagtgttacttatacagaccaaccaagaatagtgctgaattaagtggcatttagtatctagaagccattttgatccaagaagctacttaagtgtcaaagtcagcatgcagcacatgtagcttttctgtaaacaagggtgtgatatgaaagctgcttttttaagaagagtaaaagcacattccatatacgtaagtgaattttaaaaataaattgaggcaaacagttaagttttatttttagagcaacaagttaactgtaaatattttaatgttagtttgctcatctatgatctgagatcatgccgaagtgagaaaaatctccccaaaatacaatttaatgcattgggaaaaaaaaactttaacagtaattccagccacaatctttagatcacccttgtaatgtgttacgggtccatttttcctggaatcgtttaatctaaagcagtttcccctgttttggagattttgtagttaattttaattttggctattgtttggaaaagatgagctgtctgtgtagatatgaagtatagttttttccataaaacagatgtttattttgtattaaaaaataccactgtacttgttttacaccatttgtatacatgtggtgatattaatgctaaactgtaaaattcaggaattaaaatgtgaccctgtaattcca

SEQ ID NO: 171351 - DNA, 3868 bp, Homo sapiens
  Payload ID: 13701
  Gene Symbol: PPP4R4
  Gene Name: protein phosphatase 4, regulatory subunit 4
  Uniprot ID: Q6NUP7
  ENST ID: ENST00000304338
  CDS Start-End: 155-2776
gggccgtgctcttgctcccgccgcctggcagcctcacgctcggctccagcggccaagagccggagaaagtcctgctggtgggcggccgcggggctgagggcgtccggcatcccggggccgctccggcccgggcggcgagagtgcccggcggtccatgcatccgccgccgcccgccgccgcgatggatttcagtcagaacagcctgttcggttacatggaggacctgcaggagctcaccatcatcgagaggccggtccgccggagcctcaagacaccggaagaaatagaaagattgacagtcgatgaagacctcagtgatattgaaagggctgtttatctgctcagtgctggtcaagatgtccaaggaacaagtgtgattgcaaatctcccatttttgatgcgacagaatcccactgagacgcttcggagagtgttgccaaaagtcagagaagccctgcatgttgcaggagtggaaatgcagttaacggctgcgatgtcatttctgaccattctgcaggacgaatcagtgtcaattcatgcatatacccactcattcctccaagtcattctcctgcatctggagcacagggacacaggtgtcagcaatgcatggctggaaactcttctgtctgttatagaagtattgccaaaagaaaccctacggcatgagattttgaatccacttgtttccaaggcacaactttcccaaacagtccagtctcgtttagttagttgtaaaattttaggaaaattgaccaacaaatttgatgcccacaccattaagcgagaaatacttcctctggtaaaatcactctgtcaagatgtagaatatgaagttcgatcttgtatgtgtcggcaattagaaaatatagcccagggcattgggacagaacttacaaaaagtgtggtgctccctgaattaatagaactttctagggatgaaggcagcagtgtacgacttgcagcttttgaaactttggttaatctgcttgatatatttgatacagatgacagaagtcaaactatacttcccttagtgaaatcattttgtgaaaaatctttcaaagcagatgaatcaattcttatttctttatctttccatttaggaaaactatgtcatggactatatggaattttcactccagatcagcacttgagatttttggaattttataagaaactttgtacattgggtttgcaacaagaaaatggacacaatgaaaaccagattccaccccaaatcctagagcaggagaagaaatatatttcagtacggaagaactgtgcttataactttccggccatgattgtttttgttgatcctaaaaacttccacatggaactctattctacattcttctgcctttgccatgaccctgaagtaccagtcagatacactattgctatttgcttttatgaagtatctaagcttctgaattctggagtatatttaatacataaagaactaataacattattacaagatgaatcactggaggtactagatgctcttatagatcatcttccagaaatcttggaacttatgtctactggtggagaaagcagtgttcaagaaaataagttatcttctctgcctgacttgattccagcactcacagctgctgaacagcgagctgcagcctctttaaaatggagaactcatgagaagctacttcagaaatatgcctgcctgccacatgtcatatcaagcgatcagatttattaccgtttcttacaaagaatgttcacaatcatgatgacaaataatgttttacctgtccaaaaggcggcttcacgaactctatgcatttttctgcgttataatcgtaaacaagaacagagacatgaggtcattcaaaaattaattgaacaattgggccaaggaaaaagttactggaatagacttcgatttttggatacctgtgaatttattatagagatattttcaaaatcatttttctgtaaatatttctttctacctgctattgaactgacacatgatccagtagcaaatgtgagaatgaaactttgctacctgttgcccaaagtgaaatctactctgaagattcctgctgataagcatctacttcagcagttagaaatgtgtgtgaggaaactcctgtgtcaagaaaaagataaagatgttctggctattgtaaaaagaactgtattagagttggacagaatggaaatgtctatggatgcttttcagaaaaagttttatgagaaagatttgttggatcaagagaaagaaagagaagaactacttcttttggaaatggaacaattagagaaagaaaagcaacagaatgatggaaggcccatgagtgataaaatgtttgaaaagaaacgtagagacactaagacaccaacgcaaagtctgcccaagaacatccccatttctgttcctggaccctcttctgtcaccccatcgacaagtaaagaaatcaagaaatccaaactgattcgaagccagtcttttaataatcaagcttttcatgcaaaatatggcaacttagagaaatgtgctagtaaaagttctacaacaggatatacaacttctgtctcagggttaggaaagacttctgtgctttcactagctgatgattcattccggactcgtaatgccagtagcgttccatcttccttttctcctaatactcccttaccgagtacttcccgtgggacaggtaactcagttgaccccaagagcagtggaagtaaagatacacaaccacggaaggctaccttaaaatccagaaaatccaatccttaaatcaactgcttgatgaaggaggcaaaacaaaggcagcaggagataatgtgattggtacacaaaagctaaagcagtggctggggctttgtttttaaattttgggtttttttttttgttgttgttaatgagcagaaagagagacataatgacagctgatgttaaacttttcatatttcaaattagattccctaggaggtataatatatatttcttgagtaataatgtggttacggaattccaatgttatagtgaagtgtaatgaaaaacatctctaggaatgtgctttaaccactgctgcaaaagagacaagtctgcatttatttgtgcaggaaaccagccatttaattgttctagagttttagcatttaaaaatcgtatgaaagtctacatcagctgaattgtcctagcttgataagcacttggagggggacttggaaggtgagaaagatactgcattttctcatgagtctccaagcccacttgaaaagtcacactgaaaggatgcaaatagccgtctgcgattttggcggccctccggattgtggtgacaatatgttgtacccggacattcccaaatttaaatttggcagtgaaaattccacaaagatttctggtaactttgagctataaataccttaaaaataatagattgatgattttctttatttcctagagaatttattttataaatactttgtttacattttagattgtacttgtctttatttaaaatgatgaatctagtctgaatcagctgttattccaagctatcatgcttaagctatgtcaacagcatttatttgtactaatgctaatatttccatcaaaatttgcctgtggaatatatacagttcttaattttaaactgtcagttcttgagatataccgtgtgaagctattgtcagcttctctatttcaaaatgcaatcagcatataactatattgatattagaagatatttgttttttaaaatatattgatgtatgataaagatgatctaatttgtgaatgcatatgtatgtgtggttactttttataatgtgaaataatgaataatgaatttactcaaaataaaacataggttaatgagat

SEQ ID NO: 171352 - DNA, 876 bp, Homo sapiens
  Payload ID: 13701
  Gene Symbol: PPP4R4
  Gene Name: protein phosphatase 4, regulatory subunit 4
  Uniprot ID: Q6NUP7
  ENST ID: ENST00000328839
  CDS Start-End: 129-491
ggcagcctcacgctcggctccagcggccaagagccggagaaagtcctgctggtgggcggccgcggggctgagggcgtccggcatcccggggccgctccggcccgggcggcgagagtgcccggcggtccatgcatccgccgccgcccgccgccgcgatggatttcagtcagaacagcctgttcggttacatggaggacctgcaggagctcaccatcatcgagaggccggtccgccggagcctcaagacaccggaagaaatagaaagattgacagtcgatgaagacctcagtgatattgaaagggctgtttatctgctcagtgctggtcaagatgtccaaggaacaagtgtgattgcaaatctcccatttttgatgcgacagaatcccactgagacgcttcggagagtgttgccaaaagtcagagtccatgaggatgcacacttatttatccagagagtatggatctcacatatgtttgtccagagggtgtgactctgtggaggagaacacttactgtggacagtcccagatgttgaagtcagcacaacaagagaaaaacccaaatcctgataagacttgaggatttttcgaaaattaaatgcaaaatagttggggcaaatgttgctgcgggagtcaagactaagtaatacagtaagaagatatgaagttggagagcttctcatgttcttcctttgtataaagtttgcatacgtacaaaacccaggactttaatgactttaagagggggcagaattgcatctcttggaagttaacagactcatgtgaactggaatgtacgttgtggccctcacaattgattttaatatttatttgcaaagtcctttctgtttctaaataaaagctgtgccttctgaaa

SEQ ID NO: 171353 - DNA, 564 bp, Homo sapiens
  Payload ID: 13701
  Gene Symbol: PPP4R4
  Gene Name: protein phosphatase 4, regulatory subunit 4
  ENST ID: ENST00000553661
  CDS Start-End: 394-564
agcgccagcaaacctagtttacggaccggacccctttcccctggccattgcttaattagctgccttagcgcctctcactcccacctgccgcaatatctcaaatctctggtttttttccagccccggagtttatttccttccctcccccactccagatcttgtccttttcatgcctactcggctgcagtcttcatccatctcccttttagcatttcttggggtggaaaatgctggagaaatagccttgaagtattagagataaaaagtacaccggaagaaatagaaagattgacagtcgatgaagacctcagtgatattgaaagggctgtttatctgctcagtgctggtcaagatgtccaaggaacaagtgtgattgcaaatctcccatttttgatgcgacagaatcccactgagacgcttcggagagtgttgccaaaagtcagagaagccctgcatgttgcaggagtggaaatgcagttaacggctgcgatgtcatttctgaccattctgcaggacgaatcagtgtcaattcatgcatatacccactcattcctccaagtcatt

SEQ ID NO: 171354 - DNA, 589 bp, Homo sapiens
  Payload ID: 13701
  Gene Symbol: PPP4R4
  Gene Name: protein phosphatase 4, regulatory subunit 4
  ENST ID: ENST00000556470
  CDS Start-End: 251-589
gaagccacgatgtgattttcaagctgcagtccaggagctagaaggataaaaacagaaaaatacagccccctccccaaactccccaaaccacccaattagagacctccgtgattgatgtcgcctgacaccggaagaaatagaaagattgacagtcgatgaagacctcagtgatattgaaagggctgtttatctgctcagtgctggtcaagatgtccaaggaacaagtgtgattgcaaatctcccatttttgatgcgacagaatcccactgagacgcttcggagagtgttgccaaaagtcagagaagccctgcatgttgcaggagtggaaatgcagttaacggctgcgatgtcatttctgaccattctgcaggacgaatcagtgtcaattcatgcatatacccactcattcctccaagtcattctcctgcatctggagcacagggacacaggtgtcagcaatgcatggctggaaactcttctgtctgttatagaagtattgccaaaagaaaccctacggcatgagattttgaatccacttgtttccaaggcacaactttcccaaacagtccagtctcgtttagttagttgt

SEQ ID NO: 171355 - DNA, 564 bp, Homo sapiens
  Payload ID: 13701
  Gene Symbol: PPP4R4
  Gene Name: protein phosphatase 4, regulatory subunit 4
  ENST ID: ENST00000556884
  CDS Start-End: 377-564
agtgccattctgcaactgctgcagccagctgtctgtctgtaattatgaccttacggaagtccggcccagcagaaggaggacttactgctcattaacatcaagggtggccatcactattaagctccctgggtgccactgcatttatgcccattacctctaataatcaccggaattttgcaaggttcacgttggctatgttggggacaactttagaagaggaaaggcagaagcagaggcacccttgatccagacaccggaagaaatagaaagattgacagtcgatgaagacctcagtgatattgaaagggctgtttatctgctcagtgctggtcaagatgtccaaggaacaagtgtgattgcaaatctcccatttttgatgcgacagaatcccactgagacgcttcggagagtgttgccaaaagtcagatgtcttccaaggtccatgaggatgcacacttatttatccagagagtatggatctcacatatgtttgtccagagggtgtgactctgtggaggagaacacttactggaagccctgcatgttgcaggagtggaaatgcag

SEQ ID NO: 171356 - DNA, 3868 bp, Homo sapiens; identical to SEQ ID NO: 171351
  Payload ID: 13701
  Gene Symbol: PPP4R4
  Gene Name: protein phosphatase 4, regulatory subunit 4
  Uniprot ID: Q6NUP7
  ENST ID: ENST00000619905
  CDS Start-End: 155-2776

SEQ ID NO: 171357 - DNA, 876 bp, Homo sapiens; identical to SEQ ID NO: 171352
  Payload ID: 13701
  Gene Symbol: PPP4R4
  Gene Name: protein phosphatase 4, regulatory subunit 4
  Uniprot ID: Q6NUP7
  ENST ID: ENST00000614957
  CDS Start-End: 129-491

SEQ ID NO: 171358 - DNA, 589 bp, Homo sapiens; identical to SEQ ID NO: 171354
  Payload ID: 13701
  Gene Symbol: PPP4R4
  Gene Name: protein phosphatase 4, regulatory subunit 4
  ENST ID: ENST00000630154
  CDS Start-End: 251-589

SEQ ID NO: 171359 - DNA, 564 bp, Homo sapiens; identical to SEQ ID NO: 171355
  Payload ID: 13701
  Gene Symbol: PPP4R4
  Gene Name: protein phosphatase 4, regulatory subunit 4
  ENST ID: ENST00000630860
  CDS Start-End: 377-564

SEQ ID NO: 171360 - DNA, 564 bp, Homo sapiens; identical to SEQ ID NO: 171353
  Payload ID: 13701
  Gene Symbol: PPP4R4
  Gene Name: protein phosphatase 4, regulatory subunit 4
  ENST ID: ENST00000628432
  CDS Start-End: 394-564

SEQ ID NO: 171361 - DNA, 2109 bp, Homo sapiens
  Payload ID: 13702
  Gene Symbol: PPP5C
  Gene Name: protein phosphatase 5, catalytic subunit
  Uniprot ID: P53041
  ENST ID: ENST00000012443
  CDS Start-End: 104-1603
acgacacttgtgcggcagcggcggcggccacccggcgctccttcgcgacggttcggccgggtgccgctggcggccgttgccagggtaggggtcgctttgcggcatggcgatggcggagggcgagaggactgagtgtgctgagcccccccgggacgaacccccggctgatggagctctgaagcgggcagaggagctcaagactcaggccaatgactacttcaaagccaaggactacgagaacgccatcaagttctacagccaggccatcgagctgaaccccagcaatgccatctactatggcaaccgcagcctggcctacctgcgcactgagtgctatggctacgcgctgggagacgccacgcgggccattgagctggacaagaagtacatcaagggttattaccgccgggctgccagcaacatggcactgggcaagttccgggccgcgctgcgagactacgagacggtggtcaaggtgaagccccatgacaaggatgccaaaatgaaataccaggagtgcaacaagatcgtgaagcagaaggcctttgagcgggccatcgcgggcgacgagcacaagcgctccgtggtggactcgctggacatcgagagcatgaccattgaggatgagtacagcggacccaagcttgaagacggcaaagtgacaatcagtttcatgaaggagctcatgcagtggtacaaggaccagaagaaactgcaccggaaatgtgcctaccagattctggtacaggtcaaagaggtcctctccaagctgagcacgctcgtggaaaccacactcaaagagacagagaagattacagtatgtggggacacccatggccagttctatgacctcctcaacatattcgagctcaacggtttaccctcggagaccaacccctatatatttaatggtgactttgtggaccgaggctccttctctgtagaagtgatcctcacccttttcggcttcaagctcctgtacccagatcactttcacctccttcgaggcaaccacgagacagacaacatgaaccagatctacggtttcgagggtgaggtgaaggccaagtacacagcccagatgtacgagctctttagcgaggtgttcgagtggctcccgttggcccagtgcatcaacggcaaagtgctgatcatgcacggaggcctgttcagtgaagacggtgtcaccctggatgacatccggaaaattgagcggaatcgacaacccccagattcagggcccatgtgtgacctgctctggtcagatccacagccacagaacgggcgctcgatcagcaagcggggcgtgagctgtcagtttgggcctgacgtcaccaaggccttcttggaagagaacaacctggactatatcatccgcagccacgaagtcaaggccgagggctacgaggtggctcacggaggccgctgtgtcaccgtcttctctgcccccaactactgcgaccagatggggaacaaagcctcctacatccacctccagggctctgacctacggcctcagttccaccagttcacagcagtgcctcatcccaacgtcaagcccatggcctatgccaacacgctgctgcagctaggaatgatgtgaggtgacgggcggggcggcctgcatcccagggcccctccaatcccaccggacccaggccctgggctaggggcagagcaggccccgccccagggcaatgttggacccccttttactttgtaaagtttgtatttattcccctttaggtttgcagagggggtaggggcagagtcaggggctggccagagggtctgctccctggacagagaggaaggaggtggagcagctggggctgggggcacagcctgggcattctgtggggaggccgtcctcggggtggggtggggccgagtggctgccctgcccccctcatttgcatggctcctcccccactcaagcaatagggccccgccataggaagacccccagagagagggtcagcaggggggccccgcctgcgcctcccctcctatagccccatggtggggctaggctggggctcacccccctccccagctattttatgtctgtaattaaatatgttaaaataaagtcattatcggaagtca

SEQ ID NO: 171362 - DNA, 1929 bp, Homo sapiens
  Payload ID: 13702
  Gene Symbol: PPP5C
  Gene Name: protein phosphatase 5, catalytic subunit
  ENST ID: ENST00000391919
  CDS Start-End: 308-1423
ggagggcgagaggactgagtgtgctgagcccccccgggacgaacccccggctgatggagctctgaagcgggcagaggagctcaagactcaggccaatgactacttcaaagccaaggactacgagaacgccatcaagttctacagccaggccatcgagctgaaccccagcaatgccatctactatggcaaccgcagcctggcctacctgcgcactgagtgctatggctacgcgctgggagacgccacgcgggccattgagctggacaagaagtacatcaagggttattaccgccgggctgccagcaacatggcactgggcaagttccgggccgcgctgcgagactacgagacggtggtcaaggtgaagccccatgacaaggatgccaaaatgaaataccaggagtgcaacaagatcgtgaagcagaaggcctttgagcgggccatcgcgggcgacgagcacaagcgctccgtggtggactcgctggacatcgagagcatgaccattgaggatgagtacagcggacccaagcttgaagacggcaaagtgacaatcagtttcatgaaggagctcatgcagtggtacaaggaccagaagaaactgcaccggaaatgtgcctaccagacagagaagattacagtatgtggggacacccatggccagttctatgacctcctcaacatattcgagctcaacggtttaccctcggagaccaacccctatatatttaatggtgactttgtggaccgaggctccttctctgtagaagtgatcctcacccttttcggcttcaagctcctgtacccagatcactttcacctccttcgaggcaaccacgagacagacaacatgaaccagatctacggtttcgagggtgaggtgaaggccaagtacacagcccagatgtacgagctctttagcgaggtgttcgagtggctcccgttggcccagtgcatcaacggcaaagtgctgatcatgcacggaggcctgttcagtgaagacggtgtcaccctggatgacatccggaaaattgagcggaatcgacaacccccagattcagggcccatgtgtgacctgctctggtcagatccacagccacagaacgggcgctcgatcagcaagcggggcgtgagctgtcagtttgggcctgacgtcaccaaggccttcttggaagagaacaacctggactatatcatccgcagccacgaagtcaaggccgagggctacgaggtggctcacggaggccgctgtgtcaccgtcttctctgcccccaactactgcgaccagatggggaacaaagcctcctacatccacctccagggctctgacctacggcctcagttccaccagttcacagcagtgcctcatcccaacgtcaagcccatggcctatgccaacacgctgctgcagctaggaatgatgtgaggtgacgggcggggcggcctgcatcccagggcccctccaatcccaccggacccaggccctgggctaggggcagagcaggccccgccccagggcaatgttggacccccttttactttgtaaagtttgtatttattcccctttaggtttgcagagggggtaggggcagagtcaggggctggccagagggtctgctccctggacagagaggaaggaggtggagcagctggggctgggggcacagcctgggcattctgtggggaggccgtcctcggggtggggtggggccgagtggctgccctgcccccctcatttgcatggctcctcccccactcaagcaatagggccccgccataggaagacccccagagagagggtcagcaggggggccccgcctgcgcctcccctcctatagccccatggtggggctaggctggggctcacccccctccccagctattttatgtctgtaattaaatatgttaaaataaagtcattatcggaagtca

SEQ ID NO: 171363 - DNA, 1886 bp, Homo sapiens
  Payload ID: 13702
  Gene Symbol: PPP5C
  Gene Name: protein phosphatase 5, catalytic subunit
  ENST ID: ENST00000478046
  CDS Start-End: 1-1457
cgatggcggagggcgagaggactgagtgtgctgagcccccccgggacgaacccccggctgatggagctctgaagcgggcagaggagctcaagactcaggccaatgactacttcaaagccaaggactacgagaacgccatcaagttctacagccaggccatcgagctgaaccccagcaatgccatctactatggcaaccgcagcctggcctacctgcgcactgagtgctatggctacgcgctgggagacgccacgcgggccattgagctggacaagaagtacatcaagggttattaccgccgggctgccagcaacatggcactgggcaagttccgggccgcgctgcgagactacgagacggtggtcaaggtgaagccccatgacaaggatgccaaaatgaaataccaggagtgcaacaagatcgtgaagcagaaggcctttgagcgggccatcgcgggcgacgagcacaagcgctccgtggtggactcgctggacatcgagagcatgaccattgaggatgagtacagcggacccaagcttgaagacggcaaagtgacaatcagtttcatgaaggagctcatgcagtggtacaaggaccagaagaaactgcaccggaaatgtgcctaccagattctggtacaggtcaaagaggtcctctccaagctgagcacgctcgtggaaaccacactcaaagagacagagaagattacagtatgtggggacacccatggccagttctatgacctcctcaacatattcgagctcaacggtttaccctcggagaccaacccctatatatttaatggtgactttgtggaccgaggctccttctctgtagaagtgatcctcacccttttcggcttcaagctcctgtacccagatcactttcacctccttcgaggcaaccacgagacagacaacatgaaccagatctacggtttcgagggtgaggtgaaggccaagtacacagcccagatgtacgagctctttagcgaggtgttcgagtggctcccgttggcccagtgcatcaacggcaaagtgctgatcatgcacggaggcctgttcagtgaagacggtgtcaccctggatgacatccggaaaattgagcggaatcgacaacccccagattcagggcccatgtgtgacctgctctggtcagatccacagccacagaacgggcgctcgatcagcaagcggggcgtgagctgtcagtttgggcctgacgtcaccaaggccttcttggaagagaacaacctggactatatcatccgcagccacgaagtcaaggccgagggctacgaggtggctcacggaggccgctgtgtcaccgtcttctctgcccccaactactgcgaccagatggggaacaaagcctcctacatccacctccagggctctgacctacggcctcagttccaccagttcacagcagtgggtaggcccagcagtggttcttgacatcacacgatgaggcgcgcatctcccgtcatccagggagaccagaggacccttgtctcactcccagttggctcttagtcacagccccgctttgtctttgacatggacgtttgtgatgatcacgttcctcccgctccccgtgtctgaagagtgctccctgactggctgccgtctcctccctgtcgggtctggctgggttctccagagggagtgctgcggaggggacacagcagaggccccatgctcgtgatgtatgttgcagatcattttcccccattctgtccttttttgttaaattgtggtaaaaagcacataacataaactgtaccaccttaaccatttgaaagtatatatcccagactgtcttttatctttagacttcacttgtggtttgttgccacagtacaagtttatttttatgaagccaaa

SEQ ID NO: 171364 - DNA, 4118 bp, Homo sapiens
  Payload ID: 13703
  Gene Symbol: PPP6C
  Gene Name: protein phosphatase 6, catalytic subunit
  Uniprot ID: O00743
  ENST ID: ENST00000373547
  CDS Start-End: 101-1018
ggacgtgacgcagggaaagttccggcttcggcctccgccgctgccgccgccgctgctacagccgccgccgccgctgttgccgcggcttgttattcttaaaatggcgccgctagacctggacaagtatgtggaaatagcgcggctgtgcaagtacctgccagagaacgacctgaagcggctatgtgactacgtttgtgacctcctcttagaagagtcaaatgttcagccagtatcaacaccagtaacagtgtgtggagatatccatggacagttttatgacctttgtgaactgttcagaactggaggtcaggttcctgacacaaactacatatttatgggtgattttgtagacagaggttactatagtttggagaccttcacttaccttcttgcattaaaggctaaatggcctgatcgtattacacttttgcgaggaaatcatgagagtagacagataacacaggtctatggattttatgatgagtgccaaaccaaatatggaaatgctaatgcctggagatactgtaccaaagtttttgacatgctcacagtagcagctttaatagatgagcagattttgtgtgtccatggtggtttatctcctgatatcaaaacactggatcaaattcgaaccatcgaacggaatcaggaaattcctcataaaggagcattttgtgatctggtttggtcagatcctgaagatgtggatacctgggctatcagtccccgaggagcaggttggctttttggagcaaaggtcacaaatgagtttgttcatatcaacaacttaaaactcatctgcagagcacatcaactagtgcacgaaggctataaatttatgtttgatgagaagctggtgacagtatggtctgctcctaattactgctatcgttgtggaaatattgcttcgatcatggtcttcaaagatgtaaatacaagagaaccaaagttattccgggcagttccagattcagaacgtgttattcctcccagaacgacaacgccatatttcctttgaggccttcgcccatcctgctgacccatttttctgccctcttcttaccccaattttcttgtattaccctctacaatatactttttattgagcactttgctgctgaaatgctgcctcttgcctttttttttttaaattttaaattatctaaatttattgtttgttgtggtgtctatagcaaagtttttctatcaattttcccccatcccatccccaccctggactcatttgagaagacttgagaaatgtcttaatactcacactgctgcatgtagctcttgcttatttactggtctgggaaacaggatgtgtttcctttttttaaaagccaattgacagattacacctaaatactcctccttttgtatcattcagccttttgttttagtttggtaagttttaagaaatttcagcagcaaagttgttattcagtgggcacgatggactccaaatgcctcaagttatgtatacctgtcccagatgtaaacttcattgtcctttgttggatgatattttaaatggatataaaataaattggtctaaagggctgccctccttgttgtgtttttaaattttagttaaaaactgctacagcttatgactttgtactttaagataattgtattgatcttttttcagattccttgtattttttaataaagtaatcttaaataaaactcagataggttaagtgttagaaattttaaacagcttacattgttagcgtaaagttatcttttcttttttcctaatcagagttcttgaccctttggttattgagtttaaaacttcaattgaaattcaatagtatttatttttgaaaaaaatcactaaactgtgcctaaagaacataactgccatattaatgttttggtttatatcctctatagtaatagaaaaacatttaatacttgtaatgctgatgtgttaatttgataccagttgagtagaatgtgatcaatccagtttacaatctatcatgagtattattaactaaaatctatgtgcttttcaataggaatcattcttctcttgctgtaacacttgaccttaacttttagaaagtgttcatttttaaactgcaactggaaaggttgaaaagttaggactcttgtatttgtgaactgtaatctgaagcagattatttaaagtgtagaaaaagaaacaagttcttcttttttgcaaaggtctgtgataccatatttcagctttgtgtaagtaatttgaatatccaaagggttgtgatgatcagttctgaatatgcaactgtccacttaataaggacaagtattccagtatctcttatgactgtagtcataaatgatgttggaatgtacattttgtgaaatagttggtatccctttactatgattaatttttgttattccaggaaatacttgtgaagccagccaattaataaagcactttagcatctgttcaggtagttttgaaaacccacttttccccttcaggataagaacttccaggttacctaaaaatgcaataaaaatctttatagtctaagcttcttggcatataatttttcatcagggttttcttttattaattgagcacaatactgttttgatttaatttttttccctcaaaccacccagctccttacatagtttttaattatatagctatatgaaagaggtggctaagacatttgctgcacacacttgaactaatgttgggtcagtagcttcgtgttactgccctgatcccagtgtaattcaggtggaaaggtatttttatctcacagggatatgtagctatgtattttactaattgtgaaacactggaaattaatgatgcagacaacttggtgtggtctttgaacagctctctgcagtatttttttttttcctgttaccataaattgtatttaagtgcttgctttccacttaagttgtactaatagaaccggtaactcccagccctccctgtttgacactccttagcttagattgatgtagttgtttttgttatccctataatgtgacttttatttttaagtcattgtgtactgcatttgtttgtcactagttgggcacgtgccaataatattctctccattccttatctgccatctctgttttgcctgatttctcttcaactgaataatggctttttgcatggaaaaaatagtttttactattagacgtgtaaagggaagagagagctaatgtattggactttgtgagcctacaaggaatattttggatccctccaataaataagggctatgtactatatgtactatatagagttatcatgtggtggaagatacttgcaagtcatagatttatgggcaggaggatttgttactccctatatctaggctgaatgtaaaatcccttatgttgtatcaatgggggtaaaaactatttttatttgcctatgatatacttggtttctaataaagtgccctaggctctagtgagaactgtctactttgaattgccatttactccctttcctcctttggccgatatgctcttggctagctttttataagttaatgtgtttccccaaaaagtttcactactttatattcatttgagtgtgatcctaaaacacctggatcaacagtacatctcatatgcaatctgcatcagctcctattctgtctggatgtctagaactgttggaagattttgacgtcttaagccctaggttttgctttgggaaataaggtttgaaatattgttcattgcattaagatttgtgtgtgtgtgctttgtaagcccagaaccaggttttggaaaatgcctgtactgtgaaagcaaattaggactctttctgagcctctttcattgtcagaaatagaatcactttccatcagcttccaggaaattgtgtatctggagtcgaagagatttgacatcaagaatccagatttttaaatgtaattgttttttaaatgctaatgtttgtaaagcaccttcagttcttcggatgaaaggtgctatattccctcagtgtaaattaataaaaagattacaggaagtttgtcaaaaaattcaatgcatagtctgtagtatgtcctgacaagaagttagcattttatataagaaattaaaaaatgcttattcctcca

SEQ ID NO: 171365 - DNA, 4349 bp, Homo sapiens
  Payload ID: 13703
  Gene Symbol: PPP6C
  Gene Name: protein phosphatase 6, catalytic subunit
  Uniprot ID: O00743
  ENST ID: ENST00000451402
  CDS Start-End: 222-1250
gaagcgggctctcttggggcctgcagtcggggttcagccagagggggcgccgggcgtaccgacgtagcggggagaaacgggtcgcgctttaacggcgctgcgcaggcgccactcacgggccggacgtgacgcagggaaagttccggcttcggcctccgccgctgccgccgccgctgctacagccgccgccgccgctgttgccgcggcttgttattcttaaaatggcgccgctagacctggacaagtatgtggaaatagcgcggctgtgcaagtacctgccagagaacgacctgaaggtgagccctatttgcgggctcgccccttccggctgtggggcgcccgccggccggcccttcctttctccaggacccccgccggtatttcattttcttcgttttctaaaggagcggctatgtgactacgtttgtgacctcctcttagaagagtcaaatgttcagccagtatcaacaccagtaacagtgtgtggagatatccatggacagttttatgacctttgtgaactgttcagaactggaggtcaggttcctgacacaaactacatatttatgggtgattttgtagacagaggttactatagtttggagaccttcacttaccttcttgcattaaaggctaaatggcctgatcgtattacacttttgcgaggaaatcatgagagtagacagataacacaggtctatggattttatgatgagtgccaaaccaaatatggaaatgctaatgcctggagatactgtaccaaagtttttgacatgctcacagtagcagctttaatagatgagcagattttgtgtgtccatggtggtttatctcctgatatcaaaacactggatcaaattcgaaccatcgaacggaatcaggaaattcctcataaaggagcattttgtgatctggtttggtcagatcctgaagatgtggatacctgggctatcagtccccgaggagcaggttggctttttggagcaaaggtcacaaatgagtttgttcatatcaacaacttaaaactcatctgcagagcacatcaactagtgcacgaaggctataaatttatgtttgatgagaagctggtgacagtatggtctgctcctaattactgctatcgttgtggaaatattgcttcgatcatggtcttcaaagatgtaaatacaagagaaccaaagttattccgggcagttccagattcagaacgtgttattcctcccagaacgacaacgccatatttcctttgaggccttcgcccatcctgctgacccatttttctgccctcttcttaccccaattttcttgtattaccctctacaatatactttttattgagcactttgctgctgaaatgctgcctcttgcctttttttttttaaattttaaattatctaaatttattgtttgttgtggtgtctatagcaaagtttttctatcaattttcccccatcccatccccaccctggactcatttgagaagacttgagaaatgtcttaatactcacactgctgcatgtagctcttgcttatttactggtctgggaaacaggatgtgtttcctttttttaaaagccaattgacagattacacctaaatactcctccttttgtatcattcagccttttgttttagtttggtaagttttaagaaatttcagcagcaaagttgttattcagtgggcacgatggactccaaatgcctcaagttatgtatacctgtcccagatgtaaacttcattgtcctttgttggatgatattttaaatggatataaaataaattggtctaaagggctgccctccttgttgtgtttttaaattttagttaaaaactgctacagcttatgactttgtactttaagataattgtattgatcttttttcagattccttgtattttttaataaagtaatcttaaataaaactcagataggttaagtgttagaaattttaaacagcttacattgttagcgtaaagttatcttttcttttttcctaatcagagttcttgaccctttggttattgagtttaaaacttcaattgaaattcaatagtatttatttttgaaaaaaatcactaaactgtgcctaaagaacataactgccatattaatgttttggtttatatcctctatagtaatagaaaaacatttaatacttgtaatgctgatgtgttaatttgataccagttgagtagaatgtgatcaatccagtttacaatctatcatgagtattattaactaaaatctatgtgcttttcaataggaatcattcttctcttgctgtaacacttgaccttaacttttagaaagtgttcatttttaaactgcaactggaaaggttgaaaagttaggactcttgtatttgtgaactgtaatctgaagcagattatttaaagtgtagaaaaagaaacaagttcttcttttttgcaaaggtctgtgataccatatttcagctttgtgtaagtaatttgaatatccaaagggttgtgatgatcagttctgaatatgcaactgtccacttaataaggacaagtattccagtatctcttatgactgtagtcataaatgatgttggaatgtacattttgtgaaatagttggtatccctttactatgattaatttttgttattccaggaaatacttgtgaagccagccaattaataaagcactttagcatctgttcaggtagttttgaaaacccacttttccccttcaggataagaacttccaggttacctaaaaatgcaataaaaatctttatagtctaagcttcttggcatataatttttcatcagggttttcttttattaattgagcacaatactgttttgatttaatttttttccctcaaaccacccagctccttacatagtttttaattatatagctatatgaaagaggtggctaagacatttgctgcacacacttgaactaatgttgggtcagtagcttcgtgttactgccctgatcccagtgtaattcaggtggaaaggtatttttatctcacagggatatgtagctatgtattttactaattgtgaaacactggaaattaatgatgcagacaacttggtgtggtctttgaacagctctctgcagtatttttttttttcctgttaccataaattgtatttaagtgcttgctttccacttaagttgtactaatagaaccggtaactcccagccctccctgtttgacactccttagcttagattgatgtagttgtttttgttatccctataatgtgacttttatttttaagtcattgtgtactgcatttgtttgtcactagttgggcacgtgccaataatattctctccattccttatctgccatctctgttttgcctgatttctcttcaactgaataatggctttttgcatggaaaaaatagtttttactattagacgtgtaaagggaagagagagctaatgtattggactttgtgagcctacaaggaatattttggatccctccaataaataagggctatgtactatatgtactatatagagttatcatgtggtggaagatacttgcaagtcatagatttatgggcaggaggatttgttactccctatatctaggctgaatgtaaaatcccttatgttgtatcaatgggggtaaaaactatttttatttgcctatgatatacttggtttctaataaagtgccctaggctctagtgagaactgtctactttgaattgccatttactccctttcctcctttggccgatatgctcttggctagctttttataagttaatgtgtttccccaaaaagtttcactactttatattcatttgagtgtgatcctaaaacacctggatcaacagtacatctcatatgcaatctgcatcagctcctattctgtctggatgtctagaactgttggaagattttgacgtcttaagccctaggttttgctttgggaaataaggtttgaaatattgttcattgcattaagatttgtgtgtgtgtgctttgtaagcccagaaccaggttttggaaaatgcctgtactgtgaaagcaaattaggactctttctgagcctctttcattgtcagaaatagaatcactttccatcagcttccaggaaattgtgtatctggagtcgaagagatttgacatcaagaatccagatttttaaatgtaattgttttttaaatgctaatgtttgtaaagcaccttcagttcttcggatgaaaggtgctatattccctcagtgtaaattaataaaaagattacaggaagtttgtcaaaaaattcaatgcatagtctgtagtatgtcctgacaagaagttagcattttatataagaaattaaaaaatgcttattcctcc

SEQ ID NO: 171366 - DNA, 4172 bp, Homo sapiens
  Payload ID: 13703
  Gene Symbol: PPP6C
  Gene Name: protein phosphatase 6, catalytic subunit
  Uniprot ID: O00743
  ENST ID: ENST00000415905
  CDS Start-End: 222-1073
gaagcgggctctcttggggcctgcagtcggggttcagccagagggggcgccgggcgtaccgacgtagcggggagaaacgggtcgcgctttaacggcgctgcgcaggcgccactcacgggccggacgtgacgcagggaaagttccggcttcggcctccgccgctgccgccgccgctgctacagccgccgccgccgctgttgccgcggcttgttattcttaaaatggcgccgctagacctggacaagtatgtggaaatagcgcggctgtgcaagtacctgccagagaacgacctgaagcggctatgtgactacgtttgtgacctcctcttagaagagtcaaatgttcagccagtatcaacaccagtaacagtgtgtggagatatccatggacagggtgattttgtagacagaggttactatagtttggagaccttcacttaccttcttgcattaaaggctaaatggcctgatcgtattacacttttgcgaggaaatcatgagagtagacagataacacaggtctatggattttatgatgagtgccaaaccaaatatggaaatgctaatgcctggagatactgtaccaaagtttttgacatgctcacagtagcagctttaatagatgagcagattttgtgtgtccatggtggtttatctcctgatatcaaaacactggatcaaattcgaaccatcgaacggaatcaggaaattcctcataaaggagcattttgtgatctggtttggtcagatcctgaagatgtggatacctgggctatcagtccccgaggagcaggttggctttttggagcaaaggtcacaaatgagtttgttcatatcaacaacttaaaactcatctgcagagcacatcaactagtgcacgaaggctataaatttatgtttgatgagaagctggtgacagtatggtctgctcctaattactgctatcgttgtggaaatattgcttcgatcatggtcttcaaagatgtaaatacaagagaaccaaagttattccgggcagttccagattcagaacgtgttattcctcccagaacgacaacgccatatttcctttgaggccttcgcccatcctgctgacccatttttctgccctcttcttaccccaattttcttgtattaccctctacaatatactttttattgagcactttgctgctgaaatgctgcctcttgcctttttttttttaaattttaaattatctaaatttattgtttgttgtggtgtctatagcaaagtttttctatcaattttcccccatcccatccccaccctggactcatttgagaagacttgagaaatgtcttaatactcacactgctgcatgtagctcttgcttatttactggtctgggaaacaggatgtgtttcctttttttaaaagccaattgacagattacacctaaatactcctccttttgtatcattcagccttttgttttagtttggtaagttttaagaaatttcagcagcaaagttgttattcagtgggcacgatggactccaaatgcctcaagttatgtatacctgtcccagatgtaaacttcattgtcctttgttggatgatattttaaatggatataaaataaattggtctaaagggctgccctccttgttgtgtttttaaattttagttaaaaactgctacagcttatgactttgtactttaagataattgtattgatcttttttcagattccttgtattttttaataaagtaatcttaaataaaactcagataggttaagtgttagaaattttaaacagcttacattgttagcgtaaagttatcttttcttttttcctaatcagagttcttgaccctttggttattgagtttaaaacttcaattgaaattcaatagtatttatttttgaaaaaaatcactaaactgtgcctaaagaacataactgccatattaatgttttggtttatatcctctatagtaatagaaaaacatttaatacttgtaatgctgatgtgttaatttgataccagttgagtagaatgtgatcaatccagtttacaatctatcatgagtattattaactaaaatctatgtgcttttcaataggaatcattcttctcttgctgtaacacttgaccttaacttttagaaagtgttcatttttaaactgcaactggaaaggttgaaaagttaggactcttgtatttgtgaactgtaatctgaagcagattatttaaagtgtagaaaaagaaacaagttcttcttttttgcaaaggtctgtgataccatatttcagctttgtgtaagtaatttgaatatccaaagggttgtgatgatcagttctgaatatgcaactgtccacttaataaggacaagtattccagtatctcttatgactgtagtcataaatgatgttggaatgtacattttgtgaaatagttggtatccctttactatgattaatttttgttattccaggaaatacttgtgaagccagccaattaataaagcactttagcatctgttcaggtagttttgaaaacccacttttccccttcaggataagaacttccaggttacctaaaaatgcaataaaaatctttatagtctaagcttcttggcatataatttttcatcagggttttcttttattaattgagcacaatactgttttgatttaatttttttccctcaaaccacccagctccttacatagtttttaattatatagctatatgaaagaggtggctaagacatttgctgcacacacttgaactaatgttgggtcagtagcttcgtgttactgccctgatcccagtgtaattcaggtggaaaggtatttttatctcacagggatatgtagctatgtattttactaattgtgaaacactggaaattaatgatgcagacaacttggtgtggtctttgaacagctctctgcagtatttttttttttcctgttaccataaattgtatttaagtgcttgctttccacttaagttgtactaatagaaccggtaactcccagccctccctgtttgacactccttagcttagattgatgtagttgtttttgttatccctataatgtgacttttatttttaagtcattgtgtactgcatttgtttgtcactagttgggcacgtgccaataatattctctccattccttatctgccatctctgttttgcctgatttctcttcaactgaataatggctttttgcatggaaaaaatagtttttactattagacgtgtaaagggaagagagagctaatgtattggactttgtgagcctacaaggaatattttggatccctccaataaataagggctatgtactatatgtactatatagagttatcatgtggtggaagatacttgcaagtcatagatttatgggcaggaggatttgttactccctatatctaggctgaatgtaaaatcccttatgttgtatcaatgggggtaaaaactatttttatttgcctatgatatacttggtttctaataaagtgccctaggctctagtgagaactgtctactttgaattgccatttactccctttcctcctttggccgatatgctcttggctagctttttataagttaatgtgtttccccaaaaagtttcactactttatattcatttgagtgtgatcctaaaacacctggatcaacagtacatctcatatgcaatctgcatcagctcctattctgtctggatgtctagaactgttggaagattttgacgtcttaagccctaggttttgctttgggaaataaggtttgaaatattgttcattgcattaagatttgtgtgtgtgtgctttgtaagcccagaaccaggttttggaaaatgcctgtactgtgaaagcaaattaggactctttctgagcctctttcattgtcagaaatagaatcactttccatcagcttccaggaaattgtgtatctggagtcgaagagatttgacatcaagaatccagatttttaaatgtaattgttttttaaatgctaatgtttgtaaagcaccttcagttcttcggatgaaaggtgctatattccctcagtgtaaattaataaaaagattacaggaagtttgtcaaaaaattcaatgcatagtctgtagtatgtcctgacaagaagttagcattttatataagaaattaaaaaatgcttattcctcc

SEQ ID NO: 171367 - DNA, 569 bp, Homo sapiens
  Payload ID: 13703
  Gene Symbol: PPP6C
  Gene Name: protein phosphatase 6, catalytic subunit
  ENST ID: ENST00000456642
  CDS Start-End: 195-569
cgccgctgccgccgccgctgctacagccgccgccgccgctgttgccgcggcttgttattcttaaaatggcgccgctagacctggacaagtatgtggaaatagcgcggctgtgcaagtacctgccagagaacgacctgaagttttgggctatgatgcattaggcttctgcgagtatttatatacagattttgaacatgtttttattgccaagactacagttgctgggtcaaatgcggctatgtgactacgtttgtgacctcctcttagaagagtcaaatgttcagccagtatcaacaccagtaacagtgtgtggagatatccatggacagttttatgacctttgtgaactgttcagaactggaggtcaggttcctgacacaaactacatatttatgggtgattttgtagacagaggttactatagtttggagaccttcacttaccttcttgcattaaaggctaaatggcctgatcgtattacacttttgcgaggaaatcatgagagtagacagataacacaggtctatggattttatgatgagtgccaaaccaaatatggaaatgctaat

SEQ ID NO: 171368 - DNA, 3961 bp, Homo sapiens
  Payload ID: 13704
  Gene Symbol: PPP6R1
  Gene Name: protein phosphatase 6, regulatory subunit 1
  Uniprot ID: Q9UPN7
  ENST ID: ENST00000412770
  CDS Start-End: 568-3213
gagccgggcgtcggaggccctgaggccggccgcagagcccggagattgagcggctttggggaaggggtggttaaggaagtaggcctcggcttccgtcggtcgctgctcggctctgcggcccgtttggaccgcggaggaggtcgccttcccctcccgtggggcgctcggttggactgtggaaaccggggcaacttcccccgtcttcccggctgaggcgcctgcgtgggcctcgcgacccggctcgccaacccgcctcggcccgcacgcccacctcgcctgcggaccccggaggtgcctacgcggactagtgacgccccccgcccgtcggcaactccacccggcgctgaccccctcaactctgcaggacccggcgcgcgaggaccccacgacccgcgggcgcctgcgcggaccccgcgagccccggcgcctgcgcgagtccccgacgccgcccccgcccccactcaccgggccccgcagcaggggccggagccgccggcggcggggcgggggggggcgccccgatgagccccgagtgcgaggagccgccgccccccctcgcagggcgccatgttttggaagtttgacctgcacacaagctcgcacctggacacgctgctggagcgggaggacctgagcctgcccgagctgctggacgaggaagacgtgctgcaggagtgcaaggtcgtcaaccgcaagctgctggacttcctgctgcagccaccccacctgcaagcaatggtggcctgggtcacccaggagccgccagatagcggtgaggagcggctgcgctacaagtaccccagtgtggcctgcgagattctgacctcagatgtgccccagatcaatgatgccctgggtgctgatgagtcccttctgaaccggctctacggcttcctgcagagcaccggcagcctcaacccactgctggccagcttcttcagcaaggtcatgggcatcctcatcaaccgcaagacagaccagctcgtgtcctttcttcggaagaaggatgacttcgtggacctgctgctgcagcacattggcacctcggccatcatggacctcctgctgcgcctgctcacctgtgtggagcggcctcagctgaggcaggatgttgtcaattggctcaacgaggagaagatcgtccagcggctgattgagcagatccacccgtcgaaggatgagaatcaacattccaacgcatcccagtccctgtgtgacatcatccgcctgagccgggagcagatgatccaagtccaggacagcccagagcctgaccaactgctggccaccctggagaagcaggagacgattgagcagctcttaagcaacatgttcgagggggagcagagccagtctgtcatcgtcagtgggatccaggtgctgctgaccctgctggagcccaggaggccgaggtccgagtccgtgaccgtgaacagcttcttcagcagtgtggatgggcagctggagctcctggcccagggggccctggaaagcactgtgtccagtgtgggcgccttgcacgccctacgcccgcggctcagctgcttccaccagctcctgctggagcctcccaagctggagccgctacagatgacatggggcatgctggctccgcctctgggcaacacgcggctgcacgtggtcaagctcctggccagtgccctgagcgccaatgatgcagccctgacgcacgagctcctggcactggacgtgcccaacaccatgctggacctcttcttccattatgtcttcaacaacttcttgcatgcccaagtagagggatgcgtgagcaccatgctgagcttggggccacctcctgacagcagccctgagacgcccatccaaaaccctgttgtgaaacatctgctgcagcagtgccgcctggtggagcggatcctgacgtcctgggaggagaacgaccgtgtacagtgtgcgggaggccctcggaaaggctacatgggtcacctgacaagagtggccggtgccctggtgcagaacacggagaaggggcccaatgcagagcagctgcggcagctgctgaaggagctgcccagcgagcagcaggagcagtgggaagccttcgtatcggggcccctggcggagaccaacaagaagaacatggtggacctggtgaacacccaccacctacactcctccagtgacgatgaggacgaccggctcaaggagttcaacttccctgaggaggctgtgctgcagcaggccttcatggacttccagatgcagcgcatgacctctgccttcattgaccacttcggcttcaatgatgaggagtttggggagcaggaggagagtgtgaacgcaccttttgacaagacagccaacatcaccttctccctcaatgctgacgatgagaaccccaacgccaacctacttgagatatgctacaaggaccgcatccagcagtttgatgatgatgaggaagaggaggacgaggaagaggcccagggctcaggggagtctgatggagaagatggcgcctggcagggcagccagctggccaggggggcccgtctgggccagccacctggtgtccggagtggaggcagcacagacagtgaggacgaagaagaggaggacgaggaggaggaggaagacgaggagggcattggctgtgcagcccgtggaggggccacccctctgtcctaccccagccctggccctcagcctccaggccccagctggacagccacctttgacccagtgcctacagatgccccgaccagcccccgagtctccggggaggaagagctgcacactgggcctccagccccacaggggcccctcagtgtgccccagggcctccccactcagagcctggccagccctcctgcccgtgacgccctgcagctcaggtctcaggaccccacacccccctcagcacctcaggaagccacagaaggcagcaaagtcacggagccctcagccccttgccaggccttggttagcatcggggaccttcaggccaccttccacgggatccgttctgcccccagctcctcggacagtgcaaccagagacccctctacctctgtcccagcctccggggcccaccagcccccccagaccacagaaggggagaagagcccagagcccttggggcttccccaaagccagagtgcccaggccctcacgcctcctccgatacccaatggctctgccccggaagggcctgcatccccaggctcccaatagctgcctggtgcggcagcggcggccaaatcttccgtcctcccgtggatctcccggggtgggggcagggcgggtcccacgatggcccccattgccctcatcaccctgacacccccacattctctcctctggacccccaggaggctggtgccagggagacaggcccaacccacccccatttgcactgagaagagaagttttggagcgttgcctcctagaataaagatacagagagtcaaatagagagaatggagagagagaaacatatattatatattatatagagagagggaggagagcgagagagagtgaggacaccgaactgggctggcggctccaaagcacagccttccctgttccgtcccagcgggagctggtgttaggggtcccaaggttgccacccacgtgcccagctgtcccacgctgcagcgcagacggccacgcccacacccggccttttagctcaggtccaccatgggggacggcccagcgtgggtgggggtgccagagggtcccgagtgggggccgtgcctttgcccagaccctgcactttcaaccaggccagtccggctctggggagcaggggcctccccggcaacagccccaggggccttgagggtctgaggtcccagccctgttgccaagtgaccttgtccccagctccctcctcccaggctggtgtgagtgtgcgtgcgtttgtgccgagcttctatttcatattgcaaatataaataaaggaaggcagtttacg

SEQ ID NO: 171369 - DNA, 574 bp, Homo sapiens
  Payload ID: 13704
  Gene Symbol: PPP6R1
  Gene Name: protein phosphatase 6, regulatory subunit 1
  ENST ID: ENST00000592242
  CDS Start-End: 102-574
agactcgaagagctccgggaaggaggagggagcagcccagccccggctgagggcagtcaggtgtgacgcccacgcgggaggtagcaagagatgagggcgccatgttttggaagtttgacctgcacacaagctcgcacctggacacgctgctggagcgggaggacctgagcctgcccgagctgctggacgaggaagacgtgctgcaggagtgcaaggtcgtcaaccgcaagctgctggacttcctgctgcagccaccccacctgcaagcaatggtggcctgggtcacccaggagccgccagatagcggtgaggagcggctgcgctacaagtaccccagtgtggcctgcgagattctgacctcagatgtgccccagatcaatgatgccctgggtgctgatgagtcccttctgaaccggctctacggcttcctgcagagcaccggcagcctcaacccactgctggccagcttcttcagcaaggtcatgggcatcctcatcaaccgcaagacagaccagctcgtgtcctttcttcggaagaaggatgacttcgtggacctgctgctgcagcacattgg

SEQ ID NO: 171370 - DNA, 2953 bp, Homo sapiens
  Payload ID: 13704
  Gene Symbol: PPP6R1
  Gene Name: protein phosphatase 6, regulatory subunit 1
  Uniprot ID: Q9UPN7
  ENST ID: ENST00000587283
  CDS Start-End: 270-2915
ggaggctggagatgggggaagaggggcaggctcgagggcaactgcaggagcctggtgctcactgggagccttaagcctgagtgatggaggcagtgagcctgcgggcagtcccggggcggggccgggctcagcatgaggcagagggctgggacttggggagaggctgtgcccaaggtgggcactcagcccctgtggtcagtgcctcgtccagtggggactccctggggcgtctgacgcggcgctggttgtgtctatgcctgcagggcgccatgttttggaagtttgacctgcacacaagctcgcacctggacacgctgctggagcgggaggacctgagcctgcccgagctgctggacgaggaagacgtgctgcaggagtgcaaggtcgtcaaccgcaagctgctggacttcctgctgcagccaccccacctgcaagcaatggtggcctgggtcacccaggagccgccagatagcggtgaggagcggctgcgctacaagtaccccagtgtggcctgcgagattctgacctcagatgtgccccagatcaatgatgccctgggtgctgatgagtcccttctgaaccggctctacggcttcctgcagagcaccggcagcctcaacccactgctggccagcttcttcagcaaggtcatgggcatcctcatcaaccgcaagacagaccagctcgtgtcctttcttcggaagaaggatgacttcgtggacctgctgctgcagcacattggcacctcggccatcatggacctcctgctgcgcctgctcacctgtgtggagcggcctcagctgaggcaggatgttgtcaattggctcaacgaggagaagatcgtccagcggctgattgagcagatccacccgtcgaaggatgagaatcaacattccaacgcatcccagtccctgtgtgacatcatccgcctgagccgggagcagatgatccaagtccaggacagcccagagcctgaccaactgctggccaccctggagaagcaggagacgattgagcagctcttaagcaacatgttcgagggggagcagagccagtctgtcatcgtcagtgggatccaggtgctgctgaccctgctggagcccaggaggccgaggtccgagtccgtgaccgtgaacagcttcttcagcagtgtggatgggcagctggagctcctggcccagggggccctggaaagcactgtgtccagtgtgggcgccttgcacgccctacgcccgcggctcagctgcttccaccagctcctgctggagcctcccaagctggagccgctacagatgacatggggcatgctggctccgcctctgggcaacacgcggctgcacgtggtcaagctcctggccagtgccctgagcgccaatgatgcagccctgacgcacgagctcctggcactggacgtgcccaacaccatgctggacctcttcttccattatgtcttcaacaacttcttgcatgcccaagtagagggatgcgtgagcaccatgctgagcttggggccacctcctgacagcagccctgagacgcccatccaaaaccctgttgtgaaacatctgctgcagcagtgccgcctggtggagcggatcctgacgtcctgggaggagaacgaccgtgtacagtgtgcgggaggccctcggaaaggctacatgggtcacctgacaagagtggccggtgccctggtgcagaacacggagaaggggcccaatgcagagcagctgcggcagctgctgaaggagctgcccagcgagcagcaggagcagtgggaagccttcgtatcggggcccctggcggagaccaacaagaagaacatggtggacctggtgaacacccaccacctacactcctccagtgacgatgaggacgaccggctcaaggagttcaacttccctgaggaggctgtgctgcagcaggccttcatggacttccagatgcagcgcatgacctctgccttcattgaccacttcggcttcaatgatgaggagtttggggagcaggaggagagtgtgaacgcaccttttgacaagacagccaacatcaccttctccctcaatgctgacgatgagaaccccaacgccaacctacttgagatatgctacaaggaccgcatccagcagtttgatgatgatgaggaagaggaggacgaggaagaggcccagggctcaggggagtctgatggagaagatggcgcctggcagggcagccagctggccaggggggcccgtctgggccagccacctggtgtccggagtggaggcagcacagacagtgaggacgaagaagaggaggacgaggaggaggaggaagacgaggagggcattggctgtgcagcccgtggaggggccacccctctgtcctaccccagccctggccctcagcctccaggccccagctggacagccacctttgacccagtgcctacagatgccccgaccagcccccgagtctccggggaggaagagctgcacactgggcctccagccccacaggggcccctcagtgtgccccagggcctccccactcagagcctggccagccctcctgcccgtgacgccctgcagctcaggtctcaggaccccacacccccctcagcacctcaggaagccacagaaggcagcaaagtcacggagccctcagccccttgccaggccttggttagcatcggggaccttcaggccaccttccacgggatccgttctgcccccagctcctcggacagtgcaaccagagacccctctacctctgtcccagcctccggggcccaccagcccccccagaccacagaaggggagaagagcccagagcccttggggcttccccaaagccagagtgcccaggccctcacgcctcctccgatacccaatggctctgccccggaagggcctgcatccccaggctcccaatagctgcctggtgcggcagcggcggccaaatcttccgtcct

SEQ ID NO: 171371 - DNA, 3415 bp, Homo sapiens
  Payload ID: 13705
  Gene Symbol: PPP6R2
  Gene Name: protein phosphatase 6, regulatory subunit 2
  Uniprot ID: O75170
  ENST ID: ENST00000216061
  CDS Start-End: 371-3271
atatactccaagaaaaaaaccacaaatgtttttctgttttgcctgaatacatgatttaaacaagagatttccacagaagggcgctttcatggaactatatgatcatatgggcaacattctgttgcagtctaccttctgtctgacggatatgccatcctgaaaaaggaaagaagctgaacttcaagttcctttcatttagccttgggcttccaccttctctgtggctagaaacaggaccgtccagaagtcacctgtaactgccctatcttgcaagttctgattttggcaaaaaaaaaaaaaaaaagccttgacaaggttggattcacttctttccctggattgtgtgtcatccaactctgcggccgtcacgatgttctggaagtttgacttgaacaccacgtcccatgttgacaagctgctggacaaggagcatgtgacgctgcaggagttaatggatgaagatgacatcttgcaggagtgtaaggctcagaaccagaagctgctggacttcctgtgcaggcagcagtgcatggaggagctggtgagcctcatcacacaggatccgcccctggacatggaggagaaggtccgcttcaaatatccaaacacagcctgtgagcttctgacttgtgatgtgccgcagatcagcgaccgcctcggtggggacgagagcctgctgagcctcctgtacgacttcttggaccatgagccgcctctcaatcctctgctcgccagttttttcagcaagaccattggcaatctcattgcaagaaaaaccgaacaggtgattacgtttttgaagaagaaggacaagttcatcagcctggtgttgaagcacatcggcacctcagcgcttatggacctgctgctgcgcctggtcagctgtgtggagccagccgggctccggcaggacgtcctgcactggctgaatgaagagaaggtcatccagaggcttgtggagttgatccacccgagccaggatgaagataggcagtcaaatgcttctcagactctctgtgacatagttaggctgggcagagaccagggcagtcagctgcaagaggctctggagccagacccgctcctcacagcgctggagtcgcaggactgtgtggagcagcttctgaagaacatgtttgatggagaccggacggagagctgcctcgtcagtgggactcaggtgttactcaccttgctggaaaccaggcgggttgggacagagggcttggtggactccttttctcagggactggaaaggtcatacgctgtcagcagcagcgtactacacggcatcgagcctcggctgaaggacttccaccagctcctgctcaacccgcccaagaagaaagcgatcctgaccaccattggtgtgctggaggagcccctggggaatgcccgtctgcatggcgcccgcctcatggcagcactgctgcacacaaacacacccagcatcaaccaggagctctgccggctcaacacgatggacttactgctggacttgttctttaagtacacctggaataactttttgcacttccaagtggaactatgcatagccgctattctctcccacgctgcccgtgaggagaggacagaagccagcggatccgagagcagggtggagcctccgcatgagaacgggaaccggagcctggagactccccagccggccgccagcctccctgacaacacaatggtgacccacctgttccagaagtgctgcctggtgcagaggatcctggaggcctgggaagccaacgaccacacgcaggcagcgggtggcatgagacgtgggaacatgggccacctcacacggatcgccaacgcggtggtgcagaacctggagcggggccctgtgcagacgcacatcagcgaggtcatccgagggctccctgcggactgccgtggccgctgggagagcttcgtggaggagacgctgacggagacgaaccgcaggaacactgtggacctggtgagcactcaccaccttcactcctcaagtgaggacgaggacattgagggtgctttccctaacgagctgtcccttcagcaggccttctctgactaccagatccagcagatgacagccaacttcgtggatcagtttggcttcaatgatgaggagtttgccgaccaggacgacaacatcaatgccccgtttgacaggatcgcagagatcaacttcaacatcgacgctgacgaggacagtcccagcgcagctctgtttgaggcctgctgcagtgaccgcatccagccctttgatgatgatgaggacgaggacatctgggaggacagtgacactcgctgtgctgcccgggtgatggccagacccaggtttggagccccccatgcttcagagagttgctcaaagaatggcccagagcgtggaggccaggatgggaaggcgagcttggaagcacacagagatgcacctggggcaggtgccccaccggcccccgggaagaaggaagcgccccctgtggagggtgactcagaaggcgccatgtggacggcagtgtttgatgagccagcgaactcaacgcccacagccccaggagtggtgagggacgtgggttccagtgtgtgggcagctggcacctcagctccagaggagaaaggctgggccaagttcactgacttccaacctttctgctgctccgagtcagggcccaggtgcagctctccggtggacacagaatgcagccatgctgagggcagccggagccaaggccctgagaaagcctcacaggcctcctactttgcagtcagcccggcttctccatgtgcctggaacgtgtgtgtcaccaggaaggcccccctgctggcctctgacagtagctcctctgggggctcccacagcgaggatggcgaccagaaggcagcgagtgccatggatgcggtgagcaggggtcccggccgggaggcccccccgctgcccacagtggccaggacagaggaggctgtcggcagggtcgggtgtgctgacagccggctgttaagccctgcctgccccgcgccaaaggaagtgactgctgccccagccgtggctgtgccccccgaggctactgtggccatcaccacagcactgagcaaggctggccccgccatacccaccccagcagtctcttctgcactggccgtggcggtccccctagggcccatcatggcagtcacagcagccccagccatggtggccaccctggggacagtgacaaaggacgggaagacagatgccccgccagaaggagctgccttaaatggcccagtgtgatgctgctgccgcccggccacggcccaccctggtcaggctgcctccttaatcgagaaaactacctggtgatgcaatcttttttttttttaatttaatttaattttaaaataaatgctgcattggtaaagctggcagttgaaacca

SEQ ID NO: 171372 - DNA, 4035 bp, Homo sapiens
  Payload ID: 13705
  Gene Symbol: PPP6R2
  Gene Name: protein phosphatase 6, regulatory subunit 2
  Uniprot ID: O75170
  ENST ID: ENST00000359139
  CDS Start-End: 395-3178
ggagcgcgtgcccgtgcgccgccgccgccattttggagcgatcggagtgccgcccgcggccccgagtcggtctcgagccgccggccggccgtgccggtgtccgtaggcgctgcgccctcggccgggcccatgtgtgtgcggcccgcccgaggccgcccgggctttgcctccaccagcgccctggcctccgctcgggcctccacacgggcctccgaagagctgccgcgacgcccggcccgcagggcaggtaaagagattataaatcttccactgaatgaaaaaaattttcttaaagctgcatatactccaagaaaaaaaccacaaatgtttttctgttttgcctgaatacatgatttaaacaagagatttccacagaagctctgcggccgtcacgatgttctggaagtttgacttgaacaccacgtcccatgttgacaagctgctggacaaggagcatgtgacgctgcaggagttaatggatgaagatgacatcttgcaggagtgtaaggctcagaaccagaagctgctggacttcctgtgcaggcagcagtgcatggaggagctggtgagcctcatcacacaggatccgcccctggacatggaggagaaggtccgcttcaaatatccaaacacagcctgtgagcttctgacttgtgatgtgccgcagatcagcgaccgcctcggtggggacgagagcctgctgagcctcctgtacgacttcttggaccatgagccgcctctcaatcctctgctcgccagttttttcagcaagaccattggcaatctcattgcaagaaaaaccgaacaggtgattacgtttttgaagaagaaggacaagttcatcagcctggtgttgaagcacatcggcacctcagcgcttatggacctgctgctgcgcctggtcagctgtgtggagccagccgggctccggcaggacgtcctgcactggctgaatgaagagaaggtcatccagaggcttgtggagttgatccacccgagccaggatgaagataggcagtcaaatgcttctcagactctctgtgacatagttaggctgggcagagaccagggcagtcagctgcaagaggctctggagccagacccgctcctcacagcgctggagtcgcaggactgtgtggagcagcttctgaagaacatgtttgatggagaccggacggagagctgcctcgtcagtgggactcaggtgttactcaccttgctggaaaccaggcgggttgggacagagggcttggtggactccttttctcagggactggaaaggtcatacgctgtcagcagcagcgtactacacggcatcgagcctcggctgaaggacttccaccagctcctgctcaacccgcccaagaagaaagcgatcctgaccaccattggtgtgctggaggagcccctggggaatgcccgtctgcatggcgcccgcctcatggcagcactgctgcacacaaacacacccagcatcaaccaggagctctgccggctcaacacgatggacttactgctggacttgttctttaagtacacctggaataactttttgcacttccaagtggaactatgcatagccgctattctctcccacgctgcccgtgaggagaggacagaagccagcggatccgagagcagggtggagcctccgcatgagaacgggaaccggagcctggagactccccagccggccgccagcctccctgacaacacaatggtgacccacctgttccagaagtgctgcctggtgcagaggatcctggaggcctgggaagccaacgaccacacgcaggcagcgggtggcatgagacgtgggaacatgggccacctcacacggatcgccaacgcggtggtgcagaacctggagcggggccctgtgcagacgcacatcagcgaggtcatccgagggctccctgcggactgccgtggccgctgggagagcttcgtggaggagacgctgacggagacgaaccgcaggaacactgtggacctggccttctctgactaccagatccagcagatgacagccaacttcgtggatcagtttggcttcaatgatgaggagtttgccgaccaggacgacaacatcaatgccccgtttgacaggatcgcagagatcaacttcaacatcgacgctgacgaggacagtcccagcgcagctctgtttgaggcctgctgcagtgaccgcatccagccctttgatgatgatgaggacgaggacatctgggaggacagtgacactcgctgtgctgcccgggtgatggccagacccaggtttggagccccccatgcttcagagagttgctcaaagaatggcccagagcgtggaggccaggatgggaaggcgagcttggaagcacacagagatgcacctggggcaggtgccccaccggcccccgggaagaaggaagcgccccctgtggagggtgactcagaagcaggcgccatgtggacggcagtgtttgatgagccagcgaactcaacgcccacagccccaggagtggtgagggacgtgggttccagtgtgtgggcagctggcacctcagctccagaggagaaaggctgggccaagttcactgacttccaacctttctgctgctccgagtcagggcccaggtgcagctctccggtggacacagaatgcagccatgctgagggcagccggagccaaggccctgagaaagccttcagcccggcttctccatgtgcctggaacgtgtgtgtcaccaggaaggcccccctgctggcctctgacagtagctcctctgggggctcccacagcgaggatggcgaccagaaggcagcgagtgccatggatgcggtgagcaggggtcccggccgggaggcccccccgctgcccacagtggccaggacagaggaggctgtcggcagggtcgggtgtgctgacagccggctgttaagccctgcctgccccgcgccaaaggaagtgactgctgccccagccgtggctgtgccccccgaggctactgtggccatcaccacagcactgagcaaggctggccccgccatacccaccccagcagtctcttctgcactggccgtggcggtccccctagggcccatcatggcagtcacagcagccccagccatggtggccaccctggggacagtgacaaaggacggacagatgccccgccagaaggagctgccttaaatggcccagtgtgatgctgctgccgcccggccacggcccaccctggtcaggctgcctccttaatcgagaaaactacctggtgatgcaatcttttttttttttaatttaatttaattttaaaataaatgctgcattggtaaagctggcagttgaaaccagttggacggcccagcttgcgtctcttctgcctgagtgggcctctcaggtcactcgtgccctgctggaggacagaggggcacctcagccgcccccaagcccagagcacagcaataaggtcggcctgcaggagccggggtgggggtgggggtggggggggcaggaccctgagatgccaccaggacctgatgggccaggaagggcgtggacatggaggctgtttttacagttttttttttgttgttgttttgtttttaaagaatacagaaggagccaagcttttttgcactttgtatccagctgcaagctcagggcagagtcaagggcctgggttggaaaaacctgactcacaggaatgcataattgacccttgcagctacccaatagcccttggagctggcactgaaccaggctgcaagatttgactgccttaaaaacacaaggccctctaggcctggcagggatgtccctgtgcccagcacagggtgcctggcagggggagaccacaggtatgcaggtggggggacatggtgtggcactaggggctcgaagactggtttctagcactaccggtcacggccatgtcgtcctagaagggtccagaagattattttacgttgagtccatttttaatgttctgatcacctgacagggcaccccaaacccccaactcccaataaaagccgtgacgttcggacaaa

SEQ ID NO: 171373 - DNA, 3304 bp, Homo sapiens
  Payload ID: 13705
  Gene Symbol: PPP6R2
  Gene Name: protein phosphatase 6, regulatory subunit 2
  Uniprot ID: O75170
  ENST ID: ENST00000395741
  CDS Start-End: 376-3177
cgccgccgccattttggagcgatcggagtgccgcccgcggccccgagtcggtctcgagccgccggccggccgtgccggtgtccgtaggcgctgcgccctcggccgggcccatgtgtgtgcggcccgcccgaggccgcccgggctttgcctccaccagcgccctggcctccgctcgggcctccacacgggcctccgaagagctgccgcgacgcccggcccgcagggcaggtaaagagattataaatcttccactgaatgaaaaaaattttcttaaagctgcatatactccaagaaaaaaaccacaaatgtttttctgttttgcctgaatacatgatttaaacaagagatttccacagaagctctgcggccgtcacgatgttctggaagtttgacttgaacaccacgtcccatgttgacaagctgctggacaaggagcatgtgacgctgcaggagttaatggatgaagatgacatcttgcaggagtgtaaggctcagaaccagaagctgctggacttcctgtgcaggcagcagtgcatggaggagctggtgagcctcatcacacaggatccgcccctggacatggaggagaaggtccgcttcaaatatccaaacacagcctgtgagcttctgacttgtgatgtgccgcagatcagcgaccgcctcggtggggacgagagcctgctgagcctcctgtacgacttcttggaccatgagccgcctctcaatcctctgctcgccagttttttcagcaagaccattggcaatctcattgcaagaaaaaccgaacaggtgattacgtttttgaagaagaaggacaagttcatcagcctggtgttgaagcacatcggcacctcagcgcttatggacctgctgctgcgcctggtcagctgtgtggagccagccgggctccggcaggacgtcctgcactggctgaatgaagagaaggtcatccagaggcttgtggagttgatccacccgagccaggatgaagataggcagtcaaatgcttctcagactctctgtgacatagttaggctgggcagagaccagggcagtcagctgcaagaggctctggagccagacccgctcctcacagcgctggagtccaggcaggactgtgtggagcagcttctgaagaacatgtttgatggagaccggacggagagctgcctcgtcagtgggactcaggtgttactcaccttgctggaaaccaggcgggttgggacagagggcttggtggactccttttctcagggactggaaaggtcatacgctgtcagcagcagcgtactacacggcatcgagcctcggctgaaggacttccaccagctcctgctcaacccgcccaagaagaaagcgatcctgaccaccattggtgtgctggaggagcccctggggaatgcccgtctgcatggcgcccgcctcatggcagcactgctgcacacaaacacacccagcatcaaccaggagctctgccggctcaacacgatggacttactgctggacttgttctttaagtacacctggaataactttttgcacttccaagtggaactatgcatagccgctattctctcccacgctgcccgtgaggagaggacagaagccagcggatccgagagcagggtggagcctccgcatgagaacgggaaccggagcctggagactccccagccggccgccagcctccctgacaacacaatggtgacccacctgttccagaagtgctgcctggtgcagaggatcctggaggcctgggaagccaacgaccacacgcaggcagcgggtggcatgagacgtgggaacatgggccacctcacacggatcgccaacgcggtggtgcagaacctggagcggggccctgtgcagacgcacatcagcgaggtcatccgagggctccctgcggactgccgtggccgctgggagagcttcgtggaggagacgctgacggagacgaaccgcaggaacactgtggacctggccttctctgactaccagatccagcagatgacagccaacttcgtggatcagtttggcttcaatgatgaggagtttgccgaccaggacgacaacatcaatgccccgtttgacaggatcgcagagatcaacttcaacatcgacgctgacgaggacagtcccagcgcagctctgtttgaggcctgctgcagtgaccgcatccagccctttgatgatgatgaggacgaggacatctgggaggacagtgacactcgctgtgctgcccgggtgatggccagacccaggtttggagccccccatgcttcagagagttgctcaaagaatggcccagagcgtggaggccaggatgggaaggcgagcttggaagcacacagagatgcacctggggcaggtgccccaccggcccccgggaagaaggaagcgccccctgtggagggtgactcagaaggcgccatgtggacggcagtgtttgatgagccagcgaactcaacgcccacagccccaggagtggtgagggacgtgggttccagtgtgtgggcagctggcacctcagctccagaggagaaaggctgggccaagttcactgacttccaacctttctgctgctccgagtcagggcccaggtgcagctctccggtggacacagaatgcagccatgctgagggcagccggagccaaggccctgagaaagccttcagcccggcttctccatgtgcctggaacgtgtgtgtcaccaggaaggcccccctgctggcctctgacagtagctcctctgggggctcccacagcgaggatggcgaccagaaggcagcgagtgccatggatgcggtgagcaggggtcccggccgggaggcccccccgctgcccacagtggccaggacagaggaggctgtcggcagggtcgggtgtgctgacagccggctgttaagccctgcctgccccgcgccaaaggaagtgactgctgccccagccgtggctgtgccccccgaggctactgtggccatcaccacagcactgagcaaggctggccccgccatacccaccccagcagtctcttctgcactggccgtggcggtccccctagggcccatcatggcagtcacagcagccccagccatggtggccaccctggggacagtgacaaaggacgggaagacagatgccccgccagaaggagctgccttaaatggcccagtgtgatgctgctgccgcccggccacggcccaccctggtcaggctgcctccttaatcgagaaaactacctggtgatgcaatcttttttttttttaatttaatttaattttaaaataaatgctgcattggtaaa

SEQ ID NO: 171374 - DNA, 3293 bp, Homo sapiens
  Payload ID: 13705
  Gene Symbol: PPP6R2
  Gene Name: protein phosphatase 6, regulatory subunit 2
  Uniprot ID: O75170
  ENST ID: ENST00000395744
  CDS Start-End: 368-3166
ccattttggagcgatcggagtgccgcccgcggccccgagtcggtctcgagccgccggccggccgtgccggtgtccgtaggcgctgcgccctcggccgggcccatgtgtgtgcggcccgcccgaggccgcccgggctttgcctccaccagcgccctggcctccgctcgggcctccacacgggcctccgaagagctgccgcgacgcccggcccgcagggcaggtaaagagattataaatcttccactgaatgaaaaaaattttcttaaagctgcatatactccaagaaaaaaaccacaaatgtttttctgttttgcctgaatacatgatttaaacaagagatttccacagaagctctgcggccgtcacgatgttctggaagtttgacttgaacaccacgtcccatgttgacaagctgctggacaaggagcatgtgacgctgcaggagttaatggatgaagatgacatcttgcaggagtgtaaggctcagaaccagaagctgctggacttcctgtgcaggcagcagtgcatggaggagctggtgagcctcatcacacaggatccgcccctggacatggaggagaaggtccgcttcaaatatccaaacacagcctgtgagcttctgacttgtgatgtgccgcagatcagcgaccgcctcggtggggacgagagcctgctgagcctcctgtacgacttcttggaccatgagccgcctctcaatcctctgctcgccagttttttcagcaagaccattggcaatctcattgcaagaaaaaccgaacaggtgattacgtttttgaagaagaaggacaagttcatcagcctggtgttgaagcacatcggcacctcagcgcttatggacctgctgctgcgcctggtcagctgtgtggagccagccgggctccggcaggacgtcctgcactggctgaatgaagagaaggtcatccagaggcttgtggagttgatccacccgagccaggatgaagataggcagtcaaatgcttctcagactctctgtgacatagttaggctgggcagagaccagggcagtcagctgcaagaggctctggagccagacccgctcctcacagcgctggagtcgcaggactgtgtggagcagcttctgaagaacatgtttgatggagaccggacggagagctgcctcgtcagtgggactcaggtgttactcaccttgctggaaaccaggcgggttgggacagagggcttggtggactccttttctcagggactggaaaggtcatacgctgtcagcagcagcgtactacacggcatcgagcctcggctgaaggacttccaccagctcctgctcaacccgcccaagaagaaagcgatcctgaccaccattggtgtgctggaggagcccctggggaatgcccgtctgcatggcgcccgcctcatggcagcactgctgcacacaaacacacccagcatcaaccaggagctctgccggctcaacacgatggacttactgctggacttgttctttaagtacacctggaataactttttgcacttccaagtggaactatgcatagccgctattctctcccacgctgcccgtgaggagaggacagaagccagcggatccgagagcagggtggagcctccgcatgagaacgggaaccggagcctggagactccccagccggccgccagcctccctgacaacacaatggtgacccacctgttccagaagtgctgcctggtgcagaggatcctggaggcctgggaagccaacgaccacacgcaggcagcgggtggcatgagacgtgggaacatgggccacctcacacggatcgccaacgcggtggtgcagaacctggagcggggccctgtgcagacgcacatcagcgaggtcatccgagggctccctgcggactgccgtggccgctgggagagcttcgtggaggagacgctgacggagacgaaccgcaggaacactgtggacctggccttctctgactaccagatccagcagatgacagccaacttcgtggatcagtttggcttcaatgatgaggagtttgccgaccaggacgacaacatcaatgccccgtttgacaggatcgcagagatcaacttcaacatcgacgctgacgaggacagtcccagcgcagctctgtttgaggcctgctgcagtgaccgcatccagccctttgatgatgatgaggacgaggacatctgggaggacagtgacactcgctgtgctgcccgggtgatggccagacccaggtttggagccccccatgcttcagagagttgctcaaagaatggcccagagcgtggaggccaggatgggaaggcgagcttggaagcacacagagatgcacctggggcaggtgccccaccggcccccgggaagaaggaagcgccccctgtggagggtgactcagaaggcgccatgtggacggcagtgtttgatgagccagcgaactcaacgcccacagccccaggagtggtgagggacgtgggttccagtgtgtgggcagctggcacctcagctccagaggagaaaggctgggccaagttcactgacttccaacctttctgctgctccgagtcagggcccaggtgcagctctccggtggacacagaatgcagccatgctgagggcagccggagccaaggccctgagaaagccttcagcccggcttctccatgtgcctggaacgtgtgtgtcaccaggaaggcccccctgctggcctctgacagtagctcctctgggggctcccacagcgaggatggcgaccagaaggcagcgagtgccatggatgcggtgagcaggggtcccggccgggaggcccccccgctgcccacagtggccaggacagaggaggctgtcggcagggtcgggtgtgctgacagccggctgttaagccctgcctgccccgcgccaaaggaagtgactgctgccccagccgtggctgtgccccccgaggctactgtggccatcaccacagcactgagcaaggctggccccgccatacccaccccagcagtctcttctgcactggccgtggcggtccccctagggcccatcatggcagtcacagcagccccagccatggtggccaccctggggacagtgacaaaggacgggaagacagatgccccgccagaaggagctgccttaaatggcccagtgtgatgctgctgccgcccggccacggcccaccctggtcaggctgcctccttaatcgagaaaactacctggtgatgcaatcttttttttttttaatttaatttaattttaaaataaatgctgcattggtaaa

SEQ ID NO: 171375 - DNA, 2199 bp, Homo sapiens
  Payload ID: 13705
  Gene Symbol: PPP6R2
  Gene Name: protein phosphatase 6, regulatory subunit 2
  ENST ID: ENST00000401672
  CDS Start-End: 1-2056
gctggaaaccaggcgggttgggacagagggcttggtggactccttttctcagggactggaaaggtcatacgctgtcagcagcagcgtactacacggcatcgagcctcggctgaaggacttccaccagctcctgctcaacccgcccaagaagaaagcgatcctgaccaccattggtgtgctggaggagcccctggggaatgcccgtctgcatggcgcccgcctcatggcagcactgctgcacacaaacacacccagcatcaaccaggagctctgccggctcaacacgatggacttactgctggacttgttctttaagtacacctggaataactttttgcacttccaagtggaactatgcatagccgctattctctcccacgctgcccgtgaggagaggacagaagccagcggatccgagagcagggtggagcctccgcatgagaacgggaaccggagcctggagactccccagccggccgccagcctccctgacaacacaatggtgacccacctgttccagaagtgctgcctggtgcagaggatcctggaggcctgggaagccaacgaccacacgcaggcagcgggtggcatgagacgtgggaacatgggccacctcacacggatcgccaacgcggtggtgcagaacctggagcggggccctgtgcagacgcacatcagcgaggtcatccgagggctccctgcggactgccgtggccgctgggagagcttcgtggaggagacgctgacggagacgaaccgcaggaacactgtggacctggtgagcactcaccaccttcactcctcaagtgaggacgaggacattgagggtgctttccctaacgagctgtcccttcagcaggccttctctgactaccagatccagcagatgacagccaacttcgtggatcagtttggcttcaatgatgaggagtttgccgaccaggacgacaacatcaatgccccgtttgacaggatcgcagagatcaacttcaacatcgacgctgacgaggacagtcccagcgcagctctgtttgaggcctgctgcagtgaccgcatccagccctttgatgatgatgaggacgaggacatctgggaggacagtgacactcgctgtgctgcccgggtgatggccagacccaggtttggagccccccatgcttcagagagttgctcaaagaatggcccagagcgtggaggccaggatgggaaggcgagcttggaagcacacagagatgcacctggggcaggtgccccaccggcccccgggaagaaggaagcgccccctgtggagggtgactcagaaggcgccatgtggacggcagtgtttgatgagccagcgaactcaacgcccacagccccaggagtggtgagggacgtgggttccagtgtgtgggcagctggcacctcagctccagaggagaaaggctgggccaagttcactgacttccaacctttctgctgctccgagtcagggcccaggtgcagctctccggtggacacagaatgcagccatgctgagggcagccggagccaaggccctgagaaagccttcagcccggcttctccatgtgcctggaacgtgtgtgtcaccaggaaggcccccctgctggcctctgacagtagctcctctgggggctcccacagcgaggatggcgaccagaaggcagcgagtgccatggatgcggtgagcaggggtcccggccgggaggcccccccgctgcccacagtggccaggacagaggaggctgtcggcagggtcgggtgtgctgacagccggctgttaagccctgcctgccccgcgccaaaggaagtgactgctgccccagccgtggctgtgccccccgaggctactgtggccatcaccacagcactgagcaaggctggccccgccatacccaccccagcagtctcttctgcactggccgtggcggtccccctagggcccatcatggcagtcacagcagccccagccatggtggccaccctggggacagtgacaaaggacgggaagacagatgccccgccagaaggagctgccttaaatggcccagtgtgatgctgctgccgcccggccacggcccaccctggtcaggctgcctccttaatcgagaaaactacctggtgatgcaatcttttttttttttaatttaatttaattttaaaataaatgctgcattggtaaagctggcagttgaaacc

SEQ ID NO: 171376 - DNA, 1811 bp, Homo sapiens
  Payload ID: 13705
  Gene Symbol: PPP6R2
  Gene Name: protein phosphatase 6, regulatory subunit 2
  ENST ID: ENST00000427222
  CDS Start-End: 1-1687
cttactgctggacttgttctttaagtacacctggaataactttttgcacttccaagtggaactatgcatagccgctattctctcccacgctgcccgtgaggagaggacagaagccagcggatccgagagcagggtggagcctccgcatgagaacgggaaccggagcctggagactccccagccggccgccagcctccctgacaacacaatggtgacccacctgttccagaagtgctgcctggtgcagaggatcctggaggcctgggaagccaacgaccacacgcaggcagcgggtggcatgagacgtgggaacatgggccacctcacacggatcgccaacgcggtggtgcagaacctggagcggggccctgtgcagacgcacatcagcgaggtcatccgagggctccctgcggactgccgtggccgctgggagagcttcgtggaggagacgctgacggagacgaaccgcaggaacactgtggacctggccttctctgactaccagatccagcagatgacagccaacttcgtggatcagtttggcttcaatgatgaggagtttgccgaccaggacgacaacatcaatgccccgtttgacaggatcgcagagatcaacttcaacatcgacgctgacgaggacagtcccagcgcagctctgtttgaggcctgctgcagtgaccgcatccagccctttgatgatgatgaggacgaggacatctgggaggacagtgacactcgctgtgctgcccgggtgatggccagacccaggtttggagccccccatgcttcagagagttgctcaaagaatggcccagagcgtggaggccaggatgggaaggcgagcttggaagcacacagagatgcacctggggcaggtgccccaccggcccccgggaagaaggaagcgccccctgtggagggtgactcagaagcaggcgccatgtggacggcagtgtttgatgagccagcgaactcaacgcccacagccccaggagtggtgagggacgtgggttccagtgtgtgggcagctggcacctcagctccagaggagaaaggctgggccaagttcactgacttccaacctttctgctgctccgagtcagggcccaggtgcagctctccggtggacacagaatgcagccatgctgagggcagccggagccaaggccctgagaaagccttcagcccggcttctccatgtgcctggaacgtgtgtgtcaccaggaaggcccccctgctggcctctgacagtagctcctctgggggctcccacagcgaggatggcgaccagaaggcagcgagtgccatggatgcggtgagcaggggtcccggccgggaggcccccccgctgcccacagtggccaggacagaggaggctgtcggcagggtcgggtgtgctgacagccggctgttaagccctgcctgccccgcgccaaaggaagtgactgctgccccagccgtggctgtgccccccgaggctactgtggccatcaccacagcactgagcaaggctggccccgccatacccaccccagcagtctcttctgcactggccgtggcggtccccctagggcccatcatggcagtcacagcagccccagccatggtggccaccctggggacagtgacaaaggacgggaagacagatgccccgccagaaggagctgccttaaatggcccagtgtgatgctgctgccgcccggccacggcccaccctggtcaggctgcctccttaatcgagaaaactacctggtgatgcaatcttttttttttttaatttaatttaattttaaaataaatgctgcattggt

SEQ ID NO: 171377 - DNA, 4104 bp, Homo sapiens
  Payload ID: 13705
  Gene Symbol: PPP6R2
  Gene Name: protein phosphatase 6, regulatory subunit 2
  Uniprot ID: O75170
  ENST ID: ENST00000612753
  CDS Start-End: 382-3261
gtgcgccgccgccgccattttggagcgatcggagtgccgcccgcggccccgagtcggtctcgagccgccggccggccgtgccggtgtccgtaggcgctgcgccctcggccgggcccatgtgtgtgcggcccgcccgaggccgcccgggctttgcctccaccagcgccctggcctccgctcgggcctccacacgggcctccgaagagctgccgcgacgcccggcccgcagggcaggtaaagagattataaatcttccactgaatgaaaaaaattttcttaaagctgcatatactccaagaaaaaaaccacaaatgtttttctgttttgcctgaatacatgatttaaacaagagatttccacagaagctctgcggccgtcacgatgttctggaagtttgacttgaacaccacgtcccatgttgacaagctgctggacaaggagcatgtgacgctgcaggagttaatggatgaagatgacatcttgcaggagtgtaaggctcagaaccagaagctgctggacttcctgtgcaggcagcagtgcatggaggagctggtgagcctcatcacacaggatccgcccctggacatggaggagaaggtccgcttcaaatatccaaacacagcctgtgagcttctgacttgtgatgtgccgcagatcagcgaccgcctcggtggggacgagagcctgctgagcctcctgtacgacttcttggaccatgagccgcctctcaatcctctgctcgccagttttttcagcaagaccattggcaatctcattgcaagaaaaaccgaacaggtgattacgtttttgaagaagaaggacaagttcatcagcctggtgttgaagcacatcggcacctcagcgcttatggacctgctgctgcgcctggtcagctgtgtggagccagccgggctccggcaggacgtcctgcactggctgaatgaagagaaggtcatccagaggcttgtggagttgatccacccgagccaggatgaagataggcagtcaaatgcttctcagactctctgtgacatagttaggctgggcagagaccagggcagtcagctgcaagaggctctggagccagacccgctcctcacagcgctggagtcgcaggactgtgtggagcagcttctgaagaacatgtttgatggagaccggacggagagctgcctcgtcagtgggactcaggtgttactcaccttgctggaaaccaggcgggttgggacagagggcttggtggactccttttctcagggactggaaaggtcatacgctgtcagcagcagcgtactacacggcatcgagcctcggctgaaggacttccaccagctcctgctcaacccgcccaagaagaaagcgatcctgaccaccattggtgtgctggaggagcccctggggaatgcccgtctgcatggcgcccgcctcatggcagcactgctgcacacaaacacacccagcatcaaccaggagctctgccggctcaacacgatggacttactgctggacttgttctttaagtacacctggaataactttttgcacttccaagtggaactatgcatagccgctattctctcccacgctgcccgtgaggagaggacagaagccagcggatccgagagcagggtggagcctccgcatgagaacgggaaccggagcctggagactccccagccggccgccagcctccctgacaacacaatggtgacccacctgttccagaagtgctgcctggtgcagaggatcctggaggcctgggaagccaacgaccacacgcaggcagcgggtggcatgagacgtgggaacatgggccacctcacacggatcgccaacgcggtggtgcagaacctggagcggggccctgtgcagacgcacatcagcgaggtcatccgagggctccctgcggactgccgtggccgctgggagagcttcgtggaggagacgctgacggagacgaaccgcaggaacactgtggacctggtgagcactcaccaccttcactcctcaagtgaggacgaggacattgagggtgctttccctaacgagctgtcccttcagcaggccttctctgactaccagatccagcagatgacagccaacttcgtggatcagtttggcttcaatgatgaggagtttgccgaccaggacgacaacatcaatgccccgtttgacaggatcgcagagatcaacttcaacatcgacgctgacgaggacagtcccagcgcagctctgtttgaggcctgctgcagtgaccgcatccagccctttgatgatgatgaggacgaggacatctgggaggacagtgacactcgctgtgctgcccgggtgatggccagacccaggtttggagccccccatgcttcagagagttgctcaaagaatggcccagagcgtggaggccaggatgggaaggcgagcttggaagcacacagagatgcacctggggcaggtgccccaccggcccccgggaagaaggaagcgccccctgtggagggtgactcagaaggcgccatgtggacggcagtgtttgatgagccagcgaactcaacgcccacagccccaggagtggtgagggacgtgggttccagtgtgtgggcagctggcacctcagctccagaggagaaaggctgggccaagttcactgacttccaacctttctgctgctccgagtcagggcccaggtgcagctctccggtggacacagaatgcagccatgctgagggcagccggagccaaggccctgagaaagccttcagcccggcttctccatgtgcctggaacgtgtgtgtcaccaggaaggcccccctgctggcctctgacagtagctcctctgggggctcccacagcgaggatggcgaccagaaggcagcgagtgccatggatgcggtgagcaggggtcccggccgggaggcccccccgctgcccacagtggccaggacagaggaggctgtcggcagggtcgggtgtgctgacagccggctgttaagccctgcctgccccgcgccaaaggaagtgactgctgccccagccgtggctgtgccccccgaggctactgtggccatcaccacagcactgagcaaggctggccccgccatacccaccccagcagtctcttctgcactggccgtggcggtccccctagggcccatcatggcagtcacagcagccccagccatggtggccaccctggggacagtgacaaaggacgggaagacagatgccccgccagaaggagctgccttaaatggcccagtgtgatgctgctgccgcccggccacggcccaccctggtcaggctgcctccttaatcgagaaaactacctggtgatgcaatcttttttttttttaatttaatttaattttaaaataaatgctgcattggtaaagctggcagttgaaaccagttggacggcccagcttgcgtctcttctgcctgagtgggcctctcaggtcactcgtgccctgctggaggacagaggggcacctcagccgcccccaagcccagagcacagcaataaggtcggcctgcaggagccggggtgggggtgggggtggggggggcaggaccctgagatgccaccaggacctgatgggccaggaagggcgtggacatggaggctgtttttacagttttttttttgttgttgttttgtttttaaagaatacagaaggagccaagcttttttgcactttgtatccagctgcaagctcagggcagagtcaagggcctgggttggaaaaacctgactcacaggaatgcataattgacccttgcagctacccaatagcccttggagctggcactgaaccaggctgcaagatttgactgccttaaaaacacaaggccctctaggcctggcagggatgtccctgtgcccagcacagggtgcctggcagggggagaccacaggtatgcaggtggggggacatggtgtggcactaggggctcgaagactggtttctagcactaccggtcacggccatgtcgtcctagaagggtccagaagattattttacgttgagtccatttttaatgttctgatcacctgacagggcaccccaaacccccaactcccaataaaagccgtgacgttcggacaaa

SEQ ID NO: 171378 - DNA, 4794 bp, Homo sapiens
  Payload ID: 13706
  Gene Symbol: PPP6R3
  Gene Name: protein phosphatase 6, regulatory subunit 3
  Uniprot ID: Q5H9R7
  ENST ID: ENST00000265636
  CDS Start-End: 278-2659
cgtgggcacctccagataagaaaacaagctcagagagatgtggtgacttgctcaaatagtgacagaacttcctcggccatatggaggggtcatataatacccttgtgtcttcagtttgaggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaagaccagcatgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaagtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattggttaaatgaggagaaaattatccagaggcttgtggaaatagttcatccatcgcaagaagaagatcgacattcaaatgcatcacaatcactttgtgaaattgttcgcctgagcagagaccagatgttacaaattcagaacagtacagagcccgaccccctgcttgccactctagaaaagcaagaaattatagagcagcttctatcaaatattttccacaaggagaaaaatgagtcagccatagtcagtgcaatccagatattgctgactttacttgagacacgacgaccaacatttgaaggccatatagagatctgcccaccaggcatgagccattcagcttgttcagtaaacaagagtgttctagaagccatcagaggaagacttggatcttttcatgaactcctgctggagccacccaagaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaaatgaatgagaagaaacaggctgagggaggaagacggcatggttacatgggacacctaacgaggatagctaactgtatcgtgcacagcactgacaagggccccaacagtgcattagtgcagcagcttatcaaagatcttcccgacgaagtcagggaacgatgggagacgttctgcacaagctccttaggagaaactaacaagaggaacacggtagatctagccttttctgattatcagatgcaacaaatgacgtccaattttattgaccagtttggcttcaacgatgagaagtttgcagatcaagatgacattggcaatgtttcttttgatcgagtatcagacatcaactttactctcaatacaaatgaaagtggaaatattgccttgtttgaagcatgttgtaaggaaagaatacaacagtttgatgatggtggctctgatgaggaagatatatgggaggaaaagcacatcgcattcacaccagaatcccaaagacgatccagctcggggagtacagacagtgaggaaagtacagactctgaagaagaagatggagcaaagcaagacttgtttgaacccagcagtgccaacacggaggataaaatggaggtggacctgagtgaaccacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgagcacaaaagattctttaaggagtaattctccagtggaaatggaaaccagcactgaacccatggaccctctgactcccagtgcggctgccctggcagtgcagccagaagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaagtgaggaagggaaactgtctacctctcaagatgctgcttgtaaagacgcagaggagtgtcccgagactgcagaggcgaagtgcgcggcgcccaggcctcccagcagcagtcccgagcagaggactggccaaccaagcgcaccaggtgacacttcagtgaatggccctgtatgacgggtgacgtctgctgctgctgactgaggactgcagaccgccaccactcaggggctctggaggggtcagctggagcccaccaagctgtcactgctgcactcactctgcaagggatcaggaccagcaacctttatattctagattctaagacattgtacagagaaattcagaagtgtaaaaatattgcacattgacaaataccaagaatttttgcgtatgtttatattgtattgttctaaataatgggtagcctgtgaaataagatcttgccacccatgtaataatagtagtaatactatagttaaaatggctgtaagaatagttttataaaagtgaatacacagatctattgtatttgaaacataactttgacaattattagtgtgaccaaagtattaggcggttttcatacatttttcaccttgtacaaaattatgaattcatttttcctccaggccgacaaggagttgtagaatgaaaatgccctctaagtgttattttggttgttctaacttacaaaagtgattttgaataagaaatatttggtgttctttttataaccagtttttgattggtaattgttttctgtattgtttaaaacggatcaaaaatgtaagtctattggtagagattaagtaaagtatttattgctacatcatagttgataaattgatgttatcgtaaagccatatgttctgttcaagtcttgtttgcttgaaatgattattcctacaagtgaaacactagactatttggagtgtatatggcttgtgttttgggattttttttttttttttttggcttttgtttttgtttgtttttttgtttcatttggtagttcatctgccttttaacccattcaccaaaatttaccttgttaacaagcatcaccaatgaacatttcagagcaatctgcatatttaacagacctaaaataaatcctattaggcaagtcagttgaaaatgctcgtgctgctaatggaattagagtgcgttcattttacaggctagtattttaaaagtagaaatcaaaatctggcaccgaagcatgctaattgtttactgtaccttgtgaggttttcactcataaatttaaaccagtgtatttttttagaactggtttgtgtatatatatagtgattatggatactaattcaatgtaatttataattttctatgtcaatacaaaaatacatcacagccttctcaaacagctcaagcaatatattgtatattgccatatcgtctggtgaaagggttaaattacttcacctcttgcacttttagatgcaaatcagtttttcatttctgtaatagaaaattattcacgtatttttacatcatttgtttttcctgaccagtatttaaaaccaaaaggatattctgaaaaatggccaacaatttttttagaagtagcatcccaagcagcgtgcctaaacattacattgcatatggaaataaaagaatcaaacgtctaatgccttattatttctgatttcctttttcattttaagtggtgtggagattccagcactcccaggacagtggagtcagcagtaagccctgggacaggtggcaagggtgggtcccttgacctttgcacgcctcctcaggaaccccctttcccgggtgagcccctctctgaagagactgtccttgggcctcctctggaagcagcacccccagaggacagggctcctcctgcttgcctcagggctgcctgacttgaatggcgttggacctcggggattactggtagataatatgctctggtctcgcctggtggtgagttttgccagccatggccagggtttggctccactggtggcacacgtggcctccgtggtatggacctggtggcttctccatcccactgtggcctctgtggtatggacctggtggcttctccatcctacccaaggtaacagtgtcttgcttcatcccactgactgctgggagagagcctctgggacttttctttggggcatcattttgttttgtctttcgtagcagggaaaggatatgacaatggggaggacagttcttttggaggttggaggggccaagccaaggacaggagcaagtgtgccctcattttgtttctacttttaatttctgtgtgttggccatactga

SEQ ID NO: 171379 - DNA, 4783 bp, Homo sapiens
  Payload ID: 13706
  Gene Symbol: PPP6R3
  Gene Name: protein phosphatase 6, regulatory subunit 3
  ENST ID: ENST00000265637
  CDS Start-End: 83-2566
gggcgcttcgctgatggtgtcggtgagcgcgtttcccgcctgagcgcaactagcggcgggtcgtgggcacctccagaccagcatgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaagtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattggttaaatgaggagaaaattatccagaggcttgtggaaatagttcatccatcgcaagaagaagatcgacattcaaatgcatcacaatcactttgtgaaattgttcgcctgagcagagaccagatgttacaaattcagaacagtacagagcccgaccccctgcttgccactctagaaaagcaagaaattatagagcagcttctatcaaatattttccacaaggagaaaaatgagtcagccatagtcagtgcaatccagatattgctgactttacttgagacacgacgaccaacatttgaaggccatatagagatctgcccaccaggcatgagccattcagcttgttcagtaaacaagagtgttctagaagccatcagaggaagacttggatcttttcatgaactcctgctggagccacccaagaaaagtgtgatgaagaccacatggggtgtgctggatcctcctgtggggaatacccggttgaatgtcattaggttgatatccagcctgcttcaaaccaataccagcagtataaatggggaccttatggagctgaatagcattggagtcatattgaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaaatgaatgagaagaaacaggctgagggaggaagacggcatggttacatgggacacctaacgaggatagctaactgtatcgtgcacagcactgacaagggccccaacagtgcattagtgcagcagcttatcaaagatcttcccgacgaagtcagggaacgatgggagacgttctgcacaagctccttaggagaaactaacaagaggaacacggtagatctatttggcttcaacgatgagaagtttgcagatcaagatgacattggcaatgtttcttttgatcgagtatcagacatcaactttactctcaatacaaatgaaagtggaaatattgccttgtttgaagcatgttgtaaggaaagaatacaacagtttgatgatggtggctctgatgaggaagatatatgggaggaaaagcacatcgcattcacaccagaatcccaaagacgatccagctcggggagtacagacagtgaggaaagtacagactctgaagaagaagatggagcaaagcaagacttgtttgaacccagcagtgccaacacggaggataaaatggaggtggacctgagtgaaccacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgagcacaaaagattctttaaggagtaattctccagtggaaatggaaaccagcactgaacccatggaccctctgactcccagtgcggctgccctggcagtgcagccagaagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaagtgaggaagggaaactgtctacctctcaagatgctgcttgtaaagacgcagaggagtgtcccgagactgcagaggcgaagtgcgcggcgcccaggcctcccagcagcagtcccgagcagaggactggccaaccaagcgcaccaggtgacacttcagtgaatggccctgtatgacgggtgacgtctgctgctgctgactgaggactgcagaccgccaccactcaggggctctggaggggtcagctggagcccaccaagctgtcactgctgcactcactctgcaagggatcaggaccagcaacctttatattctagattctaagacattgtacagagaaattcagaagtgtaaaaatattgcacattgacaaataccaagaatttttgcgtatgtttatattgtattgttctaaataatgggtagcctgtgaaataagatcttgccacccatgtaataatagtagtaatactatagttaaaatggctgtaagaatagttttataaaagtgaatacacagatctattgtatttgaaacataactttgacaattattagtgtgaccaaagtattaggcggttttcatacatttttcaccttgtacaaaattatgaattcatttttcctccaggccgacaaggagttgtagaatgaaaatgccctctaagtgttattttggttgttctaacttacaaaagtgattttgaataagaaatatttggtgttctttttataaccagtttttgattggtaattgttttctgtattgtttaaaacggatcaaaaatgtaagtctattggtagagattaagtaaagtatttattgctacatcatagttgataaattgatgttatcgtaaagccatatgttctgttcaagtcttgtttgcttgaaatgattattcctacaagtgaaacactagactatttggagtgtatatggcttgtgttttgggattttttttttttttttttggcttttgtttttgtttgtttttttgtttcatttggtagttcatctgccttttaacccattcaccaaaatttaccttgttaacaagcatcaccaatgaacatttcagagcaatctgcatatttaacagacctaaaataaatcctattaggcaagtcagttgaaaatgctcgtgctgctaatggaattagagtgcgttcattttacaggctagtattttaaaagtagaaatcaaaatctggcaccgaagcatgctaattgtttactgtaccttgtgaggttttcactcataaatttaaaccagtgtatttttttagaactggtttgtgtatatatatagtgattatggatactaattcaatgtaatttataattttctatgtcaatacaaaaatacatcacagccttctcaaacagctcaagcaatatattgtatattgccatatcgtctggtgaaagggttaaattacttcacctcttgcacttttagatgcaaatcagtttttcatttctgtaatagaaaattattcacgtatttttacatcatttgtttttcctgaccagtatttaaaaccaaaaggatattctgaaaaatggccaacaatttttttagaagtagcatcccaagcagcgtgcctaaacattacattgcatatggaaataaaagaatcaaacgtctaatgccttattatttctgatttcctttttcattttaagtggtgtggagattccagcactcccaggacagtggagtcagcagtaagccctgggacaggtggcaagggtgggtcccttgacctttgcacgcctcctcaggaaccccctttcccgggtgagcccctctctgaagagactgtccttgggcctcctctggaagcagcacccccagaggacagggctcctcctgcttgcctcagggctgcctgacttgaatggcgttggacctcggggattactggtagataatatgctctggtctcgcctggtggtgagttttgccagccatggccagggtttggctccactggtggcacacgtggcctccgtggtatggacctggtggcttctccatcccactgtggcctctgtggtatggacctggtggcttctccatcctacccaaggtaacagtgtcttgcttcatcccactgactgctgggagagagcctctgggacttttctttggggcatcattttgttttgtctttcgtagcagggaaaggatatgacaatggggaggacagttcttttggaggttggaggggccaagccaaggacaggagcaagtgtgccctcattttgtttctacttttaatttctgtgtgttggccatactgaattatgagactaacagatgtctacaatacaatacctgtattcaaaataacaaaaataaagcctgattctttgtttctagaaa

SEQ ID NO: 171380 - DNA, 5093 bp, Homo sapiens
  Payload ID: 13706
  Gene Symbol: PPP6R3
  Gene Name: protein phosphatase 6, regulatory subunit 3
  Uniprot ID: Q5H9R7
  ENST ID: ENST00000393800
  CDS Start-End: 255-2876
gcttgatacgtccgccattttgggcgcttcgctgatggtgtcggtgagcgcgtttcccgcctgagcgcaactagcggcgggtcgtgggcacctccaggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaagaccagcatgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaagtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattggttaaatgaggagaaaattatccagaggcttgtggaaatagttcatccatcgcaagaagaagatcgacattcaaatgcatcacaatcactttgtgaaattgttcgcctgagcagagaccagatgttacaaattcagaacagtacagagcccgaccccctgcttgccactctagaaaagcaagaaattatagagcagcttctatcaaatattttccacaaggagaaaaatgagtcagccatagtcagtgcaatccagatattgctgactttacttgagacacgacgaccaacatttgaaggccatatagagatctgcccaccaggcatgagccattcagcttgttcagtaaacaagagtgttctagaagccatcagaggaagacttggatcttttcatgaactcctgctggagccacccaagaaaagtgtgatgaagaccacatggggtgtgctggatcctcctgtggggaatacccggttgaatgtcattaggttgatatccagcctgcttcaaaccaataccagcagtataaatggggaccttatggagctgaatagcattggagtcatattgaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaaatgaatgagaagaaacaggctgagggaggaagacggcatggttacatgggacacctaacgaggatagctaactgtatcgtgcacagcactgacaagggccccaacagtgcattagtgcagcagcttatcaaagatcttcccgacgaagtcagggaacgatgggagacgttctgcacaagctccttaggagaaactaacaagaggaacacggtagatctagttacaacctgccatattcattcatccagtgatgatgaaattgactttaaagaaacgggtttctcacaggattcttctttgcagcaagccttttctgattatcagatgcaacaaatgacgtccaattttattgaccagtttggcttcaacgatgagaagtttgcagatcaagatgacattggcaatgtttcttttgatcgagtatcagacatcaactttactctcaatacaaatgaaagtggaaatattgccttgtttgaagcatgttgtaaggaaagaatacaacagtttgatgatggtggctctgatgaggaagatatatgggaggaaaagcacatcgcattcacaccagaatcccaaagacgatccagctcggggagtacagacagtgaggaaagtacagactctgaagaagaagatggagcaaagcaagacttgtttgaacccagcagtgccaacacggaggataaaatggaggtggacctgagtgaaccacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgagcacaaaagattctttaaggagtaattctccagtggaaatggaaaccagcactgaacccatggaccctctgactcccagtgcggctgccctggcagtgcagccagaagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaagtgaggaagggaaactgtctacctctcaagatgctgcttgtaaagacgcagaggagtgtcccgagactgcagaggcgaagtgcgcggcgcccaggcctcccagcagcagtcccgagcagaggactggccaaccaagcgcaccaggtgacacttcagtgaatggccctgtatgacgggtgacgtctgctgctgctgactgaggactgcagaccgccaccactcaggggctctggaggggtcagctggagcccaccaagctgtcactgctgcactcactctgcaagggatcaggaccagcaacctttatattctagattctaagacattgtacagagaaattcagaagtgtaaaaatattgcacattgacaaataccaagaatttttgcgtatgtttatattgtattgttctaaataatgggtagcctgtgaaataagatcttgccacccatgtaataatagtagtaatactatagttaaaatggctgtaagaatagttttataaaagtgaatacacagatctattgtatttgaaacataactttgacaattattagtgtgaccaaagtattaggcggttttcatacatttttcaccttgtacaaaattatgaattcatttttcctccaggccgacaaggagttgtagaatgaaaatgccctctaagtgttattttggttgttctaacttacaaaagtgattttgaataagaaatatttggtgttctttttataaccagtttttgattggtaattgttttctgtattgtttaaaacggatcaaaaatgtaagtctattggtagagattaagtaaagtatttattgctacatcatagttgataaattgatgttatcgtaaagccatatgttctgttcaagtcttgtttgcttgaaatgattattcctacaagtgaaacactagactatttggagtgtatatggcttgtgttttgggattttttttttttttttttggcttttgtttttgtttgtttttttgtttcatttggtagttcatctgccttttaacccattcaccaaaatttaccttgttaacaagcatcaccaatgaacatttcagagcaatctgcatatttaacagacctaaaataaatcctattaggcaagtcagttgaaaatgctcgtgctgctaatggaattagagtgcgttcattttacaggctagtattttaaaagtagaaatcaaaatctggcaccgaagcatgctaattgtttactgtaccttgtgaggttttcactcataaatttaaaccagtgtatttttttagaactggtttgtgtatatatatagtgattatggatactaattcaatgtaatttataattttctatgtcaatacaaaaatacatcacagccttctcaaacagctcaagcaatatattgtatattgccatatcgtctggtgaaagggttaaattacttcacctcttgcacttttagatgcaaatcagtttttcatttctgtaatagaaaattattcacgtatttttacatcatttgtttttcctgaccagtatttaaaaccaaaaggatattctgaaaaatggccaacaatttttttagaagtagcatcccaagcagcgtgcctaaacattacattgcatatggaaataaaagaatcaaacgtctaatgccttattatttctgatttcctttttcattttaagtggtgtggagattccagcactcccaggacagtggagtcagcagtaagccctgggacaggtggcaagggtgggtcccttgacctttgcacgcctcctcaggaaccccctttcccgggtgagcccctctctgaagagactgtccttgggcctcctctggaagcagcacccccagaggacagggctcctcctgcttgcctcagggctgcctgacttgaatggcgttggacctcggggattactggtagataatatgctctggtctcgcctggtggtgagttttgccagccatggccagggtttggctccactggtggcacacgtggcctccgtggtatggacctggtggcttctccatcccactgtggcctctgtggtatggacctggtggcttctccatcctacccaaggtaacagtgtcttgcttcatcccactgactgctgggagagagcctctgggacttttctttggggcatcattttgttttgtctttcgtagcagggaaaggatatgacaatggggaggacagttcttttggaggttggaggggccaagccaaggacaggagcaagtgtgccctcattttgtttctacttttaatttctgtgtgttggccatactgaattatgagactaacagatgtctacaatacaatacctgtattcaaaataacaaaaataaagcctgattctttgtttctagaaa

SEQ ID NO: 171381 - DNA, 5069 bp, Homo sapiens
  Payload ID: 13706
  Gene Symbol: PPP6R3
  Gene Name: protein phosphatase 6, regulatory subunit 3
  Uniprot ID: Q5H9R7
  ENST ID: ENST00000393801
  CDS Start-End: 216-2855
gtcggtgagcgcgtttcccgcctgagcgcaactagcggcgggtcgtgggcacctccaggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaagaccagcatgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaagtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattggttaaatgaggagaaaattatccagaggcttgtggaaatagttcatccatcgcaagaagaagatcgacattcaaatgcatcacaatcactttgtgaaattgttcgcctgagcagagaccagatgttacaaattcagaacagtacagagcccgaccccctgcttgccactctagaaaagcaagaaattatagagcagcttctatcaaatattttccacaaggagaaaaatgagtcagccatagtcagtgcaatccagatattgctgactttacttgagacacgacgaccaacatttgaaggccatatagagatctgcccaccaggcatgagccattcagcttgttcagtaaacaagagtgttctagaagccatcagaggaagacttggatcttttcatgaactcctgctggagccacccaagaaaagtgtgatgaagaccacatggggtgtgctggatcctcctgtggggaatacccggttgaatgtcattaggttgatatccagcctgcttcaaaccaataccagcagtataaatggggaccttatggagctgaatagcattggagtcatattgaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaaatgaatgagaagaaacaggctgagggaggaagacggcatggttacatgggacacctaacgaggatagctaactgtatcgtgcacagcactgacaagggccccaacagtgcattagtgcagcagcttatcaaagatcttcccgacgaagtcagggaacgatgggagacgttctgcacaagctccttaggagaaactaacaagaggaacacggtagatctagttacaacctgccatattcattcatccagtgatgatgaaattgactttaaagaaacgggtttctcacaggattcttctttgcagcaagccttttctgattatcagatgcaacaaatgacgtccaattttattgaccagtttggcttcaacgatgagaagtttgcagatcaagatgacattggcaatgtttcttttgatcgagtatcagacatcaactttactctcaatacaaatgaaagtggaaatattgccttgtttgaagcatgttgtaaggaaagaatacaacagtttgatgatggtggctctgatgaggaagatatatgggaggaaaagcacatcgcattcacaccagaatcccaaagacgatccagctcggggagtacagacagtgaggaaagtacagactctgaagaagaagatggagcaaagcaagacttgtttgaacccagcagtgccaacacggaggataaaatggaggtggacctgagtgaaccacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgagcacaaaagattctttaaggagtaattctccagtggaaatggaaaccagcactgaacccatggaccctctgactcccagtgcggctgccctggcagtgcagccagaagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaagagtgttgaaatcctatcgtgaggaagggaaactgtctacctctcaagatgctgcttgtaaagacgcagaggagtgtcccgagactgcagaggcgaagtgcgcggcgcccaggcctcccagcagcagtcccgagcagaggactggccaaccaagcgcaccaggtgacacttcagtgaatggccctgtatgacgggtgacgtctgctgctgctgactgaggactgcagaccgccaccactcaggggctctggaggggtcagctggagcccaccaagctgtcactgctgcactcactctgcaagggatcaggaccagcaacctttatattctagattctaagacattgtacagagaaattcagaagtgtaaaaatattgcacattgacaaataccaagaatttttgcgtatgtttatattgtattgttctaaataatgggtagcctgtgaaataagatcttgccacccatgtaataatagtagtaatactatagttaaaatggctgtaagaatagttttataaaagtgaatacacagatctattgtatttgaaacataactttgacaattattagtgtgaccaaagtattaggcggttttcatacatttttcaccttgtacaaaattatgaattcatttttcctccaggccgacaaggagttgtagaatgaaaatgccctctaagtgttattttggttgttctaacttacaaaagtgattttgaataagaaatatttggtgttctttttataaccagtttttgattggtaattgttttctgtattgtttaaaacggatcaaaaatgtaagtctattggtagagattaagtaaagtatttattgctacatcatagttgataaattgatgttatcgtaaagccatatgttctgttcaagtcttgtttgcttgaaatgattattcctacaagtgaaacactagactatttggagtgtatatggcttgtgttttgggattttttttttttttttttggcttttgtttttgtttgtttttttgtttcatttggtagttcatctgccttttaacccattcaccaaaatttaccttgttaacaagcatcaccaatgaacatttcagagcaatctgcatatttaacagacctaaaataaatcctattaggcaagtcagttgaaaatgctcgtgctgctaatggaattagagtgcgttcattttacaggctagtattttaaaagtagaaatcaaaatctggcaccgaagcatgctaattgtttactgtaccttgtgaggttttcactcataaatttaaaccagtgtatttttttagaactggtttgtgtatatatatagtgattatggatactaattcaatgtaatttataattttctatgtcaatacaaaaatacatcacagccttctcaaacagctcaagcaatatattgtatattgccatatcgtctggtgaaagggttaaattacttcacctcttgcacttttagatgcaaatcagtttttcatttctgtaatagaaaattattcacgtatttttacatcatttgtttttcctgaccagtatttaaaaccaaaaggatattctgaaaaatggccaacaatttttttagaagtagcatcccaagcagcgtgcctaaacattacattgcatatggaaataaaagaatcaaacgtctaatgccttattatttctgatttcctttttcattttaagtggtgtggagattccagcactcccaggacagtggagtcagcagtaagccctgggacaggtggcaagggtgggtcccttgacctttgcacgcctcctcaggaaccccctttcccgggtgagcccctctctgaagagactgtccttgggcctcctctggaagcagcacccccagaggacagggctcctcctgcttgcctcagggctgcctgacttgaatggcgttggacctcggggattactggtagataatatgctctggtctcgcctggtggtgagttttgccagccatggccagggtttggctccactggtggcacacgtggcctccgtggtatggacctggtggcttctccatcccactgtggcctctgtggtatggacctggtggcttctccatcctacccaaggtaacagtgtcttgcttcatcccactgactgctgggagagagcctctgggacttttctttggggcatcattttgttttgtctttcgtagcagggaaaggatatgacaatggggaggacagttcttttggaggttggaggggccaagccaaggacaggagcaagtgtgccctcattttgtttctacttttaatttctgtgtgttggccatactgaattatgagactaacagatgtctacaatacaatacctgtattcaaaataacaaaaataaagcctgattctttgtttctag

SEQ ID NO: 171382 - DNA, 2771 bp, Homo sapiens
  Payload ID: 13706
  Gene Symbol: PPP6R3
  Gene Name: protein phosphatase 6, regulatory subunit 3
  Uniprot ID: Q5H9R7
  ENST ID: ENST00000524845
  CDS Start-End: 237-2771
tttgggcgcttcgctgatggtgtcggtgagcgcgtttcccgcctgagcgcaactagcggcgggtcgtgggcacctccaggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaagaccagcatgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaagtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattggttaaatgaggagaaaattatccagaggcttgtggaaatagttcatccatcgcaagaagaagatcgacattcaaatgcatcacaatcactttgtgaaattgttcgcctgagcagagaccagatgttacaaattcagaacagtacagagcccgaccccctgcttgccactctagaaaagcaagaaattatagagcagcttctatcaaatattttccacaaggagaaaaatgagtcagccatagtcagtgcaatccagatattgctgactttacttgagacacgacgaccaacatttgaaggccatatagagatctgcccaccaggcatgagccattcagcttgttcagtaaacaagagtgttctagaagccatcagaggaagacttggatcttttcatgaactcctgctggagccacccaagaaaagtgtgatgaagaccacatggggtgtgctggatcctcctgtggggaatacccggttgaatgtcattaggttgatatccagcctgcttcaaaccaataccagcagtataaatggggaccttatggagctgaatagcattggagtcatattgaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaaatgaatgagaagaaacaggctgagggaggaagacggcatggttacatgggacacctaacgaggatagctaactgtatcgtgcacagcactgacaagggccccaacagtgcattagtgcagcagcttatcaaagatcttcccgacgaagtcagggaacgatgggagacgttctgcacaagctccttaggagaaactaacaagaggaacacggtagatctagccttttctgattatcagatgcaacaaatgacgtccaattttattgaccagtttggcttcaacgatgagaagtttgcagatcaagatgacattggcaatgtttcttttgatcgagtatcagacatcaactttactctcaatacaaatgaaagtggaaatattgccttgtttgaagcatgttgtaaggaaagaatacaacagtttgatgatggtggctctgatgaggaagatatatgggaggaaaagcacatcgcattcacaccagaatcccaaagacgatccagctcggggagtacagacagtgaggaaagtacagactctgaagaagaagatggagcaaagcaagacttgtttgaacccagcagtgccaacacggaggataaaatggaggtggacctgagtgaaccacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgagcacaaaagattctttaaggagtaattctccagtggaaatggaaaccagcactgaacccatggaccctctgactcccagtgcggctgccctggcagtgcagccagaagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaagtgaggaagggaaactgtctacctctcaagatgctgcttgtaaagacgcagaggagtgtcccgagactgcagaggcgaagtgcgcggcgcccaggcctcccagcagcagtcccgagcagaggactggccaaccaagcgcaccaggtgacacttcagtgaatggccctgtatga

SEQ ID NO: 171383 - DNA, 826 bp, Homo sapiens
  Payload ID: 13706
  Gene Symbol: PPP6R3
  Gene Name: protein phosphatase 6, regulatory subunit 3
  ENST ID: ENST00000529907
  CDS Start-End: 406-826
attttgggcgcttcgctgatggtgtcggtgagcgcgtttcccgcctgagcgcaactagcggcgggtcgtgggcacctccagataagaaaacaagctcagagagatgtggtgacttgctcaaatagtgacagaacttcctcggccatatggaggggtcatataatacccttgtgtcttcagtttgaggtacctcccataattttaaggggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaaggtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattggttaaatgaggagaaaattatccagaggcttgtggaaatagttcatccatcgcaagaagaagatcgacattcaaatgcatcacaatcactttgtgaaattgttcgcctgagcagagaccagatgttacaaattcagaaca

SEQ ID NO: 171384 - DNA, 687 bp, Homo sapiens
  Payload ID: 13706
  Gene Symbol: PPP6R3
  Gene Name: protein phosphatase 6, regulatory subunit 3
  ENST ID: ENST00000531244
  CDS Start-End: 129-687
agagctttgtgctgaacatcagtcctccacatcgactcctcttgtaagatgttgtgtccaggtggatcatcacagtggctgccatccttaaatatgtcttggtcctgttgctgctaattgataccagcatgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaagtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattggttaa

SEQ ID NO: 171385 - DNA, 4292 bp, Homo sapiens
  Payload ID: 13706
  Gene Symbol: PPP6R3
  Gene Name: protein phosphatase 6, regulatory subunit 3
  Uniprot ID: Q5H9R7
  ENST ID: ENST00000524904
  CDS Start-End: 231-2834
cgcttcgctgatggtgtcggtgagcgcgtttcccgcctgagcgcaactagcggcgggtcgtgggcacctccaggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaagaccagcatgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaagtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattggttaaatgaggagaaaattatccagaggcttgtggaaatagttcatccatcgcaagaagaagatcgacattcaaatgcatcacaatcactttgtgaaattgttcgcctgagcagagaccagatgttacaaattcagaacagtacagagcccgaccccctgcttgccactctagaaaagcaagaaattatagagcagcttctatcaaatattttccacaaggagaaaaatgagtcagccatagtcagtgcaatccagatattgctgactttacttgagacacgacgaccaacatttgaaggccatatagagatctgcccaccaggcatgagccattcagcttgttcagtaaacaagagtgttctagaagccatcagaggaagacttggatcttttcatgaactcctgctggagccacccaagaaaagtgtgatgaagaccacatggggtgtgctggatcctcctgtggggaatacccggttgaatgtcattaggttgatatccagcctgcttcaaaccaataccagcagtataaatggggaccttatggagctgaatagcattggagtcatattgaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaaatgaatgagaagaaacaggctgagggaggaagacggcatggttacatgggacacctaacgaggatagctaactgtatcgtgcacagcactgacaagggccccaacagtgcattagtgcagcagcttatcaaagatcttcccgacgaagtcagggaacgatgggagacgttctgcacaagctccttaggagaaactaacaagaggaacacggtagatctagttacaacctgccatattcattcatccagtgatgatgaaattgactttaaagaaacgggtttctcacaggattcttctttgcagcaaatgcaacaaatgacgtccaattttattgaccagtttggcttcaacgatgagaagtttgcagatcaagatgacattggcaatgtttcttttgatcgagtatcagacatcaactttactctcaatacaaatgaaagtggaaatattgccttgtttgaagcatgttgtaaggaaagaatacaacagtttgatgatggtggctctgatgaggaagatatatgggaggaaaagcacatcgcattcacaccagaatcccaaagacgatccagctcggggagtacagacagtgaggaaagtacagactctgaagaagaagatggagcaaagcaagacttgtttgaacccagcagtgccaacacggaggataaaatggaggtggacctgagtgaaccacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgagcacaaaagattctttaaggagtaattctccagtggaaatggaaaccagcactgaacccatggaccctctgactcccagtgcggctgccctggcagtgcagccagaagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaagtgaggaagggaaactgtctacctctcaagatgctgcttgtaaagacgcagaggagtgtcccgagactgcagaggcgaagtgcgcggcgcccaggcctcccagcagcagtcccgagcagaggactggccaaccaagcgcaccaggtgacacttcagtgaatggccctgtatgacgggtgacgtctgctgctgctgactgaggactgcagaccgccaccactcaggggctctggaggggtcagctggagcccaccaagctgtcactgctgcactcactctgcaagggatcaggaccagcaacctttatattctagattctaagacattgtacagagaaattcagaagtgtaaaaatattgcacattgacaaataccaagaatttttgcgtatgtttatattgtattgttctaaataatgggtagcctgtgaaataagatcttgccacccatgtaataatagtagtaatactatagttaaaatggctgtaagaatagttttataaaagtgaatacacagatctattgtatttgaaacataactttgacaattattagtgtgaccaaagtattaggcggttttcatacatttttcaccttgtacaaaattatgaattcatttttcctccaggccgacaaggagttgtagaatgaaaatgccctctaagtgttattttggttgttctaacttacaaaagtgattttgaataagaaatatttggtgttctttttataaccagtttttgattggtaattgttttctgtattgtttaaaacggatcaaaaatgtaagtctattggtagagattaagtaaagtatttattgctacatcatagttgataaattgatgttatcgtaaagccatatgttctgttcaagtcttgtttgcttgaaatgattattcctacaagtgaaacactagactatttggagtgtatatggcttgtgttttgggattttttttttttttttttggcttttgtttttgtttgtttttttgtttcatttggtagttcatctgccttttaacccattcaccaaaatttaccttgttaacaagcatcaccaatgaacatttcagagcaatctgcatatttaacagacctaaaataaatcctattaggcaagtcagttgaaaatgctcgtgctgctaatggaattagagtgcgttcattttacaggctagtattttaaaagtagaaatcaaaatctggcaccgaagcatgctaattgtttactgtaccttgtgaggttttcactcataaatttaaaccagtgtatttttttagaactggtttgtgtatatatatagtgattatggatactaattcaatgtaatttataattttctatgtcaatacaaaaatacatcacagccttctcaaacagctcaagcaatatattgtatattgccatatcgtctggtgaaagggttaaattacttcacctcttgcacttttagatgcaaatcagtttttcatttctgtaatagaaaattattcacgtatttttacatcatttgtttttcctgaccagtatttaaaaccaaaaggatattctgaaaaatggccaacaatttttttagaagtagcatcccaagcagcgtgcctaaacattacattgcatatggaaa

SEQ ID NO: 171386 - DNA, 603 bp, Homo sapiens
  Payload ID: 13706
  Gene Symbol: PPP6R3
  Gene Name: protein phosphatase 6, regulatory subunit 3
  ENST ID: ENST00000529344
  CDS Start-End: 377-603
ttttgggcgcttcgctgatggtgtcggtgagcgcgtttcccgcctgagcgcaactagcggcgggtcgtgggcacctccaggctcagaaggaaagaaaacatctcccaggaccagatgtggagtagatgggagttggagagaagctgaagcccaggcccagcaacaggctgggggcccaggtgcttcgggggtcccagccattaacagagcttcgtgcaggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaagaccagcatgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaa

SEQ ID NO: 171387 - DNA, 4862 bp, Homo sapiens
  Payload ID: 13706
  Gene Symbol: PPP6R3
  Gene Name: protein phosphatase 6, regulatory subunit 3
  ENST ID: ENST00000527403
  CDS Start-End: 153-2669
cttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaagaccagcatgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaagtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattggttaaatgaggagaaaattatccagaggcttgtggaaatagttcatccatcgcaagaagaagatcgacattcaaatgcatcacaatcactttgtgaaattgttcgcctgagcagagaccagatgttacaaattcagaacagtacagagcccgaccccctgcttgccactctagaaaagcaagaaattatagagcagcttctatcaaatattttccacaaggagaaaaatgagtcagccatagtcagtgcaatccagatattgctgactttacttgagacacgacgaccaacatttgaaggccatatagagatctgcccaccaggcatgagccattcagcttgttcagtaaacaagagtgttctagaagccatcagaggaagacttggatcttttcatgaactcctgctggagccacccaagaaaagtgtgatgaagaccacatggggtgtgctggatcctcctgtggggaatacccggttgaatgtcattaggttgatatccagcctgcttcaaaccaataccagcagtataaatggggaccttatggagctgaatagcattggagtcatattgaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaaatgaatgagaagaaacaggctgagggaggaagacggcatggttacatgggacacctaacgaggatagctaactgtatcgtgcacagcactgacaagggccccaacagtgcattagtgcagcagcttatcaaagatcttcccgacgaagtcagggaacgatgggagacgttctgcacaagctccttaggagaaactaacaagaggaacacggtagatctaatgcaacaaatgacgtccaattttattgaccagtttggcttcaacgatgagaagtttgcagatcaagatgacattggcaatgtttcttttgatcgagtatcagacatcaactttactctcaatacaaatgaaagtggaaatattgccttgtttgaagcatgttgtaaggaaagaatacaacagtttgatgatggtggctctgatgaggaagatatatgggaggaaaagcacatcgcattcacaccagaatcccaaagacgatccagctcggggagtacagacagtgaggaaagtacagactctgaagaagaagatggagcaaagcaagacttgtttgaacccagcagtgccaacacggaggataaaatggaggtggacctgagtgaaccacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgagcacaaaagattctttaaggagtaattctccagtggaaatggaaaccagcactgaacccatggaccctctgactcccagtgcggctgccctggcagtgcagccagaagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaagtgaggaagggaaactgtctacctctcaagatgctgcttgtaaagacgcagaggagtgtcccgagactgcagaggcgaagtgcgcggcgcccaggcctcccagcagcagtcccgagcagaggactggccaaccaagcgcaccaggtgacacttcagtgaatggccctgtatgacgggtgacgtctgctgctgctgactgaggactgcagaccgccaccactcaggggctctggaggggtcagctggagcccaccaagctgtcactgctgcactcactctgcaagggatcaggaccagcaacctttatattctagattctaagacattgtacagagaaattcagaagtgtaaaaatattgcacattgacaaataccaagaatttttgcgtatgtttatattgtattgttctaaataatgggtagcctgtgaaataagatcttgccacccatgtaataatagtagtaatactatagttaaaatggctgtaagaatagttttataaaagtgaatacacagatctattgtatttgaaacataactttgacaattattagtgtgaccaaagtattaggcggttttcatacatttttcaccttgtacaaaattatgaattcatttttcctccaggccgacaaggagttgtagaatgaaaatgccctctaagtgttattttggttgttctaacttacaaaagtgattttgaataagaaatatttggtgttctttttataaccagtttttgattggtaattgttttctgtattgtttaaaacggatcaaaaatgtaagtctattggtagagattaagtaaagtatttattgctacatcatagttgataaattgatgttatcgtaaagccatatgttctgttcaagtcttgtttgcttgaaatgattattcctacaagtgaaacactagactatttggagtgtatatggcttgtgttttgggattttttttttttttttttggcttttgtttttgtttgtttttttgtttcatttggtagttcatctgccttttaacccattcaccaaaatttaccttgttaacaagcatcaccaatgaacatttcagagcaatctgcatatttaacagacctaaaataaatcctattaggcaagtcagttgaaaatgctcgtgctgctaatggaattagagtgcgttcattttacaggctagtattttaaaagtagaaatcaaaatctggcaccgaagcatgctaattgtttactgtaccttgtgaggttttcactcataaatttaaaccagtgtatttttttagaactggtttgtgtatatatatagtgattatggatactaattcaatgtaatttataattttctatgtcaatacaaaaatacatcacagccttctcaaacagctcaagcaatatattgtatattgccatatcgtctggtgaaagggttaaattacttcacctcttgcacttttagatgcaaatcagtttttcatttctgtaatagaaaattattcacgtatttttacatcatttgtttttcctgaccagtatttaaaaccaaaaggatattctgaaaaatggccaacaatttttttagaagtagcatcccaagcagcgtgcctaaacattacattgcatatggaaataaaagaatcaaacgtctaatgccttattatttctgatttcctttttcattttaagtggtgtggagattccagcactcccaggacagtggagtcagcagtaagccctgggacaggtggcaagggtgggtcccttgacctttgcacgcctcctcaggaaccccctttcccgggtgagcccctctctgaagagactgtccttgggcctcctctggaagcagcacccccagaggacagggctcctcctgcttgcctcagggctgcctgacttgaatggcgttggacctcggggattactggtagataatatgctctggtctcgcctggtggtgagttttgccagccatggccagggtttggctccactggtggcacacgtggcctccgtggtatggacctggtggcttctccatcccactgtggcctctgtggtatggacctggtggcttctccatcctacccaaggtaacagtgtcttgcttcatcccactgactgctgggagagagcctctgggacttttctttggggcatcattttgttttgtctttcgtagcagggaaaggatatgacaatggggaggacagttcttttggaggttggaggggccaagccaaggacaggagcaagtgtgccctcattttgtttctacttttaatttctgtgtgttggccatactgaattatgagactaacagatgtctacaatacaatacctgtattcaaaataacaaaaataa

SEQ ID NO: 171388 - DNA, 551 bp, Homo sapiens
  Payload ID: 13706
  Gene Symbol: PPP6R3
  Gene Name: protein phosphatase 6, regulatory subunit 3
  ENST ID: ENST00000533127
  CDS Start-End: 435-551
attttgggcgcttcgctgatggtgtcggtgagcgcgtttcccgcctgagcgcaactagcggcgggtcgtgggcacctccaggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaagaaaaatttcgttctttgccctgtgctcagaagatcacaataaaacttcaccacatcaagctgctgtgggatagggcaaaccgggatggttaagtccatgagtgcatgaagtttactgttggtgctactggttcagtaacaggtgatggatttcaaaagtctccagatgcctgctggcgaataatcaaagaataactaccagcatgttttggaaatttgatcttcactcatcatcccacatagacacacttctagaaagagaagatgtaacactgaaggagttaatggatgaggaagatgttttacaggaatgtaaagct

SEQ ID NO: 171389 - DNA, 576 bp, Homo sapiens
  Payload ID: 13706
  Gene Symbol: PPP6R3
  Gene Name: protein phosphatase 6, regulatory subunit 3
  ENST ID: ENST00000530734
  CDS Start-End: 1-155
cagaggagtgtcccgagactgcagaggcgaagtgcgcggcgcccaggcctcccagcagcagtcccgagcagagtgcctccgatgcctgtctgttgctccttaggactggccaaccaagcgcaccaggtgacacttcagtgaatggccctgtatgacgggtgacgtctgctgctgctgactgaggactgcagaccgccaccactcaggggctctggaggggtcagctggagcccaccaagctgtcactgctgcactcactctgcaagggatcaggaccagcaacctttatattctagattctaagacattgtacagagaaattcagaagtgtaaaaatattgcacattgacaaataccaagaatttttgcgtatgtttatattgtattgttctaaataatgggtagcctgtgaaataagatcttgccacccatgtaataatagtagtaatactatagttaaaatggctgtaagaatagttttataaaagtgaatacacagatctattgtatttgaaacataactttgacaattattagtgtgaccaaagtattaggcggttttcatacatttttcac

SEQ ID NO: 171390 - DNA, 830 bp, Homo sapiens
  Payload ID: 13706
  Gene Symbol: PPP6R3
  Gene Name: protein phosphatase 6, regulatory subunit 3
  ENST ID: ENST00000525421
  CDS Start-End: 1-337
gaaacaggctgagggaggaagacggcatggttacatgggacacctaacgaggatagctaactgtatcgtgcacagcactgacaagggccccaacagtgcattagtgcagcagcttatcaaagatcttcccgacgaagtcagggaacgatgggagacgttctgcacaagctccttaggagaaactaacaagaggaacacggtagatctagttacaacctgccatattcattcatccagtgatgatgaaattgactttaaagaaacgggtttctcacaggattcttctttgcagcaaaaaaacacaccaacttttatagccctatggctatgtaaataagatgatttctggaacacaaatgggcaaatagtatgtagaatatcattagaatcattatatcactgtcactggtcctggggttgccaggccttttctgattatcagatgcaacaaatgacgtccaattttattgaccagtttggcttcaacgatgagaagtttgcagatcaagatgacattggcaatgtttcttttgatcgagtatcagacatcaactttactctcaatacaaatgaaagtggaaatattgccttgtttgaagcatgttgtaaggaaagaatacaacagtttgatgatggtggctctgatgaggaagatatatgggaggaaaagcacatcgcattcacaccagaatcccaaagacgatccagctcggggagtacagacagtgaggaaagtacagactctgaagaagaagatggagcaaagcaagacttgtttgaacccagcagtgccaacacggaggataaaatggaggtggacctgagtgaac

SEQ ID NO: 171391 - DNA, 2968 bp, Homo sapiens
  Payload ID: 13706
  Gene Symbol: PPP6R3
  Gene Name: protein phosphatase 6, regulatory subunit 3
  ENST ID: ENST00000534534
  CDS Start-End: 278-2203
ttttgggcgcttcgctgatggtgtcggtgagcgcgtttcccgcctgagcgcaactagcggcgggtcgtgggcacctccaggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaaggtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaataaaagtgtgatgaagaccacatggggtgtgctggatcctcctgtggggaatacccggttgaatgtcattaggttgatatccagcctgcttcaaaccaataccagcagtataaatggggaccttatggagctgaatagcattggagtcatattgaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaaatgaatgagaagaaacaggctgagggaggaagacggcatggttacatgggacacctaacgaggatagctaactgtatcgtgcacagcactgacaagggccccaacagtgcattagtgcagcagcttatcaaagatcttcccgacgaagtcagggaacgatgggagacgttctgcacaagctccttaggagaaactaacaagaggaacacggtagatctagttacaacctgccatattcattcatccagtgatgatgaaattgactttaaagaaacgggtttctcacaggattcttctttgcagcaagccttttctgattatcagatgcaacaaatgacgtccaattttattgaccagtttggcttcaacgatgagaagtttgcagatcaagatgacattggcaatgtttcttttgatcgagtatcagacatcaactttactctcaatacaaatgaaagtggaaatattgccttgtttgaagcatgttgtaaggaaagaatacaacagtttgatgatggtggctctgatgaggaagatatatgggaggaaaagcacatcgcattcacaccagaatcccaaagacgatccagctcggggagtacagacagtgaggaaagtacagactctgaagaagaagatggagcaaagcaagacttgtttgaacccagcagtgccaacacggaggataaaatggaggtggacctgagtgaaccacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgagcacaaaagattctttaaggagtaattctccagtggaaatggaaaccagcactgaacccatggaccctctgactcccagtgcggctgccctggcagtgcagccagaagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaagtgaggaagggaaactgtctacctctcaagatgctgcttgtaaagacgcagaggagtgtcccgagactgcagaggcgaagtgcgcggcgcccaggcctcccagcagcagtcccgagcagaggactggccaaccaagcgcaccaggtgacacttcagtgaatggccctgtatgacgggtgacgtctgctgctgctgactgaggactgcagaccgccaccactcaggggctctggaggggtcagctggagcccaccaagctgtcactgctgcactcactctgcaagggatcaggaccagcaacctttatattctagattctaagacattgtacagagaaattcagaagtgtaaaaatattgcacattgacaaataccaagaatttttgcgtatgtttatattgtattgttctaaataatgggtagcctgtgaaataagatcttgccacccatgtaataatagtagtaatactatagttaaaatggctgtaagaatagttttataaaagtgaatacacagatctattgtatttgaaacataactttgacaattattagtgtgaccaaagtattaggcggttttcatacatttttcaccttgtacaaaattatgaattcatttttcctccaggccgacaaggagttgtagaatgaaaatgccctctaagtgttattttggttgttctaacttacaaaagtgattttgaataagaaatatttggtgttctttttataaccagtttttgattggtaattgttttctgtattgtttaaaacggatcaaaaatgtaagtctattggtagagattaagtaaagtatttattgctacatcatagttgataaattgatgttatcgtaaagccatatgttctgttcaagtcttgtttgcttgaaatgattattcctacaagtgaaacactagactatttggagtgtatat

SEQ ID NO: 171392 - DNA, 1980 bp, Homo sapiens
  Payload ID: 13706
  Gene Symbol: PPP6R3
  Gene Name: protein phosphatase 6, regulatory subunit 3
  ENST ID: ENST00000534190
  CDS Start-End: 1-1743
cagatattgctgactttacttgagacacgacgaccaacatttgaaggccatatagagatctgcccaccaggcatgagccattcagcttgttcagtaaacaagagtgttctagaagccatcagaggaagacttggatcttttcatgaactcctgctggagccacccaagctttttcttcttcagaaaagtgtgatgaagaccacatggggtgtgctggatcctcctgtggggaatacccggttgaatgtcattaggttgatatccagcctgcttcaaaccaataccagcagtataaatggggaccttatggagctgaatagcattggagtcatattgaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaaatgaatgagaagaaacaggctgagggaggaagacggcatggttacatgggacacctaacgaggatagctaactgtatcgtgcacagcactgacaagggccccaacagtgcattagtgcagcagcttatcaaagatcttcccgacgaagtcagggaacgatgggagacgttctgcacaagctccttaggagaaactaacaagaggaacacggtagatctagccttttctgattatcagatgcaacaaatgacgtccaattttattgaccagtttggcttcaacgatgagaagtttgcagatcaagatgacattggcaatgtttcttttgatcgagtatcagacatcaactttactctcaatacaaatgaaagtggaaatattgccttgtttgaagcatgttgtaaggaaagaatacaacagtttgatgatggtggctctgatgaggaagatatatgggaggaaaagcacatcgcattcacaccagaatcccaaagacgatccagctcggggagtacagacagtgaggaaagtacagactctgaagaagaagatggagcaaagcaagacttgtttgaacccagcagtgccaacacggaggataaaatggaggtggacctgagtgaaccacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgagcacaaaagattctttaaggagtaattctccagtggaaatggaaaccagcactgaacccatggaccctctgactcccagtgcggctgccctggcagtgcagccagaagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaagtgaggaagggaaactgtctacctctcaagatgctgcttgtaaagacgcagaggagtgtcccgagactgcagaggcgaagtgcgcggcgcccaggcctcccagcagcagtcccgagcagaggactggccaaccaagcgcaccaggtgacacttcagtgaatggccctgtatgacgggtgacgtctgctgctgctgactgaggactgcagaccgccaccactcaggggctctggaggggtcagctggagcccaccaagctgtcactgctgcactcactctgcaagggatcaggaccagcaacctttatattctagattctaagacattgtacagagaaattcagaagtgtaaaaatattgcacattgacaaataccaagaatttttgcgtatgtttatattgtattgttct

SEQ ID NO: 171393 - DNA, 570 bp, Homo sapiens
  Payload ID: 13706
  Gene Symbol: PPP6R3
  Gene Name: protein phosphatase 6, regulatory subunit 3
  ENST ID: ENST00000526593
  CDS Start-End: 1-329
attctccagtggaaatggaaaccagcactgaacccatggaccctctgactcccagtgcggctgccctggcagtgcagccagaagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaaggttctttgacaccttcaccgagtctgcagttttgcttacgtgcagtcgtggacatattattcccccaaattcctcatttctaggagtattctgaaactcttgtacatttctttttctgttttgcacactgggcttcagagtgttgaaatcctatcgtgaggaagggaaactgtctacctctcaagatgctgcttgtaaagacgcagaggagtgtcccgagactgcagaggcgaagtgcgcggcgcccaggcctcccagcagcagtcccgagcagaggactggccaaccaagcgcaccaggtgacacttcagtgaatggccctgtatgacgggtga

SEQ ID NO: 171394 - DNA, 538 bp, Homo sapiens
  Payload ID: 13706
  Gene Symbol: PPP6R3
  Gene Name: protein phosphatase 6, regulatory subunit 3
  ENST ID: ENST00000528635
  CDS Start-End: 514-538
acgtccgccattttgggcgcttcgctgatggtgtcggtgagcgcgtttcccgcctgagcgcaactagcggcgggtcgtgggcacctccagataagaaaacaagctcagagagatgtggtgacttgctcaaatagtgacagaacttcctcggccatatggaggggtcatataatacccttgtgtcttcagtttgaggtacctcccataattttaaggggctcagaaggaaagaaaacatctcccaggaccagatgtggagtagatgggagttggagagaagctgaagcccaggcccagcaacaggctgggggcccaggtgcttcgggggtcccagccattaacagagcttcgtgcaggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaagaccagcatgttttggaaatttgatcttcact

SEQ ID NO: 171395 - DNA, 3228 bp, Homo sapiens
  Payload ID: 13706
  Gene Symbol: PPP6R3
  Gene Name: protein phosphatase 6, regulatory subunit 3
  Uniprot ID: Q5H9R7
  ENST ID: ENST00000529710
  CDS Start-End: 278-2653
cgtgggcacctccagataagaaaacaagctcagagagatgtggtgacttgctcaaatagtgacagaacttcctcggccatatggaggggtcatataatacccttgtgtcttcagtttgaggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaagaccagcatgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaagtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattggttaaatgaggagaaaattatccagaggcttgtggaaatagttcatccatcgcaagaagaagatcgacattcaaatgcatcacaatcactttgtgaaattgttcgcctgagcagagaccagatgttacaaattcagaacagtacagagcccgaccccctgcttgccactctagaaaagcaagaaattatagagcagcttctatcaaatattttccacaaggagaaaaatgagtcagccatagtcagtgcaatccagatattgctgactttacttgagacacgacgaccaacatttgaaggccatatagagatctgcccaccaggcatgagccattcagcttgttcagtaaacaagagtgttctagaagccatcagaggaagacttggatcttttcatgaactcctgctggagccacccaagaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaaatgaatgagaagaaacaggctgagggaggaagacggcatggttacatgggacacctaacgaggatagctaactgtatcgtgcacagcactgacaagggccccaacagtgcattagtgcagcagcttatcaaagatcttcccgacgaagtcagggaacgatgggagacgttctgcacaagctccttaggagaaactaacaagaggaacacggtagatctagccttttctgattatcagatgcaacaaatgacgtccaattttattgaccagtttggcttcaacgatgagaagtttgcagatcaagatgacattggcaatgtttcttttgatcgagtatcagacatcaactttactctcaatacaaatgaaagtggaaatattgccttgtttgaagcatgttgtaaggaaagaatacaacagtttgatgatggtggctctgatgaggaagatatatgggaggaaaagcacatcgcattcacaccagaatcccaaagacgatccagctcggggagtacagacagtgaggaaagtacagactctgaagaagaagatggagcaaagcaagacttgtttgaacccagcagtgccaacacggaggataaaatggaggtggacctgagtgaaccacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgagcacaaaagattctttaaggagtaattctccagtggaaatggaaaccagcactgaacccatggaccctctgactcccagtgcggctgccctggcagtgcagccagaagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaagtgaggaagggaaactgtctacctctcaagatgctgcttgtaaagacgcagaggagtgtcccgagactgcagaggcgaagtgcgcggcgcccaggcctcccagcagcagtcccgagcagagtggtgtggagattccagcactcccaggacagtggagtcagcagtaagccctgggacaggtggcaagggtgggtcccttgacctttgcacgcctcctcaggaaccccctttcccgggtgagcccctctctgaagagactgtccttgggcctcctctggaagcagcacccccagaggacagggctcctcctgcttgcctcagggctgcctgacttgaatggcgttggacctcggggattactggtagataatatgctctggtctcgcctggtggtgagttttgccagccatggccagggtttggctccactggtggcacacgtggcctccgtggtatggacctggtggcttctccatcccactgtggcctctgtggtatggacctggtggcttctccatcctacccaaggtaacagtgtcttgcttcatcccactgactgctgggagagagcctctgggacttttctttggggcatcattttgttttgtctttcgtagcagggaaaggatatgacaatggggaggacagttcttttggaggttggaggggccaagccaaggacaggagcaagtgtgccctcattttgtttctacttttaatttctgtgtgttggccatactga

SEQ ID NO: 171396 - DNA, 2677 bp, Homo sapiens
  Payload ID: 13707
  Gene Symbol: PPME1
  Gene Name: protein phosphatase methylesterase 1
  Uniprot ID: Q9Y570
  ENST ID: ENST00000328257
  CDS Start-End: 324-1484
attgcgcagggtgcattgccctgaagagcgctcctccttccggtgaaagtcgtcgggttcccagccgggagtctgcggagttctcatactctgttacccagcttcctttgtatgagtgctgttgcgcacttccggtggaagcgctgaagcgagtgggtggagtttacggagccggtgggcggtaggcggtgctacgggtagctgggtgctgtccaaaggcgacagggcgtcgttaggggagcgagtcgtgaccggttgggccacactcaacgtgggacgaagcttcgcctactgtttgactacgtgcgtgcagcctcccctcgatgtcggccctcgaaaagagcatgcacctcggccgccttccctctcgcccacctctacccggcagcgggggcagtcagagcggagccaagatgcgaatgggccctggaagaaagcgggacttttcccctgttccttggagtcagtattttgagtccatggaagatgtagaagtagagaatgaaactggcaaggatacttttcgagtctacaagagtggttcagagggtccagtcctgctccttctgcatggaggaggtcattctgccctttcttgggctgtgttcacggcagcgattattagtagagttcagtgtaggattgtagctttggatctgcgaagtcatggtgaaacaaaggtcaagaatcctgaagatctgtctgcagaaacaatggcaaaagacgttggcaatgtggttgaagccatgtatggggaccttcctcctccaattatgctgattggacatagcatgggtggtgctattgcagtccacacagcatcatccaacctggtaccaagcctcttgggtctgtgcatgattgatgttgtagaaggtacagctatggatgcacttaatagcatgcagaatttcttacggggtcgtcctaaaaccttcaagtctctggagaatgctattgaatggagtgtgaagagtggccagattcgaaatctggagtctgcccgtgtctcaatggttggccaagtcaaacagtgtgaaggaattacaagtccagaaggctcaaaatctatagtggaaggaatcatagaggaagaagaagaagatgaggaaggaagtgagtctataagcaagaggaaaaaggaagatgacatggagaccaagaaagaccatccatacacctggagaattgaactggcaaaaacagaaaaatactgggacggctggttccgaggcttatccaatctctttcttagttgtcccattcctaaattgctgctcttggctggtgttgatagattggataaagatctgaccattggccagatgcaagggaagttccagatgcaggtcctaccccagtgtggccatgcagtccatgaggatgcccctgacaaggtagctgaagctgttgccactttcctgatccggcacaggtttgcagaacccatcggtggattccagtgtgtgtttcctggctgttagtgacctgctgtccacccctcctcaacatcgagctctgttgtaaatacgtcgcaccagaggccactgtgatgccactgtctcctctccatcccgcccagccatgtgacactggctcccggtagacgggcaccccgagatgtaccaaccttttcatgtattctgccaaaagcattgttttccagggcccttgaccaacatcggcttccccagtccagggctcccctgctcctttcccttccctgtactggggtagctcctgcctgctctccctgcgttgcctagggtaaagcctccagatttgccatactgagcccctcttcctagcatcaggcgatacatctgagttcaaatgtcttcccaggctcagggacctccattccttgagattgtcttggcatggcccagccctgcctcatgggatggacaatgcatggggtggtctttatttttccctttcaaataaaacactagtcaggtaccgttttatcccagtcgtactcttccaggtttggaagacccagagaggccaagatcccatccttagccatagcgagcggtggtggtggatagcatcacaagaaacgagcctgaaaatcaggtccagccggtccaagcacatggcctcccatctgggagagcccactgtcccactcccacatgtctgggcacctgccctgggctgaggccaggctgctccaggggcctcctgcgccctcacctgccacagagcaacccaggttaaatacagcccatgcacaaagccacaggccaaagcctatggaattgtttttaatcatcaaatttaaccattttcataactggttcctggaggtgtgcagtgcccccttgcctcttcaaacctacagcttctctttgccatttgtggatttcacatcactccacacagaaacattacagcctggcatccccagtctttgccttcttccagctgcctcgacacagcactgtggcctgtccctattgcccaggcacgccatttccaagggcaggaaggggcagtgtcctgaagcccatcttttctgtgactgtcttaggtgatgtgtagccccctccacctttccactcaacaacctcccacccctgtcctgctgcatggtccggagtctgggacctactttgttttttgttatttatgaccttgtttaaagaaaataaatatctcccaaccttta

SEQ ID NO: 171397 - DNA, 2496 bp, Homo sapiens
  Payload ID: 13707
  Gene Symbol: PPME1
  Gene Name: protein phosphatase methylesterase 1
  Uniprot ID: Q9Y570
  ENST ID: ENST00000398427
  CDS Start-End: 101-1303
agggcgtcgttaggggagcgagtcgtgaccggttgggccacactcaacgtgggacgaagcttcgcctactgtttgactacgtgcgtgcagcctcccctcgatgtcggccctcgaaaagagcatgcacctcggccgccttccctctcgcccacctctacccggcagcgggggcagtcagagcggagccaagatgcgaatgggccctggaagaaagcgggacttttcccctgttccttggagtcagtattttgagtccatggaagatgtagaagtagagaatgaaactggcaaggatacttttcgagtctacaagagtggttcagagggtccagtcctgctccttctgcatggaggaggtcattctgccctttcttgggctgtgttcacggcagcgattattagtagagttcagtgtaggattgtagctttggatctgcgaagtcatggtgaaacaaaggtcaagaatcctgaagatctgtctgcagaaacaatggcaaaagacgttggcaatgtggttgaagccatgtatggggaccttcctcctccaattatgctgattggacatagcatgggtggtgctattgcagtccacacagcatcatccaacctggtaccaagcctcttgggtctgtgcatgattgatgttgtagaaggtacagctatggatgcacttaatagcatgcagaatttcttacggggtcgtcctaaaaccttcaagtctctggagaatgctattgaatggagtgtgaagagtggccagattcgaaatctggagtctgcccgtgtctcaatggttggccaagtcaaacagtgtgaaggaattacaagtccagaaggctcaaaatctatagtggaaggaatcatagaggaagaagaagaagatgaggaaggaagtgagtctataagcaagaggaaaaaggaagatgacatggaggggttgccctcggagactcagaacttgctcttattcctccagaccaagaaagaccatccatacacctggagaattgaactggcaaaaacagaaaaatactgggacggctggttccgaggcttatccaatctctttcttagttgtcccattcctaaattgctgctcttggctggtgttgatagattggataaagatctgaccattggccagatgcaagggaagttccagatgcaggtcctaccccagtgtggccatgcagtccatgaggatgcccctgacaaggtagctgaagctgttgccactttcctgatccggcacaggtttgcagaacccatcggtggattccagtgtgtgtttcctggctgttagtgacctgctgtccacccctcctcaacatcgagctctgttgtaaatacgtcgcaccagaggccactgtgatgccactgtctcctctccatcccgcccagccatgtgacactggctcccggtagacgggcaccccgagatgtaccaaccttttcatgtattctgccaaaagcattgttttccagggcccttgaccaacatcggcttccccagtccagggctcccctgctcctttcccttccctgtactggggtagctcctgcctgctctccctgcgttgcctagggtaaagcctccagatttgccatactgagcccctcttcctagcatcaggcgatacatctgagttcaaatgtcttcccaggctcagggacctccattccttgagattgtcttggcatggcccagccctgcctcatgggatggacaatgcatggggtggtctttatttttccctttcaaataaaacactagtcaggtaccgttttatcccagtcgtactcttccaggtttggaagacccagagaggccaagatcccatccttagccatagcgagcggtggtggtggatagcatcacaagaaacgagcctgaaaatcaggtccagccggtccaagcacatggcctcccatctgggagagcccactgtcccactcccacatgtctgggcacctgccctgggctgaggccaggctgctccaggggcctcctgcgccctcacctgccacagagcaacccaggttaaatacagcccatgcacaaagccacaggccaaagcctatggaattgtttttaatcatcaaatttaaccattttcataactggttcctggaggtgtgcagtgcccccttgcctcttcaaacctacagcttctctttgccatttgtggatttcacatcactccacacagaaacattacagcctggcatccccagtctttgccttcttccagctgcctcgacacagcactgtggcctgtccctattgcccaggcacgccatttccaagggcaggaaggggcagtgtcctgaagcccatcttttctgtgactgtcttaggtgatgtgtagccccctccacctttccactcaacaacctcccacccctgtcctgctgcatggtccggagtctgggacctactttgttttttgttatttatgaccttgtttaaagaaaataaatatctcccaaccttta

SEQ ID NO: 171398 - DNA, 1584 bp, Homo sapiens
  Payload ID: 13707
  Gene Symbol: PPME1
  Gene Name: protein phosphatase methylesterase 1
  ENST ID: ENST00000617237
  CDS Start-End: 1051-1458
gaagaagaagaagatgaggaaggaagtgagtctataagcaagaggaaaaaggaagatgacatggagaccaagaaagaccatccatacacctggagaattgaactggcaaaaacagaaaaatactgggacggctggttccgaggcttatccaatctctttcttagttgtcccattcctaaattgctgctcttggctggtgttgatagattggataaagatctgaccattggccagatgcaagggaagttccagatgcaggtcctaccccagtgtggccatgcagtccatgaggatgcccctgacaaggtagctgaagctgttgccactttcctgatccggcacaggtttgcagaacccatcggtggattccagtgtgtgtttcctggctgttagtgacctgctgtccacccctcctcaacatcgagctctgttgtaaatacgtcgcaccagaggccactgtgatgccactgtctcctctccatcccgcccagccatgtgacactggctcccggtagacgggcaccccgagatgtaccaaccttttcatgtattctgccaaaagcattgttttccagggcccttgaccaacatcggcttccccagtccagggctcccctgctcctttcccttccctgtactggggtagctcctgcctgctctccctgcgttgcctagggtaaagcctccagatttgccatactgagcccctcttcctagcatcaggcgatacatctgagttcaaatgtcttcccaggctcagggacctccattccttgagattgtcttggcatggcccagccctgcctcatgggatggacaatgcatggggtggtctttatttttccctttcaaataaaacactagtcaggtaccgttttatcccagtcgtactcttccaggtttggaagacccagagaggccaagatcccatccttagccatagcgagcggtggtggtggatagcatcacaagaaacgagcctgaaaatcaggtccagccggtccaagcacatggcctcccatctgggagagcccactgtcccactcccacatgtctgggcacctgccctgggctgaggccaggctgctccaggggcctcctgcgccctcacctgccacagagcaacccaggttaaatacagcccatgcacaaagccacaggccaaagcctatggaattgtttttaatcatcaaatttaaccattttcataactggttcctggaggtgtgcagtgcccccttgctcttcaaacctacagcttctctttgccatttgtggatttcacatcactccacacagaaacattacagcctggcatccccagtctttgccttcttccagctgcctcgacacagcactgtggcctgtccctattgcccaggcacgccatttccaagggcaggaaggggcagtgtcctgaagcccatcttttctgtgactgtcttaggtgatgtgtagccccctccacctttccactcaacaacctcccacccctgtcctgctgcatggtccggagtctgggacctactttgttttttgttatttatgaccttgtttaaagaaaataaatatctcccaaccttt

SEQ ID NO: 171399 - DNA, 2687 bp, Homo sapiens
  Payload ID: 13708
  Gene Symbol: PPEF1
  Gene Name: protein phosphatase, EF-hand calcium binding domain 1
  Uniprot ID: O14829
  ENST ID: ENST00000349874
  CDS Start-End: 482-2257
tgaagattacaaatgagactgggaaaccctcttcaataagacctgtgtgatgatagattgtgtcctgagcccgcaggtcaggctgaaagagtcaacaaccagcaaagtgaagatctaggagtctgttccccttgaacctgtgtggacctgatcaaacctcgagggaaaggctgggagaacacatccctggtcagctgtaggaaagccagagagcatttgagaagaggctgaagcttgaattttgcaaacacacaagccctctgcatttccccagagagaaggtttttttctcgtcttcatttcctttgaaacacctggggtgaggaaaaacctctacattggccaagcagaagaaacagaatctatgactgaagaggatcggctaagagtggttcctcgcagcttaaagggaggcacttttcacactctgtcttaaaatcagaagttgaattcatgaacacatatgatttagatagaagtcatgggatgcagcagttcttcaacgaaaaccaggagatctgacacatcactgagagctgcgttgatcatccagaactggtaccgaggttacaaagctcgactgaaggccagacaacactatgccctcaccatcttccagtccatcgaatatgctgatgaacaaggccaaatgcagttatccaccttcttttccttcatgttggaaaactacacacatatacataaggaagagctagaattaagaaatcagtctcttgaaagcgaacaggacatgagggatagatgggattatgtggactcgatagatgtcccagactcctataatggtcctcggctacaatttcctctcacttgtacggatattgatttacttcttgaggccttcaaggaacaacagatacttcatgcccattatgtcttagaggtgctatttgaaaccaagaaagtcctgaagcaaatgccgaatttcactcacatacaaacttctccctccaaagaggtaacaatctgtggtgatttgcatgggaaactggatgatctttttttgatcttctacaagaatggtctcccctcagagaggaacccgtatgtttttaatggtgactttgtagatcgaggaaagaattccatagagatcctaatgatcctgtgtgtgagttttcttgtctaccccaatgacctgcacttgaacagagggaaccacgaagattttatgatgaatctgaggtatggcttcacgaaagaaattttgcataaatataagctacatggaaaaagaatcttacaaatcttggaagaattctatgcctggctcccaatcggtacaatcgttgacaatgaaatcctggtcatccatggtgggatatcagagaccacagacttgaatttactccaccgtgtagagaggaacaagatgaaatctgtgctgataccaccaacggaaacaaacagagaccatgacactgactcgaagcacaataaagtaggtgtgacttttaatgcacatggaagaatcaaaacaaatggatctcctactgaacacttaacagagcatgaatgggaacaggtggtgactatattttctgcttctaattattatgaagaaggcagcaatcgaggagcttacatcaaactatgttctggtacaactcctcgatttttccagtaccaagtaactaaagcaacgtgctttcagcctcttcgccaaagagtggatactatggaaaacagcgccatcaagatattaagagagagagtgatttcacgaaaaagtgaccttactcgtgctttccaacttcaagaccacagaaaatcaggaaaactttctgtgagccagtgggctttttgcatggagaacattttggggctgaacttaccatggagatccctcagttcgaatctggtaaacatagaccaaaatggaaacgttgaatacatgtccagcttccagaatatccgcattgaaaaacctgtacaagaggctcattctactctagttgaaactctgtacagatacagatctgacctggaaatcatatttaatgccattgacactgatcactcaggcctgatctccgtggaagaatttcgtgccatgtggaaactttttagttctcactacaatgttcacattgatgattcccaagtcaataagcttgccaacataatggacttgaacaaagatggaagcattgactttaatgagtttttaaaggctttctatgtagtgcatagatatgaagacttgatgaaacctgatgtcaccaaccttggctaaacacaaatgagagcttccctcaggctccctgaaacagctaggcccaaatcacaagtacagtcctttccaacacccctgaaattcatagtcagtagcagagaaaagcagatcccaattcatcccacaaacagatgcatagtatgggttttggaagtccctagcaagctgttattggtaagattaggttaaatgtcagtaataggatttggtttcagcattagtacctacatattgccagtgagaaactgggttggacctagtggtgttgtcgtgagtgccacctaaccaggaggccagagcggtttgaaaacatcctgaaaggaactcatacagcacaagagaaaactactaagcttgacatctgtgagtgactgagggagacaggaggaataccaggttattcatggaataaagtctttccatctttaaa

SEQ ID NO: 171400 - DNA, 2890 bp, Homo sapiens
  Payload ID: 13708
  Gene Symbol: PPEF1
  Gene Name: protein phosphatase, EF-hand calcium binding domain 1
  Uniprot ID: O14829
  ENST ID: ENST00000361511
  CDS Start-End: 495-2456
agaatctacctcttgaagattacaaatgagactgggaaaccctcttcaataagacctgtgtgatgatagattgtgtcctgagcccgcaggtcaggctgaaagagtcaacaaccagcaaagtgaagatctaggagtctgttccccttgaacctgtgtggacctgatcaaacctcgagggaaaggctgggagaacacatccctggtcagctgtaggaaagccagagagcatttgagaagaggctgaagcttgaattttgcaaacacacaagccctctgcatttccccagagagaaggtttttttctcgtcttcatttcctttgaaacacctggggtgaggaaaaacctctacattggccaagcagaagaaacagaatctatgactgaagaggatcggctaagagtggttcctcgcagcttaaagggaggcacttttcacactctgtcttaaaatcagaagttgaattcatgaacacatatgatttagatagaagtcatgggatgcagcagttcttcaacgaaaaccaggagatctgacacatcactgagagctgcgttgatcatccagaactggtaccgaggttacaaagctcgactgaaggccagacaacactatgccctcaccatcttccagtccatcgaatatgctgatgaacaaggccaaatgcagttatccaccttcttttccttcatgttggaaaactacacacatatacataaggaagagctagaattaagaaatcagtctcttgaaagcgaacaggacatgagggatagatgggattatgtggactcgatagatgtcccagactcctataatggtcctcggctacaatttcctctcacttgtacggatattgatttacttcttgaggccttcaaggaacaacagatacttcatgcccattatgtcttagaggtgctatttgaaaccaagaaagtcctgaagcaaatgccgaatttcactcacatacaaacttctccctccaaagaggtaacaatctgtggtgatttgcatgggaaactggatgatctttttttgatcttctacaagaatggtctcccctcagagaggaacccgtatgtttttaatggtgactttgtagatcgaggaaagaattccatagagatcctaatgatcctgtgtgtgagttttcttgtctaccccaatgacctgcacttgaacagagggaaccacgaagattttatgatgaatctgaggtatggcttcacgaaagaaattttgcataaatataagctacatggaaaaagaatcttacaaatcttggaagaattctatgcctggctcccaatcggtacaatcgttgacaatgaaatcctggtcatccatggtgggatatcagagaccacagacttgaatttactccaccgtgtagagaggaacaagatgaaatctgtgctgataccaccaacggaaacaaacagagaccatgacactgactcgaagcacaataaagtaggtgtgacttttaatgcacatggaagaatcaaaacaaatggatctcctactgaacacttaacagagcatgaatgggaacagattattgatattctgtggagtgatcccagaggcaaaaatggctgttttccaaatacgtgccgaggagggggctgctattttggaccagatgttacttccaagattcttaataaataccagttgaagatgctcatcaggtctcatgaatgtaagcccgaagggtatgaaatctgtcatgatgggaaggtggtgactatattttctgcttctaattattatgaagaaggcagcaatcgaggagcttacatcaaactatgttctggtacaactcctcgatttttccagtaccaagtaactaaagcaacgtgctttcagcctcttcgccaaagagtggatactatggaaaacagcgccatcaagatattaagagagagagtgatttcacgaaaaagtgaccttactcgtgctttccaacttcaagaccacagaaaatcaggaaaactttctgtgagccagtgggctttttgcatggagaacattttggggctgaacttaccatggagatccctcagttcgaatctggtaaacatagaccaaaatggaaacgttgaatacatgtccagcttccagaatatccgcattgaaaaacctgtacaagaggctcattctactctagttgaaactctgtacagatacagatctgacctggaaatcatatttaatgccattgacactgatcactcaggcctgatctccgtggaagaatttcgtgccatgtggaaactttttagttctcactacaatgttcacattgatgattcccaagtcaataagcttgccaacataatggacttgaacaaagatggaagcattgactttaatgagtttttaaaggctttctatgtagtgcatagatatgaagacttgatgaaacctgatgtcaccaaccttggctaaacacaaatgagagcttccctcaggctccctgaaacagctaggcccaaatcacaagtacagtcctttccaacacccctgaaattcatagtcagtagcagagaaaagcagatcccaattcatcccacaaacagatgcatagtatgggttttggaagtccctagcaagctgttattggtaagattaggttaaatgtcagtaataggatttggtttcagcattagtacctacatattgccagtgagaaactgggttggacctagtggtgttgtcgtgagtgccacctaaccaggaggccagagcggtttgaaaacatcctgaaaggaactcatacagcacaagagaaaactactaagcttgacatctgtgagtgactgagggagacaggaggaataccaggttattcatggaataaagtctttccatctttaaactgt

SEQ ID NO: 171401 - DNA, 765 bp, Homo sapiens
  Payload ID: 13708
  Gene Symbol: PPEF1
  Gene Name: protein phosphatase, EF-hand calcium binding domain 1
  ENST ID: ENST00000496075
  CDS Start-End: 230-765
gaatctatgactgaagaggatcggctaagagtggttcctcgcagcttaaagggaggcacttttcacactctgtcttaaaatcagaagttgaattcatgaacacatatgatttagatagaagtcatgggatgcagcagttcttcaacgaaaaccaggagatctgacacatatacttcatgcccattatgtcttagaggtgctatttgaaaccaagaaagtcctgaagcaaatgccgaatttcactcacatacaaacttctccctccaaagaggtaacaatctgtggtgatttgcatgggaaactggatgatctttttttgatcttctacaagaatggtctcccctcagagaggaacccgtatgtttttaatggtgactttgtagatcgaggaaagaattccatagagatcctaatgatcctgtgtgtgagttttcttgtctaccccaatgacctgcacttgaacagagggaaccacgaagattttatgatgaatctgaggtatggcttcacgaaagaaattttgcataaatataagctacatggaaaaagaatcttacaaatcttggaagaattctatgcctggctcccaatcggtacaatcgttgacaatgaaatcctggtcatccatggtgggatatcagagaccacagacttgaatttactccaccgtgtagagaggaacaagatgaaatctgtgctgataccaccaacggaaacaaacagagaccatgacactgactcgaagcacaataaagtaggtgtgac

SEQ ID NO: 171402 - DNA, 408 bp, Homo sapiens
  Payload ID: 13708
  Gene Symbol: PPEF1
  Gene Name: protein phosphatase, EF-hand calcium binding domain 1
  ENST ID: ENST00000470157
  CDS Start-End: 1-348
gaaaaagtgaccttactcgtgctttccaacttcaagaccacagaaaatcaggctcattctactctagttgaaactctgtacagatacagatctgacctggaaatcatatttaatgccattgacactgatcactcaggcctgatctccgtggaagaatttcgtgccatgtggaaactttttagttctcactacaatgttcacattgatgattcccaagtcaataagcttgccaacataatggacttgaacaaagatggaagcattgactttaatgagtttttaaaggctttctatgtagtgcatagatatgaagacttgatgaaacctgatgtcaccaaccttggctaaacacaaatgagagcttccctcaggctccctgaaacagctaggcccaaatcacaagtacag

SEQ ID NO: 171403 - DNA, 557 bp, Homo sapiens
  Payload ID: 13708
  Gene Symbol: PPEF1
  Gene Name: protein phosphatase, EF-hand calcium binding domain 1
  ENST ID: ENST00000472826
  CDS Start-End: 270-557
attagaatctatgactgaagaggatcggctaagagtggttcctcgcagcttaaagggaggcacttttcacactctgtcttaaaatcagaagttgaattcatgaacacatatgatttagatagaagtcatgggatgcagcagttcttcaacgaaaaccaggagatctgacacatttatccaccttcttttccttcatgttggaaaactacacacatatacataaggaagagctagaattaagaaatcagtctcttgaaagcgaacaggacatgagggatagatgggattatgtggactcgatagatgtcccagactcctataatggtcctcggctacaatttcctctcacttgtacggatattgatttacttcttgaggccttcaaggaacaacagatacttcatgcccattatgtcttagaggtgctatttgaaaccaagaaagtcctgaagcaaatgccgaatttcactcacatacaaacttctccctccaaagaggtaacaatctgtggtgatttgcatgggaaactggatgatctttttttgatcttctacaag

SEQ ID NO: 171404 - DNA, 3414 bp, Homo sapiens
  Payload ID: 13709
  Gene Symbol: PPEF2
  Gene Name: protein phosphatase, EF-hand calcium binding domain 2
  Uniprot ID: O14830
  ENST ID: ENST00000286719
  CDS Start-End: 358-2619
gggggcctgatctgactgacgtcagggggtgcctactccttcgaggcaagaagcctgaactttccttcctgtcactgtgaatacttggccagggctgtgaatgtcaccattgcttttcaggaagaagacatggcagactagggctgcaccttctttatgggctctgtaggtctgaaagaaatcagatcagcctgggatccctcagccaactctgaagacaggatggggatcacgcctgcatgttaaagagatttctgccttgttgtgtctcatggtaaataaaaaacccagcaaagaagcaaacagctcactgtcctctggatctgctgcgtcctgcaggagcattgcgcttaaactatgggaagcggcacctccacccaacatcattttgctttccagaatgcagagagagccttcaaggcagcagccctgatccagagatggtaccggcgctacgtggcccgcctggagatgaggcggcgttgcacctggagcatcttccagtctatagaatatgctgggcagcaagaccaagtcaagctccatgacttcttcagctatctcatggatcacttcatccccagcagccacaacgacagggacttcctgacccgcatattcactgaggacagattcgcccaggactccgagatgaagaaatgcagtgactatgaatccatagaggtacccgacagttacacggggccacgcctctccttcccactcctgcctgaccatgcaactgccctggtagaagcattcagactgaaacaacagctccatgctcgctacgtcttgaaccttttgtatgaaaccaagaaacatctggtacagctgccaaacatcaaccgggtctcaacctgttacagtgaggagatcacagtgtgtggagacttacatggccaattggatgacttaatctttatattttataagaatggcctcccgtcgccagaacggtcatatgtgttcaacggtgactttgtggatcgaggcaaggattcagtagagatcctgatgattctttttgccttcatgctggtttaccccaaagagttccatcttaacagaggaaaccatgaggaccatatggtgaacttacgatatggcttcaccaaggaagtgatgaataaatacaaggtacacgggaaggaaatactaagaaccctgcaagatgttttctgttggcttccactggccactctgatagatgagaaagttctaattcttcatggtggggtgtcagacataactgatctggagcttttggacaaaatagagaggagcaagatagtttccaccatgaggtgcaaaacgagacagaagagtgagaagcagatggaggagaagagaagagccaaccagaagagctctgcacagggacccatcccatggtttctccccgaaagccgctctcttccctcttcgccccttcggcttggctcctacaaggcccagaaaaccagcaggtcctccagcatcccctgcagcggttccctggacgggcgggagctctcccggcaggtgcggagctccgtggaactggagctagagcggtgccggcagcaagcaggcctcctggtgaccggagagaaagaggagccctcccgctcagcctcagaagcagactctgaagccggagagctgcggaagcccactcaggaggagtggaggcaggttgtagatatcctgtggagtgatcccatggctcaagagggctgcaaggccaacactattcgaggaggaggctgttattttgggcctgatgtgacacaacagttgctacaaaaatacaacatgcaattcctgatccgttcacatgaatgcaaacctgaaggctatgaattctgtcacaaccgcaaggtattaacaatcttttctgcctccaactactatgaagttggcagcaacagaggggcctatgtcaaactggggccagccctgaccccacatattgtgcagtatcaagctaacaaggtgacccacacactcaccatgaggcaaaggattagcagagtggaggagtcggctctgagagctctgagggagaagctgtttgctcattcttcagatcttctcagtgaatttaagaagcatgatgcagataaagtcggtttaatcaccttgagtgactgggcagcagcggtggagtctgtgttgcacctaggactgccatggcggatgctgaggccacagctggtgaacagctcagcagacaacatgctggagtacaagtcttggctgaagaacttggccaaggaacaactgagtcgcgagaacatacaatcaagtttgctggaaacattgtatcgaaaccgatccaacctagagaccatttttaggatcatagacagtgatcattcagggttcatctcactggacgagttcaggcagacctggaagctgttcagctctcacatgaatatcgacattacagatgactgcatctgtgaccttgctcggagcattgatttcaacaaagatggccacattgatatcaatgagttcctggaggccttccgccttgtggagaaatcctgcccagagggcgatgcctcagaatgcccacaagctacaaatgctaaagacagtggctgcagcagtccaggtgcacactaagaacagcctggtcttcatcacccaaagtgcctcataggcaatgctcagcttctcactagactatctcccttattctccatgtgaaactttatgctgaaaatttacctatccatatgcatcagaatcacctgtgtatttcagtgtggaggggtgggttggggtgttgtgtatgtatgtgttttaagtatatgagtgccccaaccccacctcacaatcttcacaaagtagaacttaggtatagtgttttcaaattctaaagtccacttcagttaagaaccactgacaatgtaactctctcattgttttcattttatacgtttttttgagatggagtttctctcttgttgcccaggctggagtgcattggcgcgatctcggctcaccgcaaagtccgcctcccaggcgattctcctgcctcagcctcctgagtagctgggattacaggcatgcaccaccacaccaggctaattttgtatttttagtagacacagggtttctccatgttggtcaggctggtcttgaactcccaacctcaggtgatccaccctcctcagcctcccaaagtgctgggattacaggcatgagccaccgcacccagcctattttatactttttatttattgtctttaacaatgtctattggtaaaggaaagttatttttaaaaattgtattgtaattccatgacccaagcatatggattttcttcattatttactttttcttacttgttactgtagtgtttatataattttatgttctacttttaaaaaaataaattaatatctaattgtaaa

SEQ ID NO: 171405 - DNA, 4163 bp, Homo sapiens
  Payload ID: 13709
  Gene Symbol: PPEF2
  Gene Name: protein phosphatase, EF-hand calcium binding domain 2
  ENST ID: ENST00000511880
  CDS Start-End: 274-693
accattgcttttcaggaagaagacatggcagactagggctgcaccttctttatgggctctgtaggtctgaaagaaatcagatcagcctgggatccctcagccaactctgaagacaggatggggatcacgcctgcatgttaaagagatttctgccttgttgtgtctcatggtaaataaaaaacccagcaaagaagattctctcttcattttgtcagcaaacagctcactgtcctctggatctgctgcgtcctgcaggagcattgcgcttaaactatgggaagcggcacctccacccaacatcattttgctttccagaatgcagagagagccttcaaggcagcagccctgatccagagatggtaccggcgctacgtggcccgcctggagatgaggcggcgttgcacctggagcatcttccagtctatagaatatgctgggcagcaagaccaagtcaagctccatgacttcttcagctatctcatggatcacttcatccccagcagccacaacgacagggacttcctgacccgcatattcactgaggacagattcgcccaggactccgagatgaagaaatgcagtgactatgaatccatagaggtacccgacagttacacggggccacgcctctccttcccactcctgcctgaccatgcaactgccctggtagaagcattcagactgaaacaatagcagctccatgctcgctacgtcttgaaccttttgtatgaaaccaagaaacatctggtacagctgccaaacatcaaccgggtctcaacctgttacagtgaggagatcacagtgtgtggagacttacatggccaattggatgacttaatctttatattttataagaatggcctcccgtcgccagaacggtcatatgtgttcaacggtgactttgtggatcgaggcaaggattcagtagagatcctgatgattctttttgccttcatgctggtttaccccaaagagttccatcttaacagaggaaaccatgaggaccatatggtgaacttacgatatggcttcaccaaggaagtgatgaataaatacaaggtacacgggaaggaaatactaagaaccctgcaagatgttttctgttggcttccactggccactctgatagatgagaaagttctaattcttcatggtggggtgtcagacataactgatctggagcttttggacaaaatagagaggagcaaggaaatgctgctacaacatccatgacaacattttcctgggaagttccaaagacagggaacaatcagtctacttcagctttgggcaattctaatggatatggatatgaaagtctatgtatatgagacatacatgaaatgaaagaatacggctttagagtgagacagacctgggtttgaaccctggaataggcaattgttggctgaaatggcagtttggttctatgaagttgtccagagacccaggtttcttgttactctgccacccctaatgtgtggtttctagacttagctaccatttagcaagtaaggatatgactccttgtggtttggtaactagaaattgctgtgtccctgtacacccaaactcagtgttttcacttacacatctgttatatctttttttgtttgtttgtttttgagacaaggtctcactctgtcatccagactggagtgtggtaccacgatcacggctcactgcagccttgacctcctgggctgaggcaatcctccagcctcagcctcccgagtagctgggactacagtcacacacaatcatgcttggctaatttttaaaaaattatttgtagagggccgggtgtgatggctcacacctgtaatcccagcactctgagagtcggaggccagcggatcatgagatagtttccaccatgaggtgcaaaacgagacagaagagtgagaagcagatggaggagaagagaagagccaaccagaagagctctgcacagggacccatcccatggtttctccccgaaagccgctctcttccctcttcgccccttcggcttggctcctacaaggcccagaaaaccagcaggtcctccagcatcccctgcagcggttccctggacgggcgggagctctcccggcaggtgcggagctccgtggaactggagctagagcggtgccggcagcaagcaggcctcctggtgaccggagagaaagaggagccctcccgctcagcctcagaagcagactctgaagccggagagctgcggaagcccactcaggaggagtggaggcaggttgtagatatcctgtggagtgatcccatggctcaagagggctgcaaggccaacactattcgaggaggaggctgttattttgggcctgatgtgacacaacagttgctacaaaaatacaacatgcaattcctgatccgttcacatgaatgcaaacctgaaggctatgaattctgtcacaaccgcaaggtattaacaatcttttctgcctccaactactatgaagttggcagcaacagaggggcctatgtcaaactggggccagccctgaccccacatattgtgcagtatcaagctaacaaggtgacccacacactcaccatgaggcaaaggattagcagagtggaggagtcggctctgagagctctgagggagaagctgtttgctcattcttcagatcttctcagtgaatttaagaagcatgatgcagataaagtcggcctagcttccagccaactctgctactatcaacaaaaatagtgacagtgcccattatttctattacctgcagatagtaagaaggatgtcaggataaaaatatacacaccattgggcaggaaactagacttctaggtgacaaggcaacaggttagctctcacctgtaggtttaatcaccttgagtgactgggcagcagcggtggagtctgtgttgcacctaggactgccatggcggatgctgaggccacagctggtgaacagctcagcagacaacatgctggagtacaagtcttggctgaagaacttggccaaggaacaactgagtcgcgagaacatacaatcaagtttgctggaaacattgtatcgaaaccgatccaacctagagaccatttttaggatcatagacagtgatcattcagggttcatctcactggacgagttcaggcagacctggaagctgttcagctctcacatgaatatcgacattacagatgactgcatctgtgaccttgctcggagcattgatttcaacaaagatggccacattgatatcaatgagttcctggaggccttccgccttgtggagaaatcctgcccagagggcgatgcctcagaatgcccacaagctacaaatgctaaagacagtggctgcagcagtccaggtgcacactaagaacagcctggtcttcatcacccaaagtgcctcataggcaatgctcagcttctcactagactatctcccttattctccatgtgaaactttatgctgaaaatttacctatccatatgcatcagaatcacctgtgtatttcagtgtggaggggtgggttggggtgttgtgtatgtatgtgttttaagtatatgagtgccccaaccccacctcacaatcttcacaaagtagaacttaggtatagtgttttcaaattctaaagtccacttcagttaagaaccactgacaatgtaactctctcattgttttcattttatacgtttttttgagatggagtttctctcttgttgcccaggctggagtgcattggcgcgatctcggctcaccgcaaagtccgcctcccaggcgattctcctgcctcagcctcctgagtagctgggattacaggcatgcaccaccacaccaggctaattttgtatttttagtagacacagggtttctccatgttggtcaggctggtcttgaactcccaacctcaggtgatccaccctcctcagcctcccaaagtgctgggattacaggcatgagccaccgcacccagcctattttatactttttatttattgtctttaacaatgtctattggtaaaggaaagttatttttaaaaattgtattgtaattccatgacccaagcatatggattttcttcattatttactttttcttacttgttactgtagtgtttatataattttatgttctacttttaaaaaaataaattaatatctaattgtaaaccctttcc

SEQ ID NO: 171406 - DNA, 1797 bp, Homo sapiens
  Payload ID: 13709
  Gene Symbol: PPEF2
  Gene Name: protein phosphatase, EF-hand calcium binding domain 2
  Uniprot ID: O14830
  ENST ID: ENST00000621010
  CDS Start-End: 1-1797
atgggaagcggcacctccacccaacatcattttgctttccagaatgcagagagagccttcaaggcagcagccctgatccagagatggtaccggcgctacgtggcccgcctggagatgaggcggcgttgcacctggagcatcttccagtctatagaatatgctgggcagcaagaccaagtcaagctccatgacttcttcagctatctcatggatcacttcatccccagcagccacaacgacagggacttcctgacccgcatattcactgaggacagattcgcccaggactccgagatgaagaaatgcagtgactatgaatccatagaggtacccgacagttacacggggccacgcctctccttcccactcctgcctgaccatgcaactgccctggtagaagcattcagactgaaacaacagctccatgctcgctacgtcttgaaccttttgtatgaaaccaagaaacatctggtacagctgccaaacatcaaccgggtctcaacctgttacagtgaggagatcacagtgtgtggagacttacatggccaattggatgacttaatctttatattttataagaatggcctcccgtcgccagaacggtcatatgtgttcaacggtgactttgtggatcgaggcaaggattcagtagagatcctgatgattctttttgccttcatgctggtttaccccaaagagttccatcttaacagaggaaaccatgaggaccatatggtgaacttacgatatggcttcaccaaggaagtgatgaataaatacaaggtacacgggaaggaaatactaagaaccctgcaagatgttttctgttggcttccactggccactctgatagatgagaaagttctaattcttcatggtggggtgtcagacataactgatctggagcttttggacaaaatagagaggagcaagatagtttccaccatgaggtgcaaaacgagacagaagagtgagaagcagatggaggagaagagaagagccaaccagaagagctctgcacagggacccatcccatggtttctccccgaaagccgctctcttccctcttcgccccttcggcttggctcctacaaggcccagaaaaccagcaggtcctccagcatcccctgcagcggttccctggacgggcgggagctctcccggcaggtgcggagctccgtggaactggagctagagcggtgccggcagcaagcaggcctcctggtgaccggagagaaagaggagccctcccgctcagcctcagaagcagactctgaagccggagagctgcggaagcccactcaggaggagtggaggcaggttgtagatatcctgtggagtgatcccatggctcaagagggctgcaaggccaacactattcgaggaggaggctgttattttgggcctgatgtgacacaacagttgctacaaaaatacaacatgcaattcctgatccgttcacatgaatgcaaacctgaaggctatgaattctgtcacaaccgcaaggtattaacaatcttttctgcctccaactactatgaagttggcagcaacagaggggcctatgtcaaactggggccagccctgaccccacatattgtgcagtatcaagctaacaaggtgacccacacactcaccatgaggcaaaggattagcagagtggaggagtcggctctgagagctctgagggagaagctgtttgctcattcttcagatcttctcagtgaatttaagaagcatgatgcagataaagtcggcctagcttccagccaactctgctactatcaacaaaaatag

SEQ ID NO: 171407 - DNA, 4125 bp, Homo sapiens
  Payload ID: 13710
  Gene Symbol: PPM1A
  Gene Name: protein phosphatase, Mg2+/Mn2+ dependent, 1A
  Uniprot ID: P35813
  ENST ID: ENST00000325658
  CDS Start-End: 360-1334
ctctgcctccctctccaacgcccggatgatctgagccgcgagggcgccgacagccgggggcccggacgcagcccggctcctcccctcctccgccccttccccagcctgacctggcccgccgctgcagcggtgacccctcccccggctgccgccgtcgccgccgcggtgaccccctccccggctgccgccgccgccgcctcggccgaccagggacctgcccgcctgcggctgctccggattttaaataaacttggagccttttcttgaaagacagctggctgtggagagccttctaccaactgcagttttagatacgttttgaaaatttcatcacctgagacctagaggatcaagacataatgggagcatttttagacaagccaaagatggaaaagcataatgcccaggggcagggtaatgggttgcgatatgggctaagcagcatgcaaggctggcgtgttgaaatggaggatgcacatacggctgtgatcggtttgccaagtggacttgaatcgtggtcattctttgctgtgtatgatgggcatgctggttctcaggttgccaaatactgctgtgagcatttgttagatcacatcaccaataaccaggattttaaagggtctgcaggagcaccttctgtggaaaatgtaaagaatggaatcagaacaggttttctggagattgatgaacacatgagagttatgtcagagaagaaacatggtgcagatagaagtgggtcaacagctgtaggtgtcttaatttctccccaacatacttatttcattaactgtggagactcaagaggtttactttgtaggaacaggaaagttcatttcttcacacaagatcacaaaccaagtaatccgctggagaaagaacgaattcagaatgcaggtggctctgtaatgattcagcgtgtgaatggctctctggctgtatcgagggcccttggggattttgattacaaatgtgtccatggaaaaggtcctactgagcagcttgtctcaccagagcctgaagtccatgatattgaaagatctgaagaagatgatcagttcattatccttgcatgtgatggtatctgggatgttatgggaaatgaagagctctgtgattttgtaagatccagacttgaagtcactgatgaccttgagaaagtttgcaatgaagtagtcgacacctgtttgtataagggaagtcgagacaacatgagtgtgattttgatctgttttccaaatgcacccaaagtatcgccagaagcagtgaagaaggaggcagagttggacaagtacctggaatgcagagtagaaggtggatcatttaacaaaaaataagtagctttattaaagaaaaatcttcaacacaatcaaactttaacattttagcttttagatttttatgtgtctttgacagctagtgtctagtgtatgaaagtggaaaaggacatttctgtagtagctgttaagatgtatgcagttgtcctatcacagttatattagaaataacaactagtgtggaaagtaacccacattctgttcaggatacttttgttttaaaaggctaaaatgtttgtgtgctttaaaattcttaatgaattcactggcatgagtaattttatgccgggaaaatctgatttgtggtctatttaattacaaagagattgtgatggtgataatttgaataccatctttctatgaaaagctgtgtatattaattttaatctctagggccttttttcaataacttgaaaatcacagcctcatcattagcaactttatatacacagctttaaaaaatttgctttaaactgtttcagagcttcttccctaagccataaactgtctcacctaaacaagatagacctcaataaaagacataatatttctccacctggcagaaaagtaactgccaagtaagattaagaaataagttgagcatttctggagtatatttctcataattctgcagagacttccagtttattgcatatatgcagtaaagtgtatatattatgcagtttctctaagtggaaaaacttgacatgactttaatagtgttaaaacatgaaaatgctggtgagctgaggtagaaaaaaaacaagaaaaaaattttaaaaatagcgttaaaatgcattttaggctcctaatgtcgttaatttgcacgttaaagacctctaatcgcatgcaagcattgacctaccacacctacatcccactgtgcctgcattattgaaattactactcactttaattttttttcccctttttactgtttgataccaatcataatcagtctgatactagaatcatgattggttttgttctttagtactgtctagagctactattttgtttttattgctgtccgccacttgatagtcatacatctagtatgtgtttgtactatttagtattgcattcattggacgtactattcaacgaatttgtctccttactgttaccaagggtcttggaatttttatattttaaattaatcattcaatataagttatttataggtatagtacaattttaaaatatttagaatgctacaatcattggttcaaactattgattcatgggaaaatttaaattcataagaataatatgtatagggataagttgatatttaatgtattggcactttaacttgggcagacatgttttcttattggtttaaagaagtaataagtattttaatatttttactatgaaatgggatccaattttagaaatgaattgctacttttctctttagtgtgtacactttaagttttagatggaattatgaaatattcactttacgttattttgttacaataataagttttatatttcttattatcaagcaagagttgccacctggacagagtttacattgatactcaatatttttgatatgttaaagtgttattatacttgtaccattcaattggagattgtcataaattaaatatggtattttttactcagatttgatgagactgcaactagagaataaatattacattaaaattgctgctattttaaaacatagaatgtaactgtttgtattgtaaaagttgtgtgtcctcagtgaaaaatactgccttcagcttccaaagcaggcacctgaatgcctttttcttttctctctctcttctttctttaaatacatgccttcactagattgctgtgacctactaaacctcattttatttgcttggaacatttttggcttctctgtccacaccatagaaaaggacaaaggccttccagctctccttttctcttatttgttcccttctaaatacttgactctctgggggtgtgaaaagattcagctcataatttatactactattaattttgtggtccttctaagccaatttaaaattatacttttgtgtatatattttcaaaatctttgctactgactaccttagctttaaagttgctaatttggagatgactgatagaatccctgaaacttggtggaggggagtggaaaggagcagaatgtgtttgtgtatatgtatgtgaaacatggatcttctatatataaatattctttagaaaaagcgttcagtctttttacaattctaagtaaaacgtataggtcaacagaaattaaaggaatatttcttaaaattcatttatttttcttttttgaaagcagacagaagcaaggctagtatagtatgaatggtcaggtagtttaaatgcgttgtcccacgtggaacaggagatattaactgtttttaaagctttacattatttttttacaagaatttgttttcctgtaattttcttcacagttaaaatatcctaatttatattttaacaaaagagatgtaagatacatcaaatatagatgattcaaggtaatgttttttagacctgaaactattgattcaatttatcatcagtgtttatttctattgtatctagttatctatccaaataattgtattggcttagcggagactgtatgttaagtgtattagttttagattgtgaaattgtgcagtttaggtaaacatcaaatccctttatttttgtacagcagatttccagcattagaaccatgtagaacaaatatactagatgttaaagattacacaataaaggaacttggcaaaccaaa

SEQ ID NO: 171408 - DNA, 1713 bp, Homo sapiens
  Payload ID: 13710
  Gene Symbol: PPM1A
  Gene Name: protein phosphatase, Mg2+/Mn2+ dependent, 1A
  Uniprot ID: P35813
  ENST ID: ENST00000325642
  CDS Start-End: 97-1464
aatgtattatgatgtaggggagggaggaaggagggccagggtagggggcacaccctctccctgaatgaaattcatttaggggcactgtctgctcgcatgttctgttctgggagaaaatgggtagcagaagctacaatttgtactaagctaatgaaaagagagaaaagaagaatggggaagagaagggcaaagaaggcaaaaagagaagagaagaaaaagggaggagagagaaggagaaatgagaaaagaggaaaccaaatgaagaggatgtgtgagagaaaaaaatatgaaacagacctagaggatcaagacataatgggagcatttttagacaagccaaagatggaaaagcataatgcccaggggcagggtaatgggttgcgatatgggctaagcagcatgcaaggctggcgtgttgaaatggaggatgcacatacggctgtgatcggtttgccaagtggacttgaatcgtggtcattctttgctgtgtatgatgggcatgctggttctcaggttgccaaatactgctgtgagcatttgttagatcacatcaccaataaccaggattttaaagggtctgcaggagcaccttctgtggaaaatgtaaagaatggaatcagaacaggttttctggagattgatgaacacatgagagttatgtcagagaagaaacatggtgcagatagaagtgggtcaacagctgtaggtgtcttaatttctccccaacatacttatttcattaactgtggagactcaagaggtttactttgtaggaacaggaaagttcatttcttcacacaagatcacaaaccaagtaatccgctggagaaagaacgaattcagaatgcaggtggctctgtaatgattcagcgtgtgaatggctctctggctgtatcgagggcccttggggattttgattacaaatgtgtccatggaaaaggtcctactgagcagcttgtctcaccagagcctgaagtccatgatattgaaagatctgaagaagatgatcagttcattatccttgcatgtgatggtatctgggatgttatgggaaatgaagagctctgtgattttgtaagatccagacttgaagtcactgatgaccttgagaaagtttgcaatgaagtagtcgacacctgtttgtataagggaagtcgagacaacatgagtgtgattttgatctgttttccaaatgcacccaaagtatcgccagaagcagtgaagaaggaggcagagttggacaagtacctggaatgcagagtagaagaaatcataaagaagcagggggaaggcgtccccgacttagtccatgtgatgcgcacattagcgagtgagaacatccccagcctcccaccagggggtgaattggcaagcaagaggaatgttattgaagccgtttacaatagactgaatccttacaaaaatgacgacactgactctacatcaacagatgatatgtggtaaaactgctcatctagccatggagtttaccttcacctccaaaggagagtacagctcaactttgttgaaacttttaacatccatcctcaactttaaggaaggggatatgacatgggtgagaatgattacatcagagaacttcagcagtacaacagctagcccagaactgatttttttttttttttttgtaaatttgagacttatgtaagcgtgatttcaaaccataattcgtgttgtaaatcagactccagc

SEQ ID NO: 171409 - DNA, 8184 bp, Homo sapiens
  Payload ID: 13710
  Gene Symbol: PPM1A
  Gene Name: protein phosphatase, Mg2+/Mn2+ dependent, 1A
  Uniprot ID: P35813
  ENST ID: ENST00000395076
  CDS Start-End: 431-1579
cgggagctagagagcagtggtctcggcgctcgtccggcccgcagcttcgggtcctcaggcggctgttgctccggaacgggtggttggggaggggggggtggggggactctagacagctgaggcgcgaaagcgatgagtcctcggctcttcctcctccttctccgggacccgctctctgcctccctctccaacgcccggatgatctgagccgcgagggcgccgacagccgggggcccggacgcagcccggctcctcccctcctccgccccttccccagcctgacctggcccgccgctgcagcggtgacccctcccccggctgccgccgtcgccgccgcggtgaccccctccccggctgccgccgccgccgcctcggccgaccagggacctgcccgcctgcggctgctccggacctagaggatcaagacataatgggagcatttttagacaagccaaagatggaaaagcataatgcccaggggcagggtaatgggttgcgatatgggctaagcagcatgcaaggctggcgtgttgaaatggaggatgcacatacggctgtgatcggtttgccaagtggacttgaatcgtggtcattctttgctgtgtatgatgggcatgctggttctcaggttgccaaatactgctgtgagcatttgttagatcacatcaccaataaccaggattttaaagggtctgcaggagcaccttctgtggaaaatgtaaagaatggaatcagaacaggttttctggagattgatgaacacatgagagttatgtcagagaagaaacatggtgcagatagaagtgggtcaacagctgtaggtgtcttaatttctccccaacatacttatttcattaactgtggagactcaagaggtttactttgtaggaacaggaaagttcatttcttcacacaagatcacaaaccaagtaatccgctggagaaagaacgaattcagaatgcaggtggctctgtaatgattcagcgtgtgaatggctctctggctgtatcgagggcccttggggattttgattacaaatgtgtccatggaaaaggtcctactgagcagcttgtctcaccagagcctgaagtccatgatattgaaagatctgaagaagatgatcagttcattatccttgcatgtgatggtatctgggatgttatgggaaatgaagagctctgtgattttgtaagatccagacttgaagtcactgatgaccttgagaaagtttgcaatgaagtagtcgacacctgtttgtataagggaagtcgagacaacatgagtgtgattttgatctgttttccaaatgcacccaaagtatcgccagaagcagtgaagaaggaggcagagttggacaagtacctggaatgcagagtagaagaaatcataaagaagcagggggaaggcgtccccgacttagtccatgtgatgcgcacattagcgagtgagaacatccccagcctcccaccagggggtgaattggcaagcaagaggaatgttattgaagccgtttacaatagactgaatccttacaaaaatgacgacactgactctacatcaacagatgatatgtggtaaaactgctcatctagccatggagtttaccttcacctccaaaggagagtacagctcaactttgttgaaacttttaacatccatcctcaactttaaggaaggggatatgacatgggtgagaatgattacatcagagaacttcagcagtacaacagctagcccagaactgatttttttttttttttttgtaaatttgagacttatgtaagcgtgatttcaaaccataattcgtgttgtaaatcagactccagcaatttttgttgtatgattttgtttttttgtaaagtgtaattgtccttgtacaaaatgctcatatttaattatgaactgctttaaatcactatcaaagttacaagaaatgtttggcttattgtgtgatgcaacagatatatagccctttcaagtcatgttgtgtttggacttggggttggaacagggagagcagcagccatgtcagctacacgctcaaatgtgcagatgattatggaaaataacctcaaaatcttacaaagctgaacatccaaggagttattgaaaactatcttaaatgttcttggtaggggagttggcattgttgataaagccagtcccttcatttaactgtctttcaggatgttccttcgttgtttccatgagtattgcaggtaataatacagtgtattcataagaatctcaatcttggggctaaatgccttgtttctttgcacctcttttcaagtccttacatttaattactaattgataagcagcagcttcctacatatagtaggaaactgccacatttttgctatcatgattggctgggcctgctgctgttcctagtaagatattctgaattccattttatcaataaagcttgatttaacaaacaagaaacttaatcatgtatgtgtaattcctcttttaccctggccttttaaaacactgtgccgttgtaatgagacgtttctcatagggaaagatgttagtctcttttaattggacaacactgtcactcaaggcatagatgaaactttccttccattagaaagactaaaagatttaattcttggttgtaccttaatctattttttaaataggtttctttcaggctgcttatttttcattaagatgtgtatcagcttggatttgcctactgtttaattaaaatatttattgtcaaagtttgacaatctaacactctatggtaggggtgtgtgtgtgtgtgtttgtgagtgtgtgtttgcctgtgatttttaattggcccatgtctttagaatccaagtggttaagatgtatttgtgatttgaaatatagcatgttgataatatttagctgttggcctttacaaataactttcaaagcttaaggaattgtagatataaaaataacctaatttaatttaggcttaaattcctctgattaagcatgtgaaagtaagttttaaaatctgtcgcattgaaaagattactgttccgtgcccttctgtatttttgtctctttaggttgaatattgtatttatcaccatgtaatcattcagtaggcagattcccactagaaaactgttgaaatgtaagactaaaatacaacattgaatacaaaatcaaaattttgtgtataaaaaccagtatagtccattttgttatatttgttttttccctaacttggaaatatacatatttgtatatatagccttaaaattaatgtaaagttaggggagtagtggggaaagtaatgtgaaatgtctcagatttaagtagttaaataccagcaaaatcttttcattatccctcttattttgtgaggtgattaaatgtaacttaattgtatttaatttatatcttattccagcatgaatgaggaaaaactgaagtactatttatatttagaaattcatatcagttgaaattacagaaccaattccatacttacaataaatacttaatgtctaaatctgtggtagagtgcgaagtatgataatgttctaagttatggctttgcaagcatctaaatgtgcatttaatgaataccagtgcttctagtatagactaattaccagacatactggtactgaaagctaaatccctattataacaaaccagttccttaatattttaagtagactgacaactttagttccagaaattgcaaaactttgaactggactgtgtaatcttttgagatgcaaaacttaagtcacaagtagagtatgtgatggaaagctgtatttcaaaccataacagcatatttagagccttttttttttgagtctttaaacaagagaaaattaaaatattcctgtcaaaattattagtattgaaattaggcttggacacgagagagaaccgtatttgagtgatgtgagaagactaaatcttttccacatgagtcagcactgccatactaataatttttttactataaaaatacaggaaggaagtatacattataacagcagactgtgtgtgttcctgattcctggaggtaatagtggggggaaaccaaccatactttttaaaggcacttttgcacctctattgtgcacttcattcttgtaccacttaaattcttcacccccatcccctttttttgtgctaattagcatctcagggcaatgcctcaaaaatgtttgatgtgttctgttctttggagggaaaaagttcttatgtgatgataatatagtactcaaaatatacttttatcatttaaatgtcttatttgctgctatgaataggaaataacattttgtatagcaggctctgttttaccctaacattaaaaaatttcactgatctttctttcattaacagggtagaatctcctaatttccactttcttgggaatatacttttatagacaatagaagcagttctcaatattagcatatactttaaaaaatcaaagtgataacttaattcagctttggaagtatctcaaacatatttttactttatagtgcattaacttgcttctagagtacttaatgcaactgctctagccacttaattttttatactaatctcaacattaagaaatttggattaagtaataaattagttatgtaattcaagtaatctgaattacagcagtacttttagtgatcattcataggactatatattaacccagctaataactcagtttttttacaaaatgtttcgagtattattggtaaaacactgttctaggctaagcacattgggactgtaaagaaatgagtagatccttggcttcaagtttacatctggacaatttataatctagtgtatgttagtattataactggatcactcatcaaaaaatatatatatatatctattgcccacctgctatctaccaggtacttagctgatcaaggcaggcccctgccctaaagaccttgtttatacttcctttactcacctgaaaactgttctccagtttattttcttctctctaaagttaaagagtaattcagaagaaaattttgcttagcataagaataaaattggactgaagaggcttaagcccattcagtatccttgattgcatttatccaacggcctttattcttcctgctgacagcagtaactcagaggaataggtagtagatttctgaaaattatccagccatggaaatgtaggtggggtttgagtttaaggcatttaaaaatgtaaatatctctagctaaatttatcttaagtagaactctgtgtttttgtaacacactgccagtgttaatatcaaattttagccaaattattactatgtgttttaatattttaaaataatttcactgcccatctttactggacaaactcatttggagttcaacttgtgatttctgaaagaactgatgaaattgggtactgctttttttctccatttttcgttttgttttaattttgaatttcatggtatatacttttagttcaaactcagctgtttgtacagtattgtattaggatttggtattagaaaagatgtgtaaatatcttagtatataattgtttctcatttgaggtttttcttctaagggaccttaaagagttttatatacttttgctcacagaaactgctggtgagattaccattttttgagtatctagtcttctagtttttcttttaggcattaggaagccttctttagagttcaaaattttagaagcctaatttgctcttacttccttcaattatgtgccatgtgttttggtttgtatatgttttaaattgtatatttccttggaatatgcttgaaatatttaagaatacattttcaaaatgtataatactgtattgttttgttgatcagaataataagtctcagttaaatgtttgttattactgatagtcaaaatgctcaatagaaatgatgagaggcattggttccaattcattgtcaaatgaacgttttctaattttgttcacagattctttccctttcgattgttctgtatgttaagatagtggcttctgctctcactgttttcctatttatattactagcaggtaggagtgctaattagaaaaacttagatggtattgaaattacagttgacaacttatatttttatgagatggagaaaaaagattaagttgatataacaacaaagtggactttttttcttccttatcctgcacgaaatattgcccttgtttcctctactttcctcttggtgttttctctttttttcaaacagaaacaggccaattccattttcttgagcaagaaagcttagtgtgttacttcatcaaggccagctaatactgtgttaaaccgggctgaaaatgagaaaacttgggagatggaggaatggggaaatggcagtgggataggtagggaaggattactcttaattgttttaaaagccataggaaagtcttccttgtacgtggctgtaaatttataagaactattgtgtcacataaaccaacaagaatgaacctttgctgcttcagataatttgatttttccagcaaggaaattaataagttactgattcttcagcatagaaacaactgagaagaattaatgcaatgtttcttcactagaaaacccaacccttcatttcttttcattgctccaaaacccagttttcaactaatggttttctcattaaactaaatgtttagaaaagttgtttagagtttttctttttcttttacatagtcctcctgatccagtataagactatttagtaacgtgcatttgtatggtactatctaaagtaagttagattgatgtaagagatcgggtagctgcggaacaaaattagttatatcctaattaggtacagtgaatgacacaaaatcattttagcaatgcttcttaaccttttggggtcacaggcgttttgagactgatgaatcctagggacttatttacccaggaaaatgcgtatataacatacatatctccctaaagtttacaatattgtagtggttcatgggccccctggttaagagcccattctaaagtacaatagggcatcatcccttttcctgcaaagcccaaaagtatatttctagggcatgaaaataacttgagtctattttaaggaattgtttcactctagaggtagataggggacctggctagaatctgacattaaaatatactttttaaaaaatattatatttggggtggggaaagtgattaaaaggtgaaaaaaaaacatagtattcagaagttttggaggttaatgtctttctctaagatttgccactttagaaattcaacagaaaagaggtaaaacagaaatggaatgtatctggaacatttttggcctccatagtgcagatatactatattaacaagtaatacatttatttacctgtcagatctccaggttttaagattttgagctttctagtattaggattcattaaatgttcaattcatttcatattctaaggaattaggttatttacttactaattcaggatgttaaaataacatccaagtcggacaaccaccaccaatgcacacagttaatgagatttctaaaatataataagtacaatgtaacaaacgtatagaattttgcatttgttgccaaaattagatgtttaatgacagcttatttaattcccatttgtgggacttctggaacatagaaaccattatcttacctggttatcccttgactaaatagcatatctgcaggaaaatatcttgtttgtagtgatatgccccaatagtgattgatttcactcttgaaatgagttatatcacttaatttgtataaatgttatgagtggagagacatgtacatgttaaaagcatgttgcattatatattcattttttaaactctataaatgttaagaataatataattgcagaaatatttttcttaaatacaatgtgtaacaaaattctccgtagcaactcacccactttgcagtttatgtgatccacacttttaaagaaattccataaatgtatattttgtattatgtattatttcctggtccaaagaaaatatgtgaattcagttctaactttaagaatgtactgtttgttttcaagttcattgaaaaattgcattcagcctgcgaatggttgcagattgtatgttagatgaaaagtagaaataatttctagtttggaaaactggtgccactaaataaacaggcaattacataa

SEQ ID NO: 171410 - DNA, 564 bp, Homo sapiens
  Payload ID: 13710
  Gene Symbol: PPM1A
  Gene Name: protein phosphatase, Mg2+/Mn2+ dependent, 1A
  ENST ID: ENST00000528241
  CDS Start-End: 179-564
cgcctgcggctgctccggtactttgttttgaaaagttcagatcaactgataatactagtgctgtgatgagactcagcttgtactcaagaacagatttatgactagcttatagttggctgcttcaccaggactctacaaattgctcagaacccaaggagacctagaggatcaagacataatgggagcatttttagacaagccaaagatggaaaagcataatgcccaggggcagggtaatgggttgcgatatgggctaagcagcatgcaaggctggcgtgttgaaatggaggatgcacatacggctgtgatcggtttgccaagtggacttgaatcgtggtcattctttgctgtgtatgatgggcatgctggttctcaggttgccaaatactgctgtgagcatttgttagatcacatcaccaataaccaggattttaaagggtctgcaggagcaccttctgtggaaaatgtaaagaatggaatcagaacaggttttctggagattgatgaacacatgagagttatgtcagagaagaaacatggtgcagatagaagtgggtcaacagc

SEQ ID NO: 171411 - DNA, 854 bp, Homo sapiens
  Payload ID: 13710
  Gene Symbol: PPM1A
  Gene Name: protein phosphatase, Mg2+/Mn2+ dependent, 1A
  ENST ID: ENST00000525399
  CDS Start-End: 292-854
ccttctaccaactgcagttttagatacgttttgaaaatttcatcacctgagggataagagttggtgtccttgttcttttttctttcctgggaattgttctagtactgagatttcctctttggcttgaagtttctggtcttcactctagcactaattgaaaaaaaaaaaatttgttttccgagaactgttactttcctccatattttcaaatttattaacagagaattgtacagagtgatttattttacaacaataaaattctatttgtgagacctagaggatcaagacataatgggagcatttttagacaagccaaagatggaaaagcataatgcccaggggcagggtaatgggttgcgatatgggctaagcagcatgcaaggctggcgtgttgaaatggaggatgcacatacggctgtgatcggtttgccaagtggacttgaatcgtggtcattctttgctgtgtatgatgggcatgctggttctcaggttgccaaatactgctgtgagcatttgttagatcacatcaccaataaccaggattttaaagggtctgcaggagcaccttctgtggaaaatgtaaagaatggaatcagaacaggttttctggagattgatgaacacatgagagttatgtcagagaagaaacatggtgcagatagaagtgggtcaacagctgtaggtgtcttaatttctccccaacatacttatttcattaactgtggagactcaagaggtttactttgtaggaacaggaaagttcatttcttcacacaagatcacaaaccaagtaatccgctggagaaagaacgaattcagaatgcaggtggctctgtaatgattcagcgtgtgaa

SEQ ID NO: 171412 - DNA, 569 bp, Homo sapiens
  Payload ID: 13710
  Gene Symbol: PPM1A
  Gene Name: protein phosphatase, Mg2+/Mn2+ dependent, 1A
  ENST ID: ENST00000531937
  CDS Start-End: 126-569
ttatttgccaagagtttcagagctattaacagaagcctaatacatgttcttggactttgcagaaataatttgttgatccatgcggtttcattgctactgcggaaaacctagaggatcaagacataatgggagcatttttagacaagccaaagatggaaaagcataatgcccaggggcagggtaatgggttgcgatatgggctaagcagcatgcaaggctggcgtgttgaaatggaggatgcacatacggctgtgatcggtttgccaagtggacttgaatcgtggtcattctttgctgtgtatgatgggcatgctggttctcaggttgccaaatactgctgtgagcatttgttagatcacatcaccaataaccaggattttaaagggtctgcaggagcaccttctgtggaaaatgtaaagaatggaatcagaacaggttttctggagattgatgaacacatgagagttatgtcagagaagaaacatggtgcagatagaagtgggtcaacagctgtaggtgtcttaatttctccccaacatacttatttcattaactgtggagactcaaga

SEQ ID NO: 171413 - DNA, 1561 bp, Homo sapiens
  Payload ID: 13710
  Gene Symbol: PPM1A
  Gene Name: protein phosphatase, Mg2+/Mn2+ dependent, 1A
  ENST ID: ENST00000532036
  CDS Start-End: 64-558
ggccagggtagggggcacaccctctccctgaatgaaattcatttaggggcactgtctgctcgcatgttctgttctgggagaaaatgggtagcagaagctacaatttgtactaagctaatgaaaagagagaaaagaagaatggggaagagaagggcaaagaaggcaaaaagagaagagaagaaaaagggaggagagagaaggagaaatgagaaaagaggaaaccaaatgaagaggatgtgtgagagaaaaaaatatgaaacagacctagaggatcaagacataatgggagcatttttagacaagccaaagatggaaaagcataatgcccaggggcagggtaatgggttgcgatatgggctaagcagcatgcaagggaagtcgagacaacatgagtgtgattttgatctgttttccaaatgcacccaaagtatcgccagaagcagtgaagaaggaggcagagttggacaagtacctggaatgcagagtagaagaaatcataaagaagcagggggaaggcgtccccgacttagtccatgtgatgcgcacattagcgagtgagaacatccccagcctcccaccagggggtgaattggcaagcaagaggaatgttattgaagccgtttacaatagactgaatccttacaaaaatgacgacactgactctacatcaacagatgatatgtggtaaaactgctcatctagccatggagtttaccttcacctccaaaggagagtacagctcaactttgttgaaacttttaacatccatcctcaactttaaggaaggggatatgacatgggtgagaatgattacatcagagaacttcagcagtacaacagctagcccagaactgatttttttttttttttttgtaaatttgagacttatgtaagcgtgatttcaaaccataattcgtgttgtaaatcagactccagcaatttttgttgtatgattttgtttttttgtaaagtgtaattgtccttgtacaaaatgctcatatttaattatgaactgctttaaatcactatcaaagttacaagaaatgtttggcttattgtgtgatgcaacagatatatagccctttcaagtcatgttgtgtttggacttggggttggaacagggagagcagcagccatgtcagctacacgctcaaatgtgcagatgattatggaaaataacctcaaaatcttacaaagctgaacatccaaggagttattgaaaactatcttaaatgttcttggtaggggagttggcattgttgataaagccagtcccttcatttaactgtctttcaggatgttccttcgttgtttccatgagtattgcaggtaataatacagtgtattcataagaatctcaatcttggggctaaatgccttgtttctttgcacctcttttcaagtccttacatttaattactaattgataagcagcagcttcctacatatagtaggaaactgccacatttttgctatcatgattggctgggcctgctgctgttcctagtaagatattctgaattccattttatcaataaagcttgatttaacaaacaagaaa

SEQ ID NO: 171414 - DNA, 1546 bp, Homo sapiens
  Payload ID: 13710
  Gene Symbol: PPM1A
  Gene Name: protein phosphatase, Mg2+/Mn2+ dependent, 1A
  ENST ID: ENST00000531143
  CDS Start-End: 92-373
attatgatgtaggggagggaggaaggagggccagggtagggggcacaccctctccctgaatgaaattcatttaggggcactgtctgctcgcatgttctgttctgggagaaaatgggtagcagaagctacaatttgtactaagctaatgaaaagagagaaaagaagaatggggaagagaagggcaaagaaggcaaaaagagaagagaagaaaaagggaggagagagaaggagaaatgagaaaagaggaaaccaaatgaagaggatgtgtgagagaaaaaaatatgaaacagtactttgttttgaaaagttcagatcaactgataatactagtgctgtgatgagactcagcttgtactcaagaacagatttatgactagacctagaggatcaagacataatgggagcatttttagacaagccaaagatggaaaagcataatgcccaggggcagggtaatgggttgcgatatgggctaagcagcatgcaaggctggcgtgttgaaatggaggatgcacatacggctgtgatcggtttgccaagtggacttgaatcgtggtcattctttgctgtgtatgatgggcatgctggttctcaggttgccaaatactgctgtgagcatttgttagatcacatcaccaataaccaggattttaaagggtctgcaggagcaccttctgtggaaaatgtaaagaatggaatcagaacaggttttctggagattgatgaacacatgagagttatgtcagagaagaaacatggtgcagatagaagtgggtcaacagctgtaggtgtcttaatttctccccaacatacttatttcattaactgtggagactcaagaggtttactttgtaggaacaggaaagttcatttcttcacacaagatcacaaaccaagtaatccgctggagaaagaacgaattcagaatgcaggtggctctgtaatgattcagcgtgtgaatggctctctggctgtatcgagggcccttggggattttgattacaaatgtgtccatggaaaaggtcctactgagcagcttgtctcaccagagcctgaagtccatgatattgaaagatctgaagaagatgatcagttcattatccttgcatgtgatggtatctgggatgttatgggaaatgaagagctctgtgattttgtaagatccagacttgaagtcactgatgaccttgagaaagtttgcaatgaagtagtcgacacctgtttgtataagggaagtcgagacaacatgagtgtgattttgatctgttttccaaatgcacccaaagtatcgccagaagcagtgaagaaggaggcagagttggacaagtacctggaatgcagagtagaagaaatcataaagaagcagggggaaggcgtccccgacttagtccatgtgatgcgcacattagcgagtgagaacatccccagcctcccaccagggggtgaattggcaagcaagaggaatgttattgaagccgtttacaatagactgaatccttacaaaaatgacgacactgactctacatcaacagatgatatgtggtaa

SEQ ID NO: 171415 - DNA, 2606 bp, Homo sapiens
  Payload ID: 13711
  Gene Symbol: PPM1B
  Gene Name: protein phosphatase, Mg2+/Mn2+ dependent, 1B
  Uniprot ID: O75688
  ENST ID: ENST00000282412
  CDS Start-End: 413-1852
aaaaggagccgagcggcttctgctcaatggcggaaaagccgccggtgctctgacggcctcgttcccctagcagttgcgggggagtttcctgccggcgcggctggagtctctgattctcagggttcggtggttggaagatgctccagagagacgaggctgcggcggaggaggtggcggcggccgaatcggcaacggcgctagggtggagagaaggcggcatcggcggcggcggcggcgtgaggggccgggcggtgtaaacagccccggaggcggcggtcgagaccccgagggggaagcggcggctgagtcagggtcgcgcctccgttggaaacttgggctgagtaccgcggcgggcgcgagcgaggcgccctagacatcttctccctcccttgcctcagatttattgctaaacatgggtgcatttttggataaacccaaaactgaaaaacataatgctcatggtgctgggaatggtttacgttatggcctgagcagcatgcaaggatggagagtggaaatggaagatgcacacacagctgttgtaggtattcctcacggcttggaagactggtcattttttgcagtttatgatggtcatgctggatcccgagtggcaaattactgctcaacacatttattagaacacatcactactaacgaagactttagggcagctggaaaatcaggatctgctcttgagctttcagtggaaaatgttaagaatggtatcagaactggatttttgaaaattgatgaatacatgcgtaacttttcagacctcagaaacgggatggacaggagtggttcaactgcagtgggagttatgatttcacctaagcatatctactttatcaactgtggtgattcacgtgctgttctgtataggaatggacaagtctgcttttctacccaggatcacaaaccttgcaatccaagggaaaaggagcgaatccaaaatgcaggaggcagcgtgatgatacaacgtgttaatggttcattagcagtatctcgtgctctgggggactatgattacaagtgtgttgatggcaagggcccaacagaacaacttgtttctccagagcctgaggtttatgaaattttaagagcagaagaggatgaatttatcatcttggcttgtgatgggatctgggatgttatgagtaatgaggagctctgtgaatatgttaaatctaggcttgaggtatctgatgacctggaaaatgtgtgcaattgggtagtggacacttgtttacacaagggaagtcgagataacatgagtattgtactagtttgcttttcaaatgctcccaaggtctcagatgaagcggtgaaaaaagattcagagttggataagcacttggaatcacgggttgaagagattatggagaagtctggcgaggaaggaatgcctgatcttgcccatgtcatgcgcatcttgtctgcagaaaatatcccaaatttgcctcctgggggaggtcttgctggcaagcgtaatgttattgaagctgtttatagtagactgaatccacatagagaaagtgatggggcctccgatgaagcagaggaaagtggatcacagggaaaattggtggaagctctcaggcaaatgagaattaatcataggggaaactaccgacaacttctggaggagatgctgactagttacaggctagctaaagtagagggagaagaaagccctgctgaaccagctgccacagctacttcttcgaacagtgatgctggaaacccagtgacaatgcaggaaagccatactgaatcagaaagtggtcttgctgaattagacagctctaatgaagatgcagggacaaagatgagtggtgaaaaaatatgactttcctttttggtaatatttttgtgatctttgatggtttttaacctaggaagtgtaatgtatgcatttatataactgttttgttatttgaatcttggaaaactagttttattatattcagatagccttgttttttaaaaaggcctttgcatacacctttatgagatagtgtaaaattgactatttatagtactatggatttaatgaaattatatgtcatttcacattgtatgccagaaattaggctaccaattatgaattaaagtcagtagttaaattaatactagatagaattagaaattttgattagagagattatgctatattatggaaaaacttgttaatgtagaattatactgcttcatattattttacctattagtacactcatagttagctttgtaataaatttatgttttctttaataattttagttcttcaaagaatggctgatgctggcctgtaatttttctttcaaggatgataatttgtgtgttgtttgatttgtttatattttacatctctgtagttttatttttagaagttgtgagatattggatgtgtggctatttttcctttctctgtattctttatgaaacataacttttgaaaaacctatgtattattcatacagctttggtttgtatattctgtatagcctaactacacacatcaaaatgtatgtcaaccaagtgtttagaatgaaattataagtgtttaagtccaaataaagcatgtgatgtggaataatcta

SEQ ID NO: 171416 - DNA, 1713 bp, Homo sapiens
  Payload ID: 13711
  Gene Symbol: PPM1B
  Gene Name: protein phosphatase, Mg2+/Mn2+ dependent, 1B
  Uniprot ID: O75688
  ENST ID: ENST00000345249
  CDS Start-End: 381-959
aaaagccgccggtgctctgacggcctcgttcccctagcagttgcgggggagtttcctgccggcgcggctggagtctctgattctcagggttcggtggttggaagatgctccagagagacgaggctgcggcggaggaggtggcggcggccgaatcggcaacggcgctagggtggagagaaggcggcatcggcggcggcggcggcgtgaggggccgggcggtgtaaacagccccggaggcggcggtcgagaccccgagggggaagcggcggctgagtcagggtcgcgcctccgttggaaacttgggctgagtaccgcggcgggcgcgagcgaggcgccctagacatcttctccctcccttgcctcagggaagtcgagataacatgagtattgtactagtttgcttttcaaatgctcccaaggtctcagatgaagcggtgaaaaaagattcagagttggataagcacttggaatcacgggttgaagagattatggagaagtctggcgaggaaggaatgcctgatcttgcccatgtcatgcgcatcttgtctgcagaaaatatcccaaatttgcctcctgggggaggtcttgctggcaagcgtaatgttattgaagctgtttatagtagactgaatccacatagagaaagtgatggggcctccgatgaagcagaggaaagtggatcacagggaaaattggtggaagctctcaggcaaatgagaattaatcataggggaaactaccgacaacttctggaggagatgctgactagttacaggctagctaaagtagagggagaagaaagccctgctgaaccagctgccacagctacttcttcgaacagtgatgctggaaacccagtgacaatgcaggaaagccatactgaatcagaaagtggtcttgctgaattagacagctctaatgaagatgcagggacaaagatgagtggtgaaaaaatatgactttcctttttggtaatatttttgtgatctttgatggtttttaacctaggaagtgtaatgtatgcatttatataactgttttgttatttgaatcttggaaaactagttttattatattcagatagccttgttttttaaaaaggcctttgcatacacctttatgagatagtgtaaaattgactatttatagtactatggatttaatgaaattatatgtcatttcacattgtatgccagaaattaggctaccaattatgaattaaagtcagtagttaaattaatactagatagaattagaaattttgattagagagattatgctatattatggaaaaacttgttaatgtagaattatactgcttcatattattttacctattagtacactcatagttagctttgtaataaatttatgttttctttaataattttagttcttcaaagaatggctgatgctggcctgtaatttttctttcaaggatgataatttgtgtgttgtttgatttgtttatattttacatctctgtagttttatttttagaagttgtgagatattggatgtgtggctatttttcctttctctgtattctttatgaaacataacttttgaaaaacctatgtattattcatacagctttggtttgtatattctgtatagcctaactacacacatcaaaatgtatgtcaaccaagtgtttagaatgaaattataagtgtttaagtccaaataaagcatgtgatgtggaataatcta

SEQ ID NO: 171417 - DNA, 3877 bp, Homo sapiens
  Payload ID: 13711
  Gene Symbol: PPM1B
  Gene Name: protein phosphatase, Mg2+/Mn2+ dependent, 1B
  Uniprot ID: O75688
  ENST ID: ENST00000378551
  CDS Start-End: 413-1576
aaaaggagccgagcggcttctgctcaatggcggaaaagccgccggtgctctgacggcctcgttcccctagcagttgcgggggagtttcctgccggcgcggctggagtctctgattctcagggttcggtggttggaagatgctccagagagacgaggctgcggcggaggaggtggcggcggccgaatcggcaacggcgctagggtggagagaaggcggcatcggcggcggcggcggcgtgaggggccgggcggtgtaaacagccccggaggcggcggtcgagaccccgagggggaagcggcggctgagtcagggtcgcgcctccgttggaaacttgggctgagtaccgcggcgggcgcgagcgaggcgccctagacatcttctccctcccttgcctcagatttattgctaaacatgggtgcatttttggataaacccaaaactgaaaaacataatgctcatggtgctgggaatggtttacgttatggcctgagcagcatgcaaggatggagagtggaaatggaagatgcacacacagctgttgtaggtattcctcacggcttggaagactggtcattttttgcagtttatgatggtcatgctggatcccgagtggcaaattactgctcaacacatttattagaacacatcactactaacgaagactttagggcagctggaaaatcaggatctgctcttgagctttcagtggaaaatgttaagaatggtatcagaactggatttttgaaaattgatgaatacatgcgtaacttttcagacctcagaaacgggatggacaggagtggttcaactgcagtgggagttatgatttcacctaagcatatctactttatcaactgtggtgattcacgtgctgttctgtataggaatggacaagtctgcttttctacccaggatcacaaaccttgcaatccaagggaaaaggagcgaatccaaaatgcaggaggcagcgtgatgatacaacgtgttaatggttcattagcagtatctcgtgctctgggggactatgattacaagtgtgttgatggcaagggcccaacagaacaacttgtttctccagagcctgaggtttatgaaattttaagagcagaagaggatgaatttatcatcttggcttgtgatgggatctgggatgttatgagtaatgaggagctctgtgaatatgttaaatctaggcttgaggtatctgatgacctggaaaatgtgtgcaattgggtagtggacacttgtttacacaagggaagtcgagataacatgagtattgtactagtttgcttttcaaatgctcccaaggtctcagatgaagcggtgaaaaaagattcagagttggataagcacttggaatcacgggttgaagagattatggagaagtctggcgaggaaggaatgcctgatcttgcccatgtcatgcgcatcttgtctgcagaaaatatcccaaatttgcctcctgggggaggtcttgctggcaagcgtaatgttattgaagctgtttatagtagactgaatccacatagagaaagtgatgggggtgctggagatctagaagacccatggtagccttaaaaaccttctaaaatgcttttgattctgaaaattgggggaaaaaacttttaatcacaattttcttcaatacaaggggaaaatattcttgcggattcccaacgttttgtgatatgagcagaaaatcattagcatttcccatcatttgttcatatttgtgttttctgacagttgccacttgtagcattgcctgtactacagtattttttgccaacctcaggcatactcgttacatctgtattgaactttcggccctagaaaccagtggagttatttcaccacaaatcaacaatgtgcctgaggtgcatgggaaatatagttagctatactctgaaaatacattatgttttttttctttaaacaaaacacacaacatgtaagcatgtaagagtaaagaattgtatgatatgttccttttttcagttcaccaagttggaagccttttgcagctctgtggcttggaatttcatttgagcaatttctataggatatgtatttattattgattgttatttaatttttttccaattttacctgtattaccaaactgggttctccaataatgtccaaattgtaatgttgccttgcttcaagataaagtgtatttgggaataatattataaacccttacaaattttatgcatgtatctactgcatccttcaactctcactagaaaatcttttgaaaccaaatggattaatttatggctatttataatttgctttgacatctcactgttggaaattttttaaagatgagatttgcctttataatgtaaattgtgatttttgttttacatgtgggtttctatagttttaattttttcagcttttaagatacgagttttgtgtaatttggtatttttaatcatttatgttattttaaaagctcagaatatcacattgaaattactataaatacatttaaaattatctattttagatctaaggaaatactacagagatattttcatgggttcagtaacttttcattttataacattgggcacggtacagagtgattgtcacataaggtacttgaagatttattagtttaattctatttttacagtaaccttgaattcttctgagttttgcatgtattaaattcaattaatgctgaacatgaagagtaaagtatttatctgaaagaagtttctgggttaggagaagtaatgaatgtatccatttgtacatggtttacatgttgtggatgctttgtaaacattttcctgtatgtttaaattgtgtttcagcaggatgtaattgcccttgtgtgtagttaaaatgagtcatcatctggtcctttgtgaaatggaattcatggtattttctgtaacgttttcctgaagctgtttctggagagccacacatttaaatacagacagctttcctgatcatttgatttattgtgcacctgatttttggtctaaaaggaattattgccacaatatattttatttattctttagattttagccttgtaagttaaagtgctttacatgatgatgtgaaaagctgtttgtccctttactgggtttggggggttgttaaaagatagggaatgaagaatgcaaaatggtttatcgttcaaactgtccactctgatccaaccctgtactgatagtacttcccagtatgatattgtgatgtttcatacaatgcagtgaacataaccaacttgttacctaaataaagaattgataaaaacagtgtgacatattactatttggtatgattcagtttttaatgttattttaaacttcttatatggttggcatatttctgaaaatttaattccaaagaggaattaaccaaactgtacaggacaatattaaccccttctgtactctagaaatatttatactccttttaaaaaaacctgcctttggccgggtgcattggctcacacctgtaatcccagcactttgggaggccaaggcgggtggatcacgaggtcaagagatcgtgaccatcctggccaacacggtgaaaccctgcctctactaaaaatacaaagattagctgggcatggtggtgcttgcctgtaatcccagctgcttgggaggctgaggcagaagaattgcttgaacccaggaggcggaggttgcagtgagctaagatcgcgccactgcactccagcctggcgacagagcgagactccgtctcaaaaaaaaaaaaaaagaaaaaaaaaaacttttccggcagggggcagggtgggggttactggtgcttgaaacagaaataatgtatgagttagtaaaagaaaaacccatattcagtgttgactcatctgaa

SEQ ID NO: 171418 - DNA, 923 bp, Homo sapiens
  Payload ID: 13711
  Gene Symbol: PPM1B
  Gene Name: protein phosphatase, Mg2+/Mn2+ dependent, 1B
  ENST ID: ENST00000409473
  CDS Start-End: 15-923
atttattgctaaacatgggtgcatttttggataaacccaaaactgaaaaacataatgctcatggtgctgggaatggtttacgttatggcctgagcagcatgcaaggatggagagtggaaatggaagatgcacacacagctgttgtaggtattcctcacggcttggaagactggtcattttttgcagtttatgatggtcatgctggatcccgagtggcaaattactgctcaacacatttattagaacacatcactactaacgaagactttagggcagctggaaaatcaggatctgctcttgagctttcagtggaaaatgttaagaatggtatcagaactggatttttgaaaattgatgaatacatgcgtaacttttcagacctcagaaacgggatggacaggagtggttcaactgcagtgggagttatgatttcacctaagcatatctactttatcaactgtggtgattcacgtgctgttctgtataggaatggacaagtctgcttttctacccaggatcacaaaccttgcaatccaagggaaaaggagcgaatccaaaatgcaggaggcagcgtgatgatacaacgtgttaatggttcattagcagtatctcgtgctctgggggactatgattacaagtgtgttgatggcaagggcccaacagaacaacttgtttctccagagcctgaggtctcagatgaagcggtgaaaaaagattcagagttggataagcacttggaatcacgggttgaagagattatggagaagtctggcgaggaaggaatgcctgatcttgcccatgtcatgcgcatcttgtctgcagaaaatatcccaaatttgcctcctgggggaggtcttgctggcaagcgtaatgttattgaagctgtttatagtagactgaatccacatagagaaagtgatggg

SEQ ID NO: 171419 - DNA, 3025 bp, Homo sapiens
  Payload ID: 13711
  Gene Symbol: PPM1B
  Gene Name: protein phosphatase, Mg2+/Mn2+ dependent, 1B
  Uniprot ID: O75688
  ENST ID: ENST00000409432
  CDS Start-End: 413-1555
aaaaggagccgagcggcttctgctcaatggcggaaaagccgccggtgctctgacggcctcgttcccctagcagttgcgggggagtttcctgccggcgcggctggagtctctgattctcagggttcggtggttggaagatgctccagagagacgaggctgcggcggaggaggtggcggcggccgaatcggcaacggcgctagggtggagagaaggcggcatcggcggcggcggcggcgtgaggggccgggcggtgtaaacagccccggaggcggcggtcgagaccccgagggggaagcggcggctgagtcagggtcgcgcctccgttggaaacttgggctgagtaccgcggcgggcgcgagcgaggcgccctagacatcttctccctcccttgcctcagatttattgctaaacatgggtgcatttttggataaacccaaaactgaaaaacataatgctcatggtgctgggaatggtttacgttatggcctgagcagcatgcaaggatggagagtggaaatggaagatgcacacacagctgttgtaggtattcctcacggcttggaagactggtcattttttgcagtttatgatggtcatgctggatcccgagtggcaaattactgctcaacacatttattagaacacatcactactaacgaagactttagggcagctggaaaatcaggatctgctcttgagctttcagtggaaaatgttaagaatggtatcagaactggatttttgaaaattgatgaatacatgcgtaacttttcagacctcagaaacgggatggacaggagtggttcaactgcagtgggagttatgatttcacctaagcatatctactttatcaactgtggtgattcacgtgctgttctgtataggaatggacaagtctgcttttctacccaggatcacaaaccttgcaatccaagggaaaaggagcgaatccaaaatgcaggaggcagcgtgatgatacaacgtgttaatggttcattagcagtatctcgtgctctgggggactatgattacaagtgtgttgatggcaagggcccaacagaacaacttgtttctccagagcctgaggtttatgaaattttaagagcagaagaggatgaatttatcatcttggcttgtgatgggatctgggatgttatgagtaatgaggagctctgtgaatatgttaaatctaggcttgaggtatctgatgacctggaaaatgtgtgcaattgggtagtggacacttgtttacacaagggaagtcgagataacatgagtattgtactagtttgcttttcaaatgctcccaaggtctcagatgaagcggtgaaaaaagattcagagttggataagcacttggaatcacgggttgaagagattatggagaagtctggcgaggaaggaatgcctgatcttgcccatgtcatgcgcatcttgtctgcagaaaatatcccaaatttgcctcctgggggaggtcttgctggcaagcgtaatgttattgaagctgtttatagtagactgaatccacatagagaaagtgatgggcagaaatgatgaagaaactgttctgatggcctgcttttctgtccttttcctactgctttaaacattgattttcttttgtactaaatcatatagccaaatattgtttaagtaagtcagttttaggaaatgcttgtgttgctgttgaattataaaagctgagtaaatttcagattaaactttaaatgactgtgaaataagacataaactagttaatggtaatttgcttaaaatgacttgagattattattggaagtttttattaattgatacaggtaagaattgatatttaataaaatgttctcatgcttagactatattacttttcggtagagaaattagtattttgctgtaatgtgttatgaaatacatgtgatatcctagtttgtctactgacactggggtcttgaatcttaaaaaaaggcctccgatgaagcagaggaaagtggatcacagggaaaattggtggaagctctcaggcaaatgagaattaatcataggggaaactaccgacaacttctggaggagatgctgactagttacaggctagctaaagtagagggagaagaaagccctgctgaaccagctgccacagctacttcttcgaacagtgatgctggaaacccagtgacaatgcaggaaagccatactgaatcagaaagtggtcttgctgaattagacagctctaatgaagatgcagggacaaagatgagtggtgaaaaaatatgactttcctttttggtaatatttttgtgatctttgatggtttttaacctaggaagtgtaatgtatgcatttatataactgttttgttatttgaatcttggaaaactagttttattatattcagatagccttgttttttaaaaaggcctttgcatacacctttatgagatagtgtaaaattgactatttatagtactatggatttaatgaaattatatgtcatttcacattgtatgccagaaattaggctaccaattatgaattaaagtcagtagttaaattaatactagatagaattagaaattttgattagagagattatgctatattatggaaaaacttgttaatgtagaattatactgcttcatattattttacctattagtacactcatagttagctttgtaataaatttatgttttctttaataattttagttcttcaaagaatggctgatgctggcctgtaatttttctttcaaggatgataatttgtgtgttgtttgatttgtttatattttacatctctgtagttttatttttagaagttgtgagatattggatgtgtggctatttttcctttctctgtattctttatgaaacataacttttgaaaaacctatgtattattcatacagctttggtttgtatattctgtatagcctaactacacacatcaaaatgtatgtcaaccaagtgtttagaatgaaattataagtgtttaagtccaaataaagcatgtgatgtggaataatct

SEQ ID NO: 171420 - DNA, 2084 bp, Homo sapiens
  Payload ID: 13711
  Gene Symbol: PPM1B
  Gene Name: protein phosphatase, Mg2+/Mn2+ dependent, 1B
  ENST ID: ENST00000419807
  CDS Start-End: 951-2084
ggctgaagcaaaacaaccgcctctcccctgcccacttcttgtcctcgtctgagtcgtcccttcccgtctccacgccgaagagaggcgtttagatcctccaatgagggcctaggaggactttcttagccaatcagtagccaagcccctgcaattccgggtgggaccaggcgtccacacctatagctggactgctcgttggtcccttatggcgcttcttttacgcgaggcttagaggtcaaatacaagggggcacggtcctcacagaacggaaaggatccgtacagactctccgggtttgaccgttttctaggacgaaccaatcgctttccagatacttccccgccttttgcgcgttcatttgaaaaaagccggtgtgacggacttggaaattggctcagtgactgacccgcaagaaagccagtgactgggggttcggatcacgagttggaccaataagaaaagacaatcgctggggccggggctttgctaggaggagcgcaggtgggcgttatttgattgacggagggctctacttatggctggtagcgggggctggtccctgacgttcgggaggtaggacctagcggaggcggggccgaataaagtaaatgttgcgggggagtttcctgccggcgcggctggagtctctgattctcagggttcggtggttggaagatgctccagagagacgaggctgcggcggaggaggtggcggcggccgaatcggcaacggcgctagggtggagagaaggcggcatcggcggcggcggcggcgtgaggggccgggcggtgtaaacagccccggaggcggcggtcgagaccccgagggggaagcggcggctgagtcagggtcgcgcctccgttggaaacttgggctgagtaccgcggcgggcgcgagcgaggcgccctagacatcttctccctcccttgcctcagatttattgctaaacatgggtgcatttttggataaacccaaaactgaaaaacataatgctcatggtgctgggaatggtttacgttatggcctgagcagcatgcaaggatggagagtggaaatggaagatgcacacacagctgttgtaggtattcctcacggcttggaagactggtcattttttgcagtttatgatggtcatgctggatcccgagtggcaaattactgctcaacacatttattagaacacatcactactaacgaagactttagggcagctggaaaatcaggatctgctcttgagctttcagtggaaaatgttaagaatggtatcagaactggatttttgaaaattgatgaatacatgcgtaacttttcagacctcagaaacgggatggacaggagtggttcaactgcagtgggagttatgatttcacctaagcatatctactttatcaactgtggtgattcacgtgctgttctgtataggaatggacaagtctgcttttctacccaggatcacaaaccttgcaatccaagggaaaaggagcgaatccaaaatgcaggaggcagcgtgatgatacaacgtgttaatggttcattagcagtatctcgtgctctgggggactatgattacaagtgtgttgatggcaagggcccaacagaacaacttgtttctccagagcctgaggtttatgaaattttaagagcagaagaggatgaatttatcatcttggcttgtgatgggatctgggatgttatgagtaatgaggagctctgtgaatatgttaaatctaggcttgaggtatctgatgacctggaaaatgtgtgcaattgggtagtggacacttgtttacacaagggaagtcgagataacatgagtattgtactagtttgcttttcaaatgctcccaaggtctcagatgaagcggtgaaaaaagattcagagttggataagcacttggaatcacgggttgaagagattatggagaagtctggcgaggaaggaatgcctgatcttgcccatgtcatgcgcatcttgtctgcagaaaatatcccaaatttgcctcctgggggaggtcttgctggcaagcgtaatgttattgaagctgtttatagtagactgaatccacatagagaaagtgatggg

SEQ ID NO: 171421 - DNA, 4778 bp, Homo sapiens
  Payload ID: 13712
  Gene Symbol: PPM1D
  Gene Name: protein phosphatase, Mg2+/Mn2+ dependent, 1D
  Uniprot ID: O15297
  ENST ID: ENST00000305921
  CDS Start-End: 233-2050
ggggaagcgcagtgcgcaggcgcaactgcctggctctgctcgctccggcgctccggcccagctctcgcggacaagtccagacatcgcgcgcccccccttctccgggtccgccccctcccccttctcggcgtcgtcgaagataaacaatagttggccggcgagcgcctagtgtgtctcccgccgccggattcggcgggctgcgtgggaccggcgggatcccggccagccggccatggcggggctgtactcgctgggagtgagcgtcttctccgaccagggcgggaggaagtacatggaggacgttactcaaatcgttgtggagcccgaaccgacggctgaagaaaagccctcgccgcggcggtcgctgtctcagccgttgcctccgcggccgtcgccggccgcccttcccggcggcgaagtctcggggaaaggcccagcggtggcagcccgagaggctcgcgaccctctcccggacgccggggcctcgccggcacctagccgctgctgccgccgccgttcctccgtggcctttttcgccgtgtgcgacgggcacggcgggcgggaggcggcacagtttgcccgggagcacttgtggggtttcatcaagaagcagaagggtttcacctcgtccgagccggctaaggtttgcgctgccatccgcaaaggctttctcgcttgtcaccttgccatgtggaagaaactggcggaatggccaaagactatgacgggtcttcctagcacatcagggacaactgccagtgtggtcatcattcggggcatgaagatgtatgtagctcacgtaggtgactcaggggtggttcttggaattcaggatgacccgaaggatgactttgtcagagctgtggaggtgacacaggaccataagccagaacttcccaaggaaagagaacgaatcgaaggacttggtgggagtgtaatgaacaagtctggggtgaatcgtgtagtttggaaacgacctcgactcactcacaatggacctgttagaaggagcacagttattgaccagattccttttctggcagtagcaagagcacttggtgatttgtggagctatgatttcttcagtggtgaatttgtggtgtcacctgaaccagacacaagtgtccacactcttgaccctcagaagcacaagtatattatattggggagtgatggactttggaatatgattccaccacaagatgccatctcaatgtgccaggaccaagaggagaaaaaatacctgatgggtgagcatggacaatcttgtgccaaaatgcttgtgaatcgagcattgggccgctggaggcagcgtatgctccgagcagataacactagtgccatagtaatctgcatctctccagaagtggacaatcagggaaactttaccaatgaagatgagttatacctgaacctgactgacagcccttcctataatagtcaagaaacctgtgtgatgactccttccccatgttctacaccaccagtcaagtcactggaggaggatccatggccaagggtgaattctaaggaccatatacctgccctggttcgtagcaatgccttctcagagaattttttagaggtttcagctgagatagctcgagagaatgtccaaggtgtagtcataccctcaaaagatccagaaccacttgaagaaaattgcgctaaagccctgactttaaggatacatgattctttgaataatagccttccaattggccttgtgcctactaattcaacaaacactgtcatggaccaaaaaaatttgaagatgtcaactcctggccaaatgaaagcccaagaaattgaaagaacccctccaacaaactttaaaaggacattagaagagtccaattctggccccctgatgaagaagcatagacgaaatggcttaagtcgaagtagtggtgctcagcctgcaagtctccccacaacctcacagcgaaagaactctgttaaactcaccatgcgacgcagacttaggggccagaagaaaattggaaatcctttacttcatcaacacaggaaaactgtttgtgtttgctgaaatgcatctgggaaatgaggtttttccaaacttaggatataagagggctttttaaatttggtgccgatgttgaactttttttaaggggagaaaattaaaagaaatatacagtttgactttttggaattcagcagttttatcctggccttgtacttgcttgtattgtaaatgtggattttgtagatgttagggtataagttgctgtaaaatttgtgtaaatttgtatccacacaaattcagtctctgaatacacagtattcagagtctctgatacacagtaattgtgacaatagggctaaatgtttaaagaaatcaaaagaatctattagattttagaaaaacatttaaactttttaaaatacttattaaaaaatttgtataagccacttgtcttgaaaactgtgcaactttttaaagtaaattattaagcagactggaaaagtgatgtattttcatagtgacctgtgtttcacttaatgtttcttagagccaagtgtcttttaaacattattttttatttctgatttcataattcagaactaaatttttcatagaagtgttgagccatgctacagttagtcttgtcccaattaaaatactatgcagtatctcttacatcagtagcatttttctaaaaccttagtcatcagatatgcttactaaatcttcagcatagaaggaagtgtgtttgcctaaaacaatctaaaacaattcccttctttttcatcccagaccaatggcattattaggtcttaaagtagttactcccttctcgtgtttgcttaaaatatgtgaagttttccttgctatttcaataacagatggtgctgctaattcccaacatttcttaaattattttatatcatacagttttcattgattatatgggtatatattcatctaataaatcagtgaactgttcctcatgttgctgaatttgtagttgttggtttattttaatggtatgtacaagttgagtatcccttatccaaaatgcttgggaccagaagtgtttcagattttttaaaattttggaatatttgctttatactgagcttttgagtgttcccaatctgaaattcaaaatgctctaatgagcatttcctttgagcatcatgcctgctctgaaaaagtttctgattctggagcattttggattttggattttcagattagggatgcttaacctggattaacattctgttgtgccatgatcatgctttacagtgagtgtattttatttatttattattttgtttgtttgtttgagatggagtctcactctgtcatccaggctagagtgcagtggcgtgatctcggctgactgcaacctctgcctcccgggttcaagtgattctcctgcctcaatctctctccccagaagctgggattacaggtgtgtgccaccacacccggctaatttttttttttttttttgagatggagtctagctctgtcatccaggctggagtgcagtggtgtgatctcggctccctgcaacctctgccttctgggttcctgcgattctcctgcctcagcctcctgagtagctgagattacaggcacgcgccactgtgcccagccaatttttgtatttttagtagagatggggtttcacatgtcagtcatgctggtcttgatctcctgacctcgtgatccacccgcctcgacctcccaaagtactgggattacaggcgtgagccaccgcatccggcctgagttttatgctttcaatgtatttcttacatttcagttcaagtgattttcatgtctcagcctcctgagtagctggaactacaggtgcgtgccaccatgcctggctaagttttgtatttttagtagagatgggttttcatcatgttggccaagatggtcttgatctcttgacctcatgatccaccagcctaggcctcccaaagtgctgggattacaggtgtgagccaccgtgcccagccaactatgccattatttaaccatgtccacacattctggttattttcaatattttgcagaagataattcttgatcggtgtgtcttatgccacaaggattaaaatatgtattcattgctacaaaacaatatctcgaaatttagcagtttaaaacaacaaatattatctccagtttctgagcctcagaaatctgagagtggtttagctgggtgatagtctcgtggttttggtcaagctaccaaccagggctacaatctttcgaaggtgtcattggggctagaagatctgcttcccgcaagactcacagctgttggcaggagacctcagtttgttgccacatgttcccctccagagggcctctcacaacatggcagttatttgtccccagagcaagcaacaccggagggcaaggaagaagccatgatgttttttgtaacctagcctctgaaagtgtcataccaattctgtattttgttggtcacacagaccaagtcaactacaacgtgggagactcctacacaaggcatgaattctaggaggtgggcatttttaagtgtcatctggaaggaggctgtcacaacctggaagttaaaagcattgatattctgaaatacagcgtgtataacattgttttagtagggtgtgcaatagttatgttttggtaatagcattaatgaacaatgttattttcatcttccagacatctggaagattgctctagtggagtaaaacatcttaatgtattttgtccctaaataaactatctcactaacaaa

SEQ ID NO: 171422 - DNA, 2996 bp, Homo sapiens
  Payload ID: 13712
  Gene Symbol: PPM1D
  Gene Name: protein phosphatase, Mg2+/Mn2+ dependent, 1D
  Uniprot ID: O15297
  ENST ID: ENST00000392995
  CDS Start-End: 147-1439
cgcgcccccccttctccgggtccgccccctcccccttctcggcgtcgtcgaagataaacaatagttggccggcgagcgcctagtgtgtctcccgccgccggattcggcgggctgcgtgggaccggcgggatcccggccagccggccatggcggggctgtactcgctgggagtgagcgtcttctccgaccagggcgggaggaagtacatggaggacgttactcaaatcgttgtggagcccgaaccgacggctgaagaaaagccctcgccgcggcggtcgctgtctcagccgttgcctccgcggccgtcgccggccgcccttcccggcggcgaagtctcggggaaaggcccagcggtggcagcccgagaggctcgcgaccctctcccggacgccggggcctcgccggcacctagccgctgctgccgccgccgttcctccgtggcctttttcgccgtgtgcgacgggcacggcgggcgggaggcggcacagtttgcccgggagcacttgtggggtttcatcaagaagcagaagggtttcacctcgtccgagccggctaaggtttgcgctgccatccgcaaaggctttctcgcttgtcaccttgccatgtggaagaaactggcggaatggccaaagactatgacgggtcttcctagcacatcagggacaactgccagtgtggtcatcattcggggcatgaagatgtatgtagctcacgtaggtgactcaggggtggttcttggaattcaggatgacccgaaggatgactttgtcagagctgtggaggtgacacaggaccataagccagaacttcccaaggaaagagaacgaatcgaaggacttggtgggagtgtaatgaacaagtctggggtgaatcgtgtagtttggaaacgacctcgactcactcacaatggacctgttagaaggagcacagttattgaccagattccttttctggcagtagcaagagcacttggtgatttgtggagctatgatttcttcagtggtgaatttgtggtgtcacctgaaccagacacaagtgtccacactcttgaccctcagaagcacaagtatattatattggggagtgatggactttggaatatgattccaccacaagatgccatctcaatgtgccaggaccaagaggagaaaaaatacctgatgggtgagcatggacaatcttgtgccaaaatgcttgtgaatcgagcattgggccgctggaggcagcgtatgctccgagcagataacactagtgccatagtaatctgcatctctccagaagtggacaatcagggaaactttaccaatgaagatgagttatacctgaacctgactgacagcccttcctataatagtcaagaaacctgtgtgatgactccttccccatgttctacaccaccagtcaaggattttggatttgaactcgattcaagaaagtgatgtaacttattatcagagagccatctttacatcaatactaatctgaatgccagccatgtgtacagcactaataaaaagtcactggaggaggatccatggccaagggtgaattctaaggaccatatacctgccctggttcgtagcaatgccttctcagagaattttttagaggtttcagctgagatagctcgagagaatgtccaaggtgtagtcataccctcaaaagatccagaaccacttgaagaaaattgcgctaaagccctgactttaaggatacatgattctttgaataatagccttccaattggccttgtgcctactaattcaacaaacactgtcatggaccaaaaaaatttgaagatgtcaactcctggccaaatgaaagcccaagaaattgaaagaacccctccaacaaactttaaaaggacattagaagagtccaattctggccccctgatgaagaagcatagacgaaatggcttaagtcgaagtagtggtgctcagcctgcaagtctccccacaacctcacagcgaaagaactctgttaaactcaccatgcgacgcagacttaggggccagaagaaaattggaaatcctttacttcatcaacacaggaaaactgtttgtgtttgctgaaatgcatctgggaaatgaggtttttccaaacttaggatataagagggctttttaaatttggtgccgatgttgaactttttttaaggggagaaaattaaaagaaatatacagtttgactttttggaattcagcagttttatcctggccttgtacttgcttgtattgtaaatgtggattttgtagatgttagggtataagttgctgtaaaatttgtgtaaatttgtatccacacaaattcagtctctgaatacacagtattcagagtctctgatacacagtaattgtgacaatagggctaaatgtttaaagaaatcaaaagaatctattagattttagaaaaacatttaaactttttaaaatacttattaaaaaatttgtataagccacttgtcttgaaaactgtgcaactttttaaagtaaattattaagcagactggaaaagtgatgtattttcatagtgacctgtgtttcacttaatgtttcttagagccaagtgtcttttaaacattattttttatttctgatttcataattcagaactaaatttttcatagaagtgttgagccatgctacagttagtcttgtcccaattaaaatactatgcagtatctcttacatcagtagcatttttctaaaaccttagtcatcagatatgcttactaaatcttcagcatagaaggaagtgtgtttgcctaaaacaatctaaaacaattcccttctttttcatcccagaccaatggcattattaggtcttaaagtagttactcccttctcgtgtttgcttaaaatatgtgaagttttccttgctatttcaataacagatggtgctgctaattcccaacatttcttaaattattttatatcatacagttttcattgattatatgggtatatattcatctaataaatcagtgaactgtt

SEQ ID NO: 171423 - DNA, 489 bp, Homo sapiens
  Payload ID: 13712
  Gene Symbol: PPM1D
  Gene Name: protein phosphatase, Mg2+/Mn2+ dependent, 1D
  ENST ID: ENST00000590418
  CDS Start-End: 113-489
atacaaaataaaaaattagcttggcatggtagcatgtgcgtgtagtctctgctactccagaggctgagatggagggattgcttgagcctgggaggtggggttacagtgaaccatgatggagcctgtgcactcagcctgggcaacagaagaaaaaacggaatggccaaagactatgacgggtcttcctagcacatcagggacaactgccagtgtggtcatcattcggggcatgaagatgtatgtagctcacgtaggtgactcaggggtggttcttggaattcaggatgacccgaaggatgactttgtcagagctgtggaggtgacacaggaccataagccagaacttcccaaggaaagagaacgaatcgaaggacttggtgggagtgtaatgaacaagtctggggtgaatcgtgtagtttggaaacgacctcgactcactcacaatggacctgttagaaggagcacagttattgaccagattccttttct

SEQ ID NO: 171424 - DNA, 1525 bp, Homo sapiens
  Payload ID: 13712
  Gene Symbol: PPM1D
  Gene Name: protein phosphatase, Mg2+/Mn2+ dependent, 1D
  Uniprot ID: O15297
  ENST ID: ENST00000629650
  CDS Start-End: 233-1525
ggggaagcgcagtgcgcaggcgcaactgcctggctctgctcgctccggcgctccggcccagctctcgcggacaagtccagacatcgcgcgcccccccttctccgggtccgccccctcccccttctcggcgtcgtcgaagataaacaatagttggccggcgagcgcctagtgtgtctcccgccgccggattcggcgggctgcgtgggaccggcgggatcccggccagccggccatggcggggctgtactcgctgggagtgagcgtcttctccgaccagggcgggaggaagtacatggaggacgttactcaaatcgttgtggagcccgaaccgacggctgaagaaaagccctcgccgcggcggtcgctgtctcagccgttgcctccgcggccgtcgccggccgcccttcccggcggcgaagtctcggggaaaggcccagcggtggcagcccgagaggctcgcgaccctctcccggacgccggggcctcgccggcacctagccgctgctgccgccgccgttcctccgtggcctttttcgccgtgtgcgacgggcacggcgggcgggaggcggcacagtttgcccgggagcacttgtggggtttcatcaagaagcagaagggtttcacctcgtccgagccggctaaggtttgcgctgccatccgcaaaggctttctcgcttgtcaccttgccatgtggaagaaactggcggaatggccaaagactatgacgggtcttcctagcacatcagggacaactgccagtgtggtcatcattcggggcatgaagatgtatgtagctcacgtaggtgactcaggggtggttcttggaattcaggatgacccgaaggatgactttgtcagagctgtggaggtgacacaggaccataagccagaacttcccaaggaaagagaacgaatcgaaggacttggtgggagtgtaatgaacaagtctggggtgaatcgtgtagtttggaaacgacctcgactcactcacaatggacctgttagaaggagcacagttattgaccagattccttttctggcagtagcaagagcacttggtgatttgtggagctatgatttcttcagtggtgaatttgtggtgtcacctgaaccagacacaagtgtccacactcttgaccctcagaagcacaagtatattatattggggagtgatggactttggaatatgattccaccacaagatgccatctcaatgtgccaggaccaagaggagaaaaaatacctgatgggtgagcatggacaatcttgtgccaaaatgcttgtgaatcgagcattgggccgctggaggcagcgtatgctccgagcagataacactagtgccatagtaatctgcatctctccagaagtggacaatcagggaaactttaccaatgaagatgagttatacctgaacctgactgacagcccttcctataatagtcaagaaacctgtgtgatgactccttccccatgttctacaccaccagtcaaggattttggatttgaactcgattcaagaaagtga

SEQ ID NO: 171425 - DNA, 6542 bp, Homo sapiens
  Payload ID: 13713
  Gene Symbol: PPM1E
  Gene Name: protein phosphatase, Mg2+/Mn2+ dependent, 1E
  Uniprot ID: Q8WY54
  ENST ID: ENST00000308249
  CDS Start-End: 130-2397
agtgctgatcgctcgtgccggtgcggccgttaaccgcccttgccggagccctaggctcaaaagcagccccttacccttcctgggcttcccccaacccctttcccggtctgccctggggcatgagcagcgatggccggctgcatccctgaggagaaaacttaccggcgcttcctggagctattcctgggcgagtttcgcggaccgtgcggcggcggcgagccggagccggaacccgaacccgaacccgaacccgaacccgagtccgagcccgagcccgaacctgaactggtagaagctgaggcggccgaggcttcggtagaggaacccggggaggaggcggccacggtagccgcgacggaggagggggaccaggagcaagacccggagcccgaggaggaggcggcggttgagggtgaggaggaggaggagggcgcggcgacggcggcggcagccccggggcactcggccgtgccgccgccgccgccccagctgccgcctttgcccccgctcccgcgaccgctgtcagagcgcatcacccgcgaggaggtggagggcgaaagcctggacctgtgcctgcagcagctctacaaatataattgcccttcctttttggctgctgctttagccagagccacatcagatgaagtccttcagagtgatctttctgcacattatatcccaaaggaaacggatggcacagaagggactgtggagattgagacagtgaaattggcccgttctgtcttcagcaaactacacgagatttgctgcagctgggtgaaagacttccccctccgcaggagaccccagctttattatgagacatcaatccatgccatcaaaaacatgcgcaggaaaatggaggacaaacatgtctgcattcctgactttaatatgctcttcaacctagaggaccaggaagaacaagcttactttgcagtgtttgatggccatgggggagtagatgctgctatttatgcctccattcacctccacgttaacttagtccgccaggagatgttcccccatgatcctgctgaggccctgtgcagggccttccgggtcactgatgagcggtttgtgcagaaagcagccagggagagcttaagatgtgggaccacaggagtggtgactttcatcagaggcaacatgctacatgtggcctgggtgggtgattcccaggttatgcttgtgagaaagggccaagctgttgaactaatgaagccacacaaaccagacagagaggatgaaaagcagagaattgaggcccttggaggttgcgtagtctggtttggtgcctggagggtgaatggaagtctgtcggtttccagagctattggagatgctgaacataagccatatatctgtggggatgcagattctgcctccactgttctggatgggaccgaagactacctcattctggcctgtgatggcttctatgacaccgtgaaccctgatgaggcagtgaaagttgtgtccgaccacctgaaagagaataatggagacagcagcatggttgcccacaaattagtggcatcagctcgtgatgctgggtcaagtgataacatcacggttattgtggtattcctgagggacatgaacaaagctgtaaatgttagtgaggaatcagattggacagagaactcttttcaaggagggcaagaagatggtggggatgataaggagaatcatggagagtgcaaacgcccttggcctcagcaccagtgctcagcaccagccgacctaggctatgatgggcgtgtggattcattcactgatagaactagcctgagcccagggtcccaaatcaacgtgctggaagacccaggctacctagatctcacacaaatagaagcaagcaaacctcacagtgcccagtttttgctaccagttgagatgtttggtcctggtgcaccaaagaaagcaaatcttattaatgagttaatgatggagaaaaaatcagttcagtcatcattgcctgaatggagtggtgctggagagtttcccactgctttcaatttgggttcaacaggggagcagatatacagaatgcagagcttgtctcctgtctgttcagggttggaaaatgaacagttcaaatccccgggaaacagagtttctagattgtctcatttacgccaccactactcaaagaagtggcacagattcaggtttaatccaaagttttattcatttctctctgctcaagagccttcccacaaaataggcactagcctgtcctcacttactggaagtgggaagagaaataggataagaagttctctgccatggaggcaaaatagttggaaagggtacagtgaaaacatgaggaagctcagaaagactcatgatattccatgcccagatcttccttggagctataaaatagaataatttttctttcaagtaggttagctagctctcccccaataaaaataccactatcagagtagaaacaaggtagacatttctaaaacatatgtgcttcattatgaatccatggatggctcaattcttaaatgtaaatagatctctaggaaactcaaagtacagtgttttcaatctaaaaagaagtattggcagtttcacttgcaaaattacacagctggtccctgtgatgtgtctcgacaccaatacacaacccccttcccaccatccttcatgtcactagatacacaacccccttcccaccatcccttcagtcactagtggaagctttcaagttagttatttcagtcaggatatacagtgttgaaatctcaatgcagttgaaatctggtctgatgtgcctaatttatctgtggaaaatttaatgctgaattacatttggttgggaaatgtccctcaaaatcctgggcactatgaaggaaccccctgccccctcacctttttgggtaggtaaaagactaaaagccatatggattttaactgataacaatgaaagtggtaaatcagtgtaaaagtgtcatattctcagacttgtgaggcggtttatagtcagaaagatttacggatttttttcctgtaacataaaagattgtgaactttttttaattaaaaaatatttcctagggctgtagttatttgggagtttcataacctgttatggtgcttttggtggaaatttttattatttagcattttaggagaccgctgtcaactggttttaatctatgatgctaatgtgttttccactgtaccctcatctcaggaataaaactgctttaacggagatgatgtcaggtacaaatacactatagagtcaaaataccatttacaaagaaaatcaaaagcatttctatattttgtctttttttagttcagacagcaaaggcatgtactactataaaatacaaagtgattttagagaatgaaaaatgctacttttatcttctctaaaattatttcccccaaggtagtgaagtaattggaatgaaggaggctgaaagtattgtctaaagtgagcccagaggccactgagaatgcagattactgacagccaggtctgtttagttgtaattggaagacacatgagtgtcctgcttacatgtagcttcagactgcagagacaggacgtgtgcttttcatttcaatatttagttatatttgatattttgaaactgtctgctttttgctatttctgcagtttcaagttagttagaagcatgttgtcaactaaagacaacaaactatcagattcattcattcagtgaagcagcctctgattctctaagagtcacgaatgtcttagtgttaccctcccctagtcaacagcagaccagcctggccaatgcctatgggtggcccctctggagtgctcactaacaagggtgagtgctctcgctaagaagtgtcccccgcctaatcatgtgtttataggatagtacacgttccccaggcccataacagaggactaaaatctctgaattttaaagacacagatgactggcatattttggataccagtatagctatatcaaatagacaaaaacagcttcactttagcaatgatcagattgttaatctacagattttattttttaaaatttggatgtaagtagagactttcagtatttgttttctcttgattttgaagtcatttcttcttctcacgtctgtgacaaatggttgaaaaggagtcaacatggccccaactatagtgccggaaccttttcatcattctgaggctttgccccacacatggtcctcactcatatctgtcaccttctgaagcctagatcttgttaacccatcaggtgcagtgtcagtttcaaatcaaattatctaagaaaacaagaaaacaaaggcagcagactattggtacacattatagtccaaagtgcttagcgaagtaaaaaaaaaagctttttaaaatttctattgttgtctattggtaatgtttttgatcagaataaagagggtaaagggaaaaagttactacacatgctaggctttctcagtggggaaaaaaatggctggatagaactgggacaaacacagacccatctttaggggtctggattttgtaggtccgactacacagcagtgttaactcatttctcatgccattagctctctacaaaataaagcaaagtagttctagtgtggtcgttataaaccaatattgtgaaaaatagcaactattcatttgttcacaacatgcgtatttatagagtagttaggtaccatttgtaaggtaaatcctttaaaattctataatacatactaaaatagtggttattggtctgatatatgctgctcttggttctataaactagataaaagcagtgctttgtgaaatgcagtgttctctcttaacgccactggtgataggaagtagttcccttcagttcaaatcctgtgcccttatttgctgcttgctgacgtaagcaataagtaaccctctaactaatggtatctacatatttctgtaacttgtatttaatgatggtgtacctggtgattgtaaaaatattagacagatataaaagtatctatataatatctataaactgttaatgctgaggtatagtctgtgaattatgtgttttgtatttttattcattgtgtaatttagtggtggtgaaagttctacactcaatccttaaagagtggcagtatccctttttcaatttaacatggtctgcatcaatctgtttgcctgctaaacaagttagaataggaaatagtaaaataaatccaaacaagagtgtaatattggttagggaaacaaacttcaggtcaccaactgaagtcattacaaactccttgtacattcactgtgagtttcaaagggagtcagtccctaatttacaggtttcctttgttcactttctagatgtgtacttttgagggacatgaggttaggcaacattacagcaacacacactggggctattaatcccatttaggtctgtactaaagaggatgggtagaaacacatatgtatataccttttctttacctagaagtgccatccattgtccttgaattattatgattaaagttactgttgcatttaggaggctccttgaaagtaacaccttttccaaggacaatggcaacaatgtcaatgtcaacactgagtctaattttgaccacatttatagtggtatagtgtcaatactgcattttcatgacaaccacactccactgttgaaacactgtgccagtgagaagtgcaacatccagtgggcagatgaaaatgatgcatggccaagttcagtgtttacagataaaactgctgtggttcaagtgcttccttccccatcaaatccttgataaggctttgtgggaaaatgatctaaattattgttttaatttttaaacctaatttattcactcagtgaacattcttacctaagcaaggctataaaagggaatactacagttttgtccacactttaatttgagaccatttttctttgaatcgtaagttagcaaaagaaatttttttcacctttgaaaatcacgtgatgttaaaggacaaatgcccactcttctattctgatctgcaaatagcttaaatgtctcttgcaaaacaaagtaagataccaccagtattacaacacaatgattttccagacaaatggtatggtgttgaaaaataactgttacttcttaaagcagcattttatcttctattttgaagactatttattgtaataattagaaaacatgaaatagggaactccagactgacacagcagttgtttttgaaaaggaaataaactttgatgaattagataatccagatacatcattgtaaactcttactctaggtgctctttggtgagagacaggctttgttctcttgttcataacatttctctgcaaagaattctctatggagtgaagcgaatgaagtgaataatttcttaccaaataaatttatcaatttacaaatctgctctacatctcacttttgagttcagttgtagtcatgagtgatccttcatattttattaaaagtgttcattcaggtaaggtgtatgttgaaattttgccaattatcttaataaaacctggcaatttaaaaa

SEQ ID NO: 171426 - DNA, 5143 bp, Homo sapiens
  Payload ID: 13714
  Gene Symbol: PPM1F
  Gene Name: protein phosphatase, Mg2+/Mn2+ dependent, 1F
  Uniprot ID: P49593
  ENST ID: ENST00000263212
  CDS Start-End: 107-1471
ggacacggagccgcgaggagacagctgaggcccgcggagaccagggggtgaagcctggagaccctcttgccctggcctagctgcaggcccccgggatgctttgggcatgtcctctggagccccacagaagagcagcccaatggccagtggagctgaggagaccccaggcttcctggacacgctcctgcaagacttcccagccctgctgaacccagaggaccctctgccatggaaggccccagggacggtgctcagccaggaggaggtggagggcgagctggctgagctggccatgggctttctgggcagcaggaaggccccgccaccacttgctgctgctctggcccacgaagcagtttcacagctgctacagacagacctttccgaattcaggaagttgcccagggaggaagaagaagaggaggaggacgatgacgaggaggaaaaggcccctgtgaccttgctggatgcccaaagcctggcacagagtttctttaaccgcctttgggaagtcgccggccagtggcagaagcaggtgccattggctgcccgggcctcacagcggcagtggctggtctccatccacgccatccggaacactcgccgcaagatggaggaccggcacgtgtccctcccttccttcaaccagctcttcggcttgtctgaccctgtgaaccgcgcctactttgctgtgtttgatggtcacggaggcgtggatgctgcgaggtacgccgctgtccacgtgcacaccaacgctgcccgccagccagagctgcccacagaccctgagggagccctcagagaagccttccggcgcaccgaccagatgtttctcaggaaagccaagcgagagcggctgcagagcggcaccacaggtgtgtgtgcgctcattgcaggagcgaccctgcacgtcgcctggctcggggattcccaggtcattttggtacagcagggacaggtggtgaagctgatggagccacacagaccagaacggcaggatgagaaggcgcgcattgaagcattgggtggctttgtgtctcacatggactgctggagagtcaacgggaccctggccgtctccagagccatcggggatgtcttccagaagccctacgtgtctggggaggccgatgcagcttcccgggcgctgacgggctccgaggactacctgctgcttgcctgtgatggcttctttgacgtcgtaccccaccaggaagttgttggcctggtccagagccacctgaccaggcagcagggcagcgggctccgtgtcgccgaggagctggtggctgcggcccgggagcggggctcccacgacaacatcacggtcatggtggtcttcctcagggacccccaagagctgctggagggcgggaaccagggagaaggggacccccaggcagaagggaggaggcaggacttgccctccagccttccagaacctgagacccaggctccaccaagaagctaggtggtttccaggcccctgccctccccttcctcccatccttgtccttctctccctcagaagcctcaggacccaacaggtggcaggcagtggacagggtgcccgccccacagtgctttccccagcaccccagagccagtcgggacaccccccgcagcccgtcctggtggctgtggaactgcactgggtggcgggcagatggtggaaggcagcttaggagacctcaccaaagagaagatggaccggctcttgctcccagctcctattaggcccggggtgggaccagaggtcataggtgcccaacggcagccaaaccaaagacactggtgtgcatggggcagcatggttgtgcacgtgggaccctggggcggacccaggagccaaactcttgaagcaccccctgggtcaggcccagcagcggagtggccagccccagtttcccattgctcctctctgcggccagggccaggtgggttcatatttacagatatgcccagccagtcctggtcggccacaccagtgtcccaaagaggagagcgcagcagagccaggggtctgttctgtagcagccacccccctgcccccactccagggcagccatgatgtgcttgggcccaccagggccttccgggctgctctcttccctgagcccggaaccggcgacgcacatgtgtcttttgttggtgtgtttgtttttttccagggaggtctaattccgaagcagtattccaggttttctctttgttttatcagtgccaagatgacctgttgtgtcatataatttaagcagagcttagcatttattttattctttagaaaacttaagtatttacttttttaaagctatttttcaaggaacctttttttgcagtattattgaatttattttctaaatcaggattgaaacaggaacttttccaggtggtgttaataagccattcaagtgccttacacagctttgaagaaactaggactgcagtgggctcggataggcccattgaggtttttagaaaagcaggatttgttttgttagggaggcatgattttggtgagatctttctggaagagttttccgcctctttgtgatgctgaacacccccaaggttctcccctccccccgctgcccaggtgactggcaggagctgcgactgccacgtagtggtgcctgggcccgacagcggggctctgggcatcccgggtgaccttggcccatctgcctgcattcccacccccttgggcctggctggatcccaggcagagggaccttgctgctgtgtgattggaacattcccaaatatcttgtgaatttgtaatcaaattggtctcattgggaaagactcttaattaagaggctcaggcaagcacagaggcagcccgtgggtctctgtctcagtctggaggcagcagggatgctgctgggagtccatggcacaggccacagcccctcaccttgccgcggtggctggcagcacgcctgccttgctctgccccatgccctgaacaggcatgagagctccacgtcccctagtgcaccctgagagggggctcacaagtgaccgatcctgggtgcctcagggagctcactgagggcgtgcaaagttgaaagtggcaaggctgggggagggtgtcgggtagagggaagagggcagggggctaggggaggactcagaggccatctgcagggccaagccacaggaagggctgagctggaggtgggcagggctgctccaggcaggtcagagcagtgcagggggaggagaggagaaagggaggaagctgggctgtgtggtccccatgaaggcattcagagtccacctgcagacagcgagagccccaggaaggtttgcacagctgtgccccaagcaccttggcctcctctcagctcgccgaggaggcacgctagagccgccttcccggtgggagccctctgtcccacagggagcggggagccagctttgctggggccctacctgcatgcccagccttacccctcattctcacagcacagatgaggttgagaccatgcagtcaatgcattgcttaaggtctcttatttacaaaaaaaaaccttaaacatagtcgctgtcattcagacattcagagaatggttggccacaaacaatgaccaagtattgcttggcttaacttgaaggcctgctgtctccttctgggggtcagggacgcagctccaccctcaccactagcccaccctgcccgtgggcataaccttgacgaagagagagaatgattggcatctgcttttctcttttctttgctaataattctgttcctggctgccgagagtgaagtttcaccatgtggaggtttggctcctatcacctggtggtctgattcataccctagcctgaggctccactggaagatctcgcagcctcagtgtatgggaaaccctttccccaggcttgtcccagcactgccgctccccacccctgagccaggaccccagaggatggccatgccccgtgcctggcagaggtctggtgccagcactgggagctgctccgcccttgccttggggccgagggagccctcgtccacccctgcacagcagctgggcacagaggagcgctcttccatcttgaccaggactgcaccaagaagcaccaggtgtcttcagcctccaacctccggggcgaccttctcttccagccacagtcccatgagggcccctagccagggacactggtctgtaaattgtaatcctttctccagcccagctctccacttgttccttgtgtgagctgagcaggcagtgcacctctgagtgtcccttttgtaaggcccaggggttgcactgagtctgcagaggccgcgacctcctagaacgctgtgggtgcaggtgagccggcgtgtcctggggagatgctgccagcacacaggggccctcctgctgccagcaggttggggtggttaagtcttattagtgtctattcttaaaattaagtgggctggagaagaatggagctccacatgccagcaccgtatatggaatacaaaagctggggaagcagggcctgccttacaggtgtggctgactctgagcccaggcctgcaggggtggagggcagtccctcagaatcccagaggcagtcccagcctcagaacccaggataggaaatgggtgtgtttagtggggaaagggacggggtgcagacggcagggccagtatggggccccctccctctcctctcctctcctatggtgagcccagcgtgggcaccgggccgtctcagccgtgttcccagggctgggaggacagctctggcccttcttaggcctagcctcgtcccaagctaaatgtaagccagttgggctgtgttaaaggaagcagtgtttttggttcgattctgcctctgtagctcaaggggggcagcccccagagtcctgtgcattctgccaaggctccatagctttgccaaatgcacggagctctgccattccggtgcagtgcaggccttgcgaagggtttatctgcgttcgtctcggtgggcttctcctgcatgggagttgtgttcctgtgcaagggggagctttgctccaggacaggatgactgtcttccctattcttagggacaagtcccaagatgccagaaaggcagtctcccaaggacccaccatgcagaagtgtcaataaaccacaagttctgaactctg

SEQ ID NO: 171427 - DNA, 1778 bp, Homo sapiens
  Payload ID: 13714
  Gene Symbol: PPM1F
  Gene Name: protein phosphatase, Mg2+/Mn2+ dependent, 1F
  ENST ID: ENST00000397495
  CDS Start-End: 101-1186
ggagccgcgaggagacagctgaggcccgcggagaccagggggtgaagcctggagaccctcttgccctggcctagctgcaggcccccgggatgctttgggcatgtcctctggagccccacagaagagcagcccaatggccagtggagctgaggagaccccaggcttcctggacacgctcctgcaagacttcccagccctgctgaacccagaggaccctctgccatggaaggccccagggacggtgctcagccaggaggaggtggagggcgagctggctgagctggccatgggctttctgggcagcaggaaggccccgccaccacttgctgctgctctggcccacgaagcagtttcacagctgctacagacagacctttccgaattcaggaagttgcccagggaggaagaagaagaggaggaggacgatgacgaggaggaaaaggcccctgtgaccttgctggatgcccaaagcctggcacagagtttctttaaccgcctttgggaagtcgccggccagtggcagaagcaggtgccattggctgcccgggcctcacagcggcagtggctggtctccatccacgccatccggaacactcgccgcaagatggaggaccggcacgtgtccctcccttccttcaaccagctcttcggcttgtctgaccctgtgaaccgcgcctactttgctgtgtttgatggtcacggaggcgtggatgctgcgaggtacgccgctgtccacgtgcacaccaacgctgcccgccagccagagctgcccacagaccctgagggagccctcagagaagccttccggcgcaccgaccagatgtttctcaggaaagccaagcgagagcggctgcagagcggcaccacaggtgtgtgtgcgctcattgcaggagcgaccctgcacgtcgcctggctcggggattcccaggtcattttggtacagcagggacaggtggtgaagctgatggagccacacagaccagaacggcaggatgagaaggcgcgcattgaagcattgggtggctttgtgtctcacatggactgctggagagtcaacgggaccctggccgtctccagagccatcggtgagagccaaagaggccgacccaagtgggagaaggtctctcggaagcccaggcctcgagtgtggcccgcggctcaccaggggttcagggaggcagtgtgatgggccgagggggatttgtcatgcactggggtgataccctcgtagtgtgaagggaacagggcagattcagagactgcagcaccagtgtctgagtgtaagttacactgtatgttattatctcacctaaaacagctcctacaaatctcatagaaacctgtggctcaccaccctatgggctggaagtagagcttccaatattccggaaatgaggtttatcctcctcccgcgttcatgctgacaatccttttttctcttttgggaaaaaagtgggttcgctgggcgcggtggctcacgcctgtaatcccagcactttgggaggccgaggtgggtggatcacctgaggtcgggagttcgagaccagcctgatgaaaccccatgtctactaaaaaaaaaatacaaaaaattagccaggcatggtagtgagcccctgtaattccagctattcagaaggctgaggcaggagaatcacttgaacccagaaggcggaggttgcagtgagctgagatcgcgccactccactccagcctggataacgaggaaaactctgtctcaaaaaataataataaaaataaataaaaattttaaaaagtaa

SEQ ID NO: 171428 - DNA, 5587 bp, Homo sapiens
  Payload ID: 13714
  Gene Symbol: PPM1F
  Gene Name: protein phosphatase, Mg2+/Mn2+ dependent, 1F
  ENST ID: ENST00000407142
  CDS Start-End: 1062-1922
tccctgttgttctaaattcggcattactagtgcatgcgtgcatccggggaaaaggaacaaggtgggagaagagagagaaagcgaatacccgaggccgccagcatcagtgggtgcccgcgctctcctcctcgctctcgtcctctgccctccgccctggctccctgcccgcattccctgggagcgcagccttgccttagcctgggagacagctgtccacagtgacaggcggccattgttctcggccgagccagcaggcttccggccggtggcagctgctgctcctccgctctgcggccccaccaagggggcgccgccaccgcccaggccctccccgcctgatgggtctctgtccgtccacgcgggagacagcgccacctgccggtgagaaggagcgttgctgcgccggcaccagcccagtcctacgctcggggctcctgcaggcctgggaaggagggagggcgcagctagaaggaagtctcgcctgcccttgcttccccgtctgtcagagtgcctcgcatgcaggcctgcctagcggccttgatcatgctctccctgtcacggaagtagaatgtagtcaagtttttggactccaagccattcttacaaaattgcgtcagagtggggattgtattataagaattgccactgaagagcagcgagtggctgaaacctctgtgtggctgccagtcagcccctccccggtgactggatcagcgaagaatccagaagcgaggttgcggggctgcagcccttggcatggggagtccgtgggctgggcagcactgcctcagccgctggcctttcctgagcagagtctaggctaagcggctgttggaaatagcagtagcacccggggcgagaccgtgagccacagcggcggccggagtctcccccagcccgagctcaggcctgtgctggatgcccaaagcctggcacagagtttctttaaccgcctttgggaagtcgccggccagtggcagaagcaggtgccattggctgcccgggcctcacagcggcagtggctggtctccatccacgccatccggaacactcgccgcaagatggaggaccggcacgtgtccctcccttccttcaaccagctcttcggcttgtctgaccctgtgaaccgcgcctactttgctgtgtttgatggtcacggaggcgtggatgctgcgaggtacgccgctgtccacgtgcacaccaacgctgcccgccagccagagctgcccacagaccctgagggagccctcagagaagccttccggcgcaccgaccagatgtttctcaggaaagccaagcgagagcggctgcagagcggcaccacaggtgtgtgtgcgctcattgcaggagcgaccctgcacgtcgcctggctcggggattcccaggtcattttggtacagcagggacaggtggtgaagctgatggagccacacagaccagaacggcaggatgagaaggcgcgcattgaagcattgggtggctttgtgtctcacatggactgctggagagtcaacgggaccctggccgtctccagagccatcggggatgtcttccagaagccctacgtgtctggggaggccgatgcagcttcccgggcgctgacgggctccgaggactacctgctgcttgcctgtgatggcttctttgacgtcgtaccccaccaggaagttgttggcctggtccagagccacctgaccaggcagcagggcagcgggctccgtgtcgccgaggagctggtggctgcggcccgggagcggggctcccacgacaacatcacggtcatggtggtcttcctcagggacccccaagagctgctggagggcgggaaccagggagaaggggacccccaggcagaagggaggaggcaggacttgccctccagccttccagaacctgagacccaggctccaccaagaagctaggtggtttccaggcccctgccctccccttcctcccatccttgtccttctctccctcagaagcctcaggacccaacaggtggcaggcagtggacagggtgcccgccccacagtgctttccccagcaccccagagccagtcgggacaccccccgcagcccgtcctggtggctgtggaactgcactgggtggcgggcagatggtggaaggcagcttaggagacctcaccaaagagaagatggaccggctcttgctcccagctcctattaggcccggggtgggaccagaggtcataggtgcccaacggcagccaaaccaaagacactggtgtgcatggggcagcatggttgtgcacgtgggaccctggggcggacccaggagccaaactcttgaagcaccccctgggtcaggcccagcagcggagtggccagccccagtttcccattgctcctctctgcggccagggccaggtgggttcatatttacagatatgcccagccagtcctggtcggccacaccagtgtcccaaagaggagagcgcagcagagccaggggtctgttctgtagcagccacccccctgcccccactccagggcagccatgatgtgcttgggcccaccagggccttccgggctgctctcttccctgagcccggaaccggcgacgcacatgtgtcttttgttggtgtgtttgtttttttccagggaggtctaattccgaagcagtattccaggttttctctttgttttatcagtgccaagatgacctgttgtgtcatataatttaagcagagcttagcatttattttattctttagaaaacttaagtatttacttttttaaagctatttttcaaggaacctttttttgcagtattattgaatttattttctaaatcaggattgaaacaggaacttttccaggtggtgttaataagccattcaagtgccttacacagctttgaagaaactaggactgcagtgggctcggataggcccattgaggtttttagaaaagcaggatttgttttgttagggaggcatgattttggtgagatctttctggaagagttttccgcctctttgtgatgctgaacacccccaaggttctcccctccccccgctgcccaggtgactggcaggagctgcgactgccacgtagtggtgcctgggcccgacagcggggctctgggcatcccgggtgaccttggcccatctgcctgcattcccacccccttgggcctggctggatcccaggcagagggaccttgctgctgtgtgattggaacattcccaaatatcttgtgaatttgtaatcaaattggtctcattgggaaagactcttaattaagaggctcaggcaagcacagaggcagcccgtgggtctctgtctcagtctggaggcagcagggatgctgctgggagtccatggcacaggccacagcccctcaccttgccgcggtggctggcagcacgcctgccttgctctgccccatgccctgaacaggcatgagagctccacgtcccctagtgcaccctgagagggggctcacaagtgaccgatcctgggtgcctcagggagctcactgagggcgtgcaaagttgaaagtggcaaggctgggggagggtgtcgggtagagggaagagggcagggggctaggggaggactcagaggccatctgcagggccaagccacaggaagggctgagctggaggtgggcagggctgctccaggcaggtcagagcagtgcagggggaggagaggagaaagggaggaagctgggctgtgtggtccccatgaaggcattcagagtccacctgcagacagcgagagccccaggaaggtttgcacagctgtgccccaagcaccttggcctcctctcagctcgccgaggaggcacgctagagccgccttcccggtgggagccctctgtcccacagggagcggggagccagctttgctggggccctacctgcatgcccagccttacccctcattctcacagcacagatgaggttgagaccatgcagtcaatgcattgcttaaggtctcttatttacaaaaaaaaaccttaaacatagtcgctgtcattcagacattcagagaatggttggccacaaacaatgaccaagtattgcttggcttaacttgaaggcctgctgtctccttctgggggtcagggacgcagctccaccctcaccactagcccaccctgcccgtgggcataaccttgacgaagagagagaatgattggcatctgcttttctcttttctttgctaataattctgttcctggctgccgagagtgaagtttcaccatgtggaggtttggctcctatcacctggtggtctgattcataccctagcctgaggctccactggaagatctcgcagcctcagtgtatgggaaaccctttccccaggcttgtcccagcactgccgctccccacccctgagccaggaccccagaggatggccatgccccgtgcctggcagaggtctggtgccagcactgggagctgctccgcccttgccttggggccgagggagccctcgtccacccctgcacagcagctgggcacagaggagcgctcttccatcttgaccaggactgcaccaagaagcaccaggtgtcttcagcctccaacctccggggcgaccttctcttccagccacagtcccatgagggcccctagccagggacactggtctgtaaattgtaatcctttctccagcccagctctccacttgttccttgtgtgagctgagcaggcagtgcacctctgagtgtcccttttgtaaggcccaggggttgcactgagtctgcagaggccgcgacctcctagaacgctgtgggtgcaggtgagccggcgtgtcctggggagatgctgccagcacacaggggccctcctgctgccagcaggttggggtggttaagtcttattagtgtctattcttaaaattaagtgggctggagaagaatggagctccacatgccagcaccgtatatggaatacaaaagctggggaagcagggcctgccttacaggtgtggctgactctgagcccaggcctgcaggggtggagggcagtccctcagaatcccagaggcagtcccagcctcagaacccaggataggaaatgggtgtgtttagtggggaaagggacggggtgcagacggcagggccagtatggggccccctccctctcctctcctctcctatggtgagcccagcgtgggcaccgggccgtctcagccgtgttcccagggctgggaggacagctctggcccttcttaggcctagcctcgtcccaagctaaatgtaagccagttgggctgtgttaaaggaagcagtgtttttggttcgattctgcctctgtagctcaaggggggcagcccccagagtcctgtgcattctgccaaggctccatagctttgccaaatgcacggagctctgccattccggtgcagtgcaggccttgcgaagggtttatctgcgttcgtctcggtgggcttctcctgcatgggagttgtgttcctgtgcaagggggagctttgctccaggacaggatgactgtcttccctattcttagggacaagtcccaagatgccagaaaggcagtctcccaaggacccaccatgcagaagtgtcaataaaccacaagttctg

SEQ ID NO: 171429 - DNA, 576 bp, Homo sapiens
  Payload ID: 13714
  Gene Symbol: PPM1F
  Gene Name: protein phosphatase, Mg2+/Mn2+ dependent, 1F
  ENST ID: ENST00000424647
  CDS Start-End: 331-576
gttctaaattcggcattactagtgcatgcgtgcatccggggaaaaggaacaaggtgggagaagagagagaaagcgaatacccgaggccgccagcatcagtgggtgcccgcgctctcctcctcgctctcgtcctctgccctccgccctggctccctgcccgcattccctgggagcgcagccttgccttagcctgggagacagctgtccacagtgacaggcggccattgttctcggccgagccagcaggcttccggccggtggcagctgctgctcctccgctctgcggccccaccaagggggcgccgccaccgcccaggccctccccgcctgatgggtctctgtccgtccacgcgggagacagcgccacctgccgtgctggatgcccaaagcctggcacagagtttctttaaccgcctttgggaagtcgccggccagtggcagaagcaggtgccattggctgcccgggcctcacagcggcagtggctggtctccatccacgccatccggaacactcgccgcaagatggaggaccggcacgtgtccctcccttccttcaaccagctcttcggcttgtct

SEQ ID NO: 171430 - DNA, 650 bp, Homo sapiens
  Payload ID: 13714
  Gene Symbol: PPM1F
  Gene Name: protein phosphatase, Mg2+/Mn2+ dependent, 1F
  ENST ID: ENST00000445205
  CDS Start-End: 382-650
ggaggctgtcatctgagatcaggatattgacagaactggctccttctggtggtttgtgggcaacccttggcattccctggcttgaaggccccgccaccacttgctgctgctctggcccacgaagcagtttcacagctgctacagacagacctttccgaattcaggaagttgcccagggaggaagaagaagaggaggaggacgatgacgaggaggaaaaggcccctgtgaccttgctggatgcccaaagcctggcacagagtttctttaaccgcctttgggaagtcgccggccagtggcagaagcaggtgccattggctgcccgggcctcacagcggcagtggctggtctccatccacgccatccggaacactcgccgcaagatggaggaccggcacgtgtccctcccttccttcaaccagctcttcggcttgtctgaccctgtgaaccgcgcctactttgctgtgtttgatggtcacggaggcgtggatgctgcgaggtacgccgctgtccacgtgcacaccaacgctgcccgccagccagagctgcccacagaccctgagggagccctcagagaagccttccggcgcaccgaccagatgtttctcaggaaagccaagcgagagcggctgcagagcggcaccacaggtgt

SEQ ID NO: 171431 - DNA, 2311 bp, Homo sapiens
  Payload ID: 13715
  Gene Symbol: PPM1G
  Gene Name: protein phosphatase, Mg2+/Mn2+ dependent, 1G
  Uniprot ID: O15355
  ENST ID: ENST00000344034
  CDS Start-End: 266-1906
ggcgagttgctaaggaaatgactgcccgcagcgcctggccccgccgcgcaggccgggcggggtctggagcggcgccgtttccgcttccgctccctcacagctcccgtcccgttaccgcctcctggccggcctcgcgcctttcaccggcaccttgcgtcggtcgcgccgcggggcctgctcctgccgcgcgcacccccggggcttcggctccggcacgggtcgcgcccagctttcctgcacctgaggccgccggccagccgccgccatgggtgcctacctctcccagcccaacacggtgaagtgctccggggacggggtcggcgccccgcgcctgccgctgccctacggcttctccgccatgcaaggctggcgcgtctccatggaggatgctcacaactgtattcctgagctggacagtgagacagccatgttttctgtctacgatggacatggaggggaggaagttgccttgtactgtgccaaatatcttcctgatatcatcaaagatcagaaggcctacaaggaaggcaagctacagaaggctttagaagatgccttcttggctattgacgccaaattgaccactgaagaagtcattaaagagctggcacagattgcagggcgacccactgaggatgaagatgaaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccagggtcccagggcctcaatggggaggcaggacctgaggactcaactagggaaactccttcacaagaaaatggccccacagccaaggcctacacaggcttttcctccaactcggaacgtgggactgaggcaggccaagttggtgagcctggcattcccactggtgaggctgggccttcctgctcttcagcctctgacaagctgcctcgagttgctaagtccaagttctttgaggacagtgaggatgagtcagatgaggcggaggaagaagaggaagacagtgaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctggaatgtgatgagcagccaggaagttgtagatttcattcaatcaaagatcagccagcgtgatgaaaatggggagcttcggttattgtcatccattgtggaagagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacctaatcgta

SEQ ID NO: 171432 - DNA, 6353 bp, Homo sapiens
  Payload ID: 13716
  Gene Symbol: PPM1H
  Gene Name: protein phosphatase, Mg2+/Mn2+ dependent, 1H
  Uniprot ID: Q9ULR3
  ENST ID: ENST00000228705
  CDS Start-End: 302-1846
gctgcagctgcagccgcctgggcgctcctggagcgcgcggtgactcccccggtcggcccgctccatgcagctccgttgcggaagtgtagcggggggaggcggcggccaccgcggcactaagcacgagaggccggggctcggccccctgcagcactaggctctgggagccgcgcgcggcgcgtcccagtggcccgactcgccgtgcgcccggcgcccaccgcagcctgcatgccccgcgctgcgccttgcccggcccccgccgcctcctgctcgcaccgctgcagccgggcgccggagtaatatgctcactcgagtgaaatctgccgtggccaatttcatgggcggcatcatggctggcagctcaggctccgagcacggcggcggcagctgcggaggctcggacctgcccctgcgtttcccctacgggcggccagagttcctggggctgtctcaggacgaggtggagtgcagcgccgaccacatcgcccgccccatcctcatcctcaaggagactcggcggctgccctgggccactggctacgcagaggttatcaatgccgggaagagcacacacaatgaagaccaagccagctgtgaggtgctcactgtgaagaagaaggcaggggccgtgacctcaaccccaaacaggaactcatccaagagacggtcctcccttcccaatggggaagggctgcagctgaaggagaactcggaatccgagggtgtttcctgccactattggtcgctgtttgacgggcacgcggggtccggggccgcggtggtggcgtcacgcctgctgcagcaccacatcacggagcagctgcaggacatcgtggacatcctgaagaactccgccgtcctgccccctacctgcctgggggaggagcctgagaacacgcccgccaacagccggactctgacccgggcagcctccctgcgcggaggggtgggggccccgggctcccccagcacgccccccacacgcttctttaccgagaagaagattccccatgagtgcctggtcatcggagcgcttgaaagtgcattcaaggaaatggacctacagatagaacgagagaggagttcatataatatatctggtggctgcacggccctcattgtgatttgccttttggggaagctgtatgttgcaaatgctggggatagcagggccataatcatcagaaatggagaaattatccccatgtcttcagaatttacccccgagacggagcgccagcgacttcagtacctggcattcatgcagcctcacttgctgggaaatgagttcacacatttggagtttccaaggagagtacagagaaaggagcttggaaagaagatgctctacagggactttaatatgacaggctgggcatacaaaaccattgaggatgaggacttgaagttcccccttatatatggagaaggcaagaaggcccgggtaatggcaactattggagtgaccaggggacttggggaccatgacctgaaggtgcatgactccaacatctacattaaaccattcctgtcttcagctccagaggtaagaatctacgatctttcaaaatatgatcatggatcagatgatgtgctgatcttggccactgatggactctgggacgttttatcaaatgaagaagtagcagaagcaatcactcagtttcttcctaactgtgatccagatgatcctcacaggtacacactggcagctcaggacctggtgatgcgtgcccggggtgtgctgaaggacagaggatggcggatatctaatgaccgactgggctcaggagacgacatttctgtatatgtcattcctttaatacatggaaacaagctgtcatgaaaatggcccaggggattgggaggacagaggggaagaaagctgggatgcctcttggcaggacggaactgggaagtgccccagctgagttccaagtgatgcagtctcttcccagcccaagcggggagttcatggccaaaagactatgcttcaagatgaccctttggtttccatttcttctttagtaacaggtcaactcaacaagagcaaaacacaaaggctgctaccaagtgttgttgtatttcagttcctttcataggcctccgaggtggccattgactatttggggtatatatgtcatatttattttatctagagtagctggggcagccattttcaggtgtaaatggcagaggactcttcagcctgtcaagctgccagcttatctacgggttaaaaagtgctgcattggaaagtagggggtcatgcctcaaaatgtaagtaagtgcccaccttctaggaagcctgaggtttatttcagggattgccgtctgccccccgccccccttctctttttttcttctctgtttctattcttttatggcagtggtggagtgaggcagggatttttttttttttttttcgtgtttttgacattccttgaatctgttttttattccccttccacagaacaggcctgggactttccaacaccctgctaaggaagttctgtgtccaagtcccacccaggctgggttgtccccacctcctccagcccacacagcccaggcagcatccgggccagtgccctgcatgacagagggtctttgttgtgtaatgtttgttcccaagttgcattttctaaccgaatcagtgtgttttcatgaaactgagtgtttctgtggaccagtagttcctctgttgtcttcagtggtcttcctgtgtggctcaagggttctctgtgagagtctggattttcatttctggaatggctggccccatcccacttttctgtatcatggggacacatataaagcagtgtttaatagagcagtttaagaagttgcttgcatctgttggttcaccatggctcatctggggaccattttggattcatgtttcatggcttgtgactgtccccaagcccactccaaacaaagtgtaaggatcagagttctgtcaaggagcagcagttctgctctccccatcatctttgtgcaaggcccctcggggggcactttaataaaagaatttgaaatgggttgactggccattctcatgctgtgctccctgtctcttctcttctctaaagaatcatgtcccagctcctcaaggtccctctatggttccacatctgagtgttcgccacaagagcagcagcagcaggcacagtgcatgccatatctacctgctgcttctctgctgggaggaatggccaagtagattataaaactcacttctgtctcttaggcagacttgtacggccacaaaattacctagtcttcttcctgctgagctactgaggtattgccaccattttgacaactttgagtaattaaaacactcttctgacccaaaaaggaaaaaaggtcactgacgtgacccccccagcatgctagagagctaattccagttctcatatttgtttgaatttcttcccagaggagaggataggaacctctcctccagggcagtaaatcacctgcatttctggagttgtcggtattgtattcgaaaaggcctggagcccctcctgctcaggaaagaactcattccagggtgtggagacagtgccgtctggcaggtgaaatactgtgggaattcacgccaccaggtgtttgtgcaagtgttggcctgggaagaatgggacttcggccttgtcaggagttgtcttcatctgcagcacgtttcttcctcctgcagtagatcttagctaccccagatatctctatggagagaagtttgtggaaaatgctttgcttcgtggcagagtctgatgctgtaggaaaaccttcgggcatgtgacagcagtgtggtccactccctgttctgccctggcactcagagtcatgtgtaagtaggaaacctgagcaagtcttccgtggaggaccctgagctgccgtctttgggatccttcctgtgtccccaccgtctttcatttatttgctttcctgggcctctatctgggccctaccttgagcttctccagttttattcaagccaccagagtaagaatttgggtgtagatgtcacaactaccttctactcaattcaccaattcatttactgctatggcacgtctcaggaataactctagaaacctctaaatcgaaatattataaaatcttgagcacttagtcctgctggttttagttagaaaggcatccaggaattgttttcctacgcccccttgagtggaaagatcttagttagaagataaagtcaagtttgtgttcaggggatgggaggaagactataaataagatgaagaaatcaaaagtaggaaacatgatgtaaacgaagcatggcagatctgtccagcactgatattgctctataaattgagcttactcagttttggccttatttttttacccaggccccatgtcacccagtcctaaaacagtaaccgtgtctacataacgggttggcccctggtgcatccctggaaaagtcaaaggacgcacacttcgaaattctgcagaacgtatttatacatggttcagaaatcttgcgtatctgacttatagccaaatctgcttgctcgaatagcctcagaggaagtcttgtttaataaaaaccttttgatttcctagtcaagtctttatggttgtctcgaggggtgtgtggctactttaatgaaaggctttcctgctctaaatctctttgctgggctgggcctcttcagactatctggtgaaactcctttccttagaacaaactcagtccgtccatgctctgtggcattttgctagatgataaccaaagccttattcctgtagccagtgtcagcagtcagagaggtggagggtgtgttctgctgtggttatgcatacctatctgctgttcttgaggtgtaaaaggaaaggtgaaaatcgggccaggccaagtactcagctgtcttaataggatgaagccttaagcagtggaaatttcagttattttccacagtattccattttggaggatttggggtgtttactttttaaattcttgaacaacttaacctccatgaggctttgtgaagtcagctgtgaccaccctcctcttactgtgttctcagtattcattcacttccagggaagaatgacagccacagggagatggtggtgggcaagaatgagagtcccaggatccagatttagcctcagatcttccccattcaggaagggttttccatttaacaagagcactagtatgaaaacattagggacaaatctcccatgtctttgaaattcggattctcctcttgagatccccttcctcacctgccaatcaactttataaggccacaagtggtcactggttttccttccacaggtttgaggttctcagctttccttaagcgacccagcagctccgctgttttcagagtgaatatgttaagctttgatgagattctattttcagtaagttagtgcttctgggacacttggagaaagctgtgagagtcattgtctacgcaaagaacaacgaagctgatcctaaaagtgatccaatctaagaaaatggtaaaacgagctctggccacagcacagaattttatgtgaggaactcagatttttgaagacttaacaattgcagagaaaggttgcagcctgcacaccatagcccacctctctgagcagactttggttttgtgtggtgacgtggcacatgtttgtacactgggatttttcaaaggacgctacgcgagcagactgacttgcctcttctgtgagcactgtggcttttgtcagatggagtgccggtctgcagaggactgctctttcgaatccacagtgttatctgtgtaaatagctttaatttttcttctgtgtcttaggtgaagttttgttcatgtagcaaccaggtagacagtgaccaaataaggctgtaaatgtgctgtagttttctactgtgatgtacttgaaggagaacctgtgtcctctacttttctgatctcccacaagtattttgtgtttgtttcctgagtcctgaggttattattttactcctgttttgcccccagttttctttgttttttttctggagacccagggaggcccatggtggagatcatttgtaaggaatggatcatggtctgggtttccaaaactaccctagtacagtgaatgagagaaatctgcctggaaattgtttcagaaccatgtacctttatgctttgtgattgtgaaacattgacttttttgtaaccccaaaatgaaaactgtttagtaaaggggatctattttgtgtgttttgaaacttaggtgcaatgtcccctggaaaaagctaaagaaatgtatatgttcaatgacattttaaaataaaatattatatatatgtatatacgacatattcagcaaaa

SEQ ID NO: 171433 - DNA, 1863 bp, Homo sapiens
  Payload ID: 13717
  Gene Symbol: PPM1J
  Gene Name: protein phosphatase, Mg2+/Mn2+ dependent, 1J
  Uniprot ID: Q5JR12
  ENST ID: ENST00000309276
  CDS Start-End: 177-1694
gggccggttcctggggtggcccagagcaagggcaagtttcgcccgggacccgcccagctggccgggagccagtagcagggaagggccggctggcgcgagcaccgcccacgcggagccatgggggcggggcctgggcgggggcggggccgcggccgagggcggggcagggaggcagcatgctaaaccgggtgcgctcggccgtggcgcacctggtgagctccgggggcgctccgcctccgcgccccaaatccccggacctgcccaacgccgcctcggcgccgcccgccgccgctccagaagcgcccaggagccctcccgcgaaggctgggagcgggagcgcgacgcccgcgaaggctgttgaggctcgagcgagcttctccagaccgacctttctgcagctgagccccggggggctgcgacgcgccgatgaccacgcgggccgggctgtgcaaagccccccggacacgggccgccgcctgccctggagcacaggctacgccgaggtcatcaatgctggcaagagtcggcacaatgaggaccaggcttgctgtgaagtggtgtatgtggaaggtcggaggagtgttacaggagtacctagggagcctagccgaggccagggactctgcttctactactggggcctatttgatgggcatgcagggggcggagctgctgaaatggcctcacggctcctgcatcgccatatccgagagcagctaaaggacctggtagagatacttcaggacccttcgccaccacccctctgcctcccaaccactccggggaccccagattcctccgatccctctcacttgcttggccctcagtcctgctggtcttcacagaaggaagtgagccacgagagcctggtagtgggggccgttgagaatgccttccagctcatggatgagcagatggcccgggagcggcgtggccaccaagtggaggggggctgctgtgcactggttgtgatctacctgctaggcaaggtgtacgtggccaatgcaggcgatagcagggccatcattgtccggaatggtgaaatcattccaatgtcccgggagtttaccccggagactgagcgccagcgtcttcagctgcttggcttcctgaaaccagagctgctaggcagtgaattcacccaccttgagttcccccgcagagttctgcccaaggagctggggcagaggatgttgtaccgggaccagaacatgaccggctgggcctacaaaaagatcgagctggaggatctcaggtttcctctggtctgtggggagggcaaaaaggctcgggtgatggccaccattggggtgacccgaggcttgggagaccacagccttaaggtctgcagttccaccctgcccatcaagccctttctctcctgcttccctgaggtacgagtgtatgacctgacacaatatgagcactgcccagatgatgtgctagtcctgggaacagatggcctgtgggatgtcactactgactgtgaggtagctgccactgtggacagggtgctgtcggcctatgagcctaatgaccacagcaggtatacagctctggcccaagctctggtcctgggggcccggggtaccccccgagaccgtggctggcgtctccccaacaacaagctgggttccggggatgacatctctgtcttcgtcatccccctgggagggccaggcagttactcctgaggggctgaacaccatccctcccactagcctctccatacttactcctctcacagcccaaattctgaagttgtctccctgacccttctttagtggcaacttaactgaagaagggatgtccgctatatccaaaattacagctattggcaaataaacgagatggataaaggtg

SEQ ID NO: 171434 - DNA, 1001 bp, Homo sapiens
  Payload ID: 13717
  Gene Symbol: PPM1J
  Gene Name: protein phosphatase, Mg2+/Mn2+ dependent, 1J
  ENST ID: ENST00000482367
  CDS Start-End: 3-455
gcatgctaaaccgggtgcgctcggccgtggcgcacctggtgagctccgggggcgctccgcctccgcgccccaaatccccggacctgcccaacgccgcctcggcgccgcccgccgccgctccagaagcgcccaggagccctcccgcgaaggctgggagcgggagcgcgacgcccgcgaaggctgttgaggctcgagcgagcttctccagaccgacctttctgcagctgagccccggggggctgcgacgcgccgatgaccacgcgggccgggctgtgcaaagccccccggacacgggccgccgcctgccctggagcacaggctacgccgagaccctgttctgccccagagcccggagggcggagagcccggcgaaggatgagttggccagttccccgtcgcggcccggcagcttaaaggctaagggtcatcaatgctggcaagagtcggcacaatgaggaccaggcttgctgtgaagtggtgtatgtggaaggtcggaggagtgttacaggagtacctagggagcctagccgaggccagggactctgcttctactactggggcctatttgatgggcatgcagggggcggagctgctgaaatggcctcacggctcctgcatcgccatatccgagagcagctaaaggacctggtagagatacttcaggacccttcgccaccacccctctgcctcccaaccactccggggaccccagattcctccgatccctctcacttgcttggccctcagtcctgctggtcttcacagaaggaagtgagccacgagagcctggtagtgggggccgttgagaatgccttccagctcatggatgagcagatggcccgggagcggcgtggccaccaagtggaggggggctgctgtgcactggttgtgatctacctgctaggcaaggtgtacgtggccaatgcaggcgatagcagggccatcattgtccggaatggtgaaatcattccaatgtcccgggagtttaccccggagactga

SEQ ID NO: 171435 - DNA, 1496 bp, Homo sapiens
  Payload ID: 13717
  Gene Symbol: PPM1J
  Gene Name: protein phosphatase, Mg2+/Mn2+ dependent, 1J
  ENST ID: ENST00000471106
  CDS Start-End: 1-896
ggggcgctccgcctccgcgccccaaatccccggacctgcccaacgccgcctcggcgccgcccgccgccgctccagaagcgcccaggagccctcccgcgaaggctgggagcgggagcgcgacgcccgcgaaggctgttgaggctcgagcgagcttctccagaccgacctttctgcagctgagccccggggggctgcgacgcgccgatgaccacgcgggccgggctgtgcaaagccccccggacacgggccgccgcctgccctggagcacaggctacgccgaggtcatcaatgctggcaagagtcggcacaatgaggaccaggcttgctgtgaagtggtgtatgtggaaggtcggaggagtgttacaggagtacctagggagcctagccgaggccagggactctgcttctactactggggcctatttgatgggcatgcagggggcggagctgctgaaatggcctcacggctcctgcatcgccatatccgagagcagctaaaggacctggtagagatacttcaggacccttcgccaccacccctctgcctcccaaccactccggggaccccagattcctccgatccctctcacttgcttggccctcagtcctgctggtcttcacagaaggaagtgagccacgagagcctggtagtgggggccgttgagaatgccttccagctcatgcaggatgagcagatggcccgggagcggcgtggccaccaagtggaggggggctgctgtgcactggttgtgatctacctgctaggcaaggtgtacgtggccaatgcaggcgatagcagggccatcattgtccggaatggtgaaatcattccaatgtcccgggagtttaccccggagactgagcgccagcgtcttcagctgcttggtctgctgtagtcaacgtcatctgtgtgccaccgtgtgctgtgagcataatgccccctggctctctgttctgatcatccccaactccagggcttcctgaaaccagagctgctaggcagtgaattcacccaccttgagttcccccgcagagttctgcccaaggagctggggcagaggatgttgtaccgggaccagaacatgaccggctgggcctacaaaaagatcgagctggaggatctcaggtttcctctggtctgtggggagggcaaaaaggctcgggtgatggccaccattggggtgacccgaggcttgggagaccacagccttaaggtctgcagttccaccctgcccatcaagccctttctctcctgcttccctgaggtacgagtgtatgacctgacacaatatgagcactgcccagatgatgtgctagtcctgggaacagatggcctgtgggatgtcactactgactgtgaggtagctgccactgtggacagggtgctgtcggcctatgagcctaatgaccacagcagtggcaacttaactgaagaagggatgtccgctatatccaaaattacagctattggcaaataaacgagatggataaaggtg

SEQ ID NO: 171436 - DNA, 2474 bp, Homo sapiens
  Payload ID: 13717
  Gene Symbol: PPM1J
  Gene Name: protein phosphatase, Mg2+/Mn2+ dependent, 1J
  Uniprot ID: Q5JR12
  ENST ID: ENST00000464951
  CDS Start-End: 1410-2309
gggtgcgctcggccgtggcgcacctggtgagctccgggggcgctccgcctccgcgccccaaatccccggacctgcccaacgccgcctcggcgccgcccgccgccgctccagaagcgcccaggagccctcccgcgaaggctgggagcgggagcgcgacgcccgcgaaggctgttgaggctcgagcgagcttctccagaccgacctttctgcagctgagccccggggggctgcgacgcgccgatgaccacgcgggccgggctgtgcaaagccccccggacacgggccgccgcctgccctggagcacaggctacgccgagtgagcgccccctggggcacccaaaccaggatggggctcccacccctctccccagctccgcatccccggcgctaggacgcgttccccacgccgcgtccgggccaggagctcccttttccgtggacctttgctatcctctggtcttcgggccgcaccccctcccaacccattttccagtggggggcagcctgtgtcaccttcttcacgtccttcccgctcattgactgccctcgcccacgccgcctcaggaccctgttctgccccagagcccggagggcggagagcccggcgaaggatgagttggccagttccccgtcgcggcccggcagcttaaaggctaagggaaaaggggtttcacgaaggagcggggttctttttaataggggacatagcggttgggaagactcgctcacccgcttcccggctccagcgccccagttccctgtccctcttaccgtagttcccctccccctccacacccagaaatagcccgcgacaccaggaggccgccagcttccccaggagcggggagggggacgcccggggtagaggagggtcccatttagatgcccttcagcctgccaactcgtgctggcctggcaaagaagcggaccccctgcccggagcggccggctggcccccgggctgtgtgtattttaaatgcatctgccgggaacgcagagcaccgagggagatgggggcgctcagttcgctgaggaaggtggctggtggcccatggacccaccaccacctcccttagcctcctgtgtgggaggagtttatgggtatgtggctcctgcccagtccaggtgggctttcacttctactctatttcagttcctctttcccgatctgggctggagagcttcctcattgttaaggcagcagaaactttcgctggatggttttaggataaggggtcatcaatgctggcaagagtcggcacaatgaggaccaggcttgctgtgaagtggtgtatgtggaaggtcggaggagtgttacaggagtacctagggagcctagccgaggccagggactctgcttctactactggggcctatttgatgggcatgcagggggcggagctgctgaaatggcctcacggctcctgcatcgccatatccgagagcagctaaaggacctgaaggaagtgagccacgagagcctggtagtgggggccgttgagaatgccttccagctcatggatgagcagatggcccgggagcggcgtggccaccaagtggaggggggctgctgtgcactggttgtgatctacctgctaggcaaggtgtacgtggccaatgcaggcgatagcagggccatcattgtccggaatggtgaaatcattccaatgtcccgggagtttaccccggagactgagcgccagcgtcttcagctgcttggcttcctgaaaccagagctgctaggcagtgaattcacccaccttgagttcccccgcagagttctgcccaaggagctggggcagaggatgttgtaccgggaccagaacatgaccggctgggcctacaaaaagatcgagctggaggatctcaggtttcctctggtctgtggggagggcaaaaaggctcgggtgatggccaccattggggtgacccgaggcttgggagaccacagccttaaggtctgcagttccaccctgcccatcaagccctttctctcctgcttccctgaggtacgagtgtatgacctgacacaatatgagcactgcccagatgatgtgctagtcctgggaacagatggcctgtgggatgtcactactgactgtgaggtagctgccactgtggacagggtgctgtcggcctatgagcctaatgaccacagcaggtatacagctctggcccaagctctggtcctgggggcccggggtaccccccgagaccgtggctggcgtctccccaacaacaagctgggttccggggatgacatctctgtcttcgtcatccccctgggagggccaggcagttactcctgaggggctgaacaccatccctcccactagcctctccatacttactcctctcacagcccaaattctgaagttgtctccctgacccttctttagtggcaacttaactgaagaagggatgtccgctatatccaaaattacagctattggcaaataaacgagatggataaa

SEQ ID NO: 171437 - DNA, 1940 bp, Homo sapiens
  Payload ID: 13718
  Gene Symbol: PPM1K
  Gene Name: protein phosphatase, Mg2+/Mn2+ dependent, 1K
  ENST ID: ENST00000295908
  CDS Start-End: 233-1216
gcgggagaaaaattttcgagaatttccagcaggcaaggcagtggccgctttgactgcttgcttcggagatccgagacgacggagaaggcactcttatttaccgaccaagaaagctcctcccccgtcctccgttagctaattaaaacatttttcagggacgtagccatccagagacattccattattgttccattgacctttccctcatcactgagtcctttggagctgagttatgtcaacagctgccttaattactttggtcagaagtggtgggaaccaggtgagaaggagagtgctgctaagctcccgcctgctgcaggacgacaggcgggtgacacccacgtgccacagctccacttcagagcctaggtgttctcggtttgacccagatggtagtgggagtccagctacctgggacaattttgggatctgggataaccgcattgatgagccaattctgctgccacccagcattaagtatggcaagccaattcccaaaatcagcttggaaaatgtggggtgcgcctcacagattggcaaacggaaagagaatgaagatcggtttgacttcgctcagctgacagatgaggtcctgtactttgcagtgtatgatggacacggtggacctgcagcagctgatttctgtcatacccacatggagaaatgtattatggatttgcttcctaaggagaagaacttggaaactctgttgaccttggcttttctagaaatagataaagccttttcgagtcatgcccgcctgtctgctgatgcaactcttctgacctctgggactactgcaacagtagccctattgcgagatggtattgaactggttgtagccagtgttggggacagccgggctattttgtgtagaaaaggaaaacccatgaagctgaccattgaccatactccagaaagaaaagatgaaaaagaaaggatcaagaaatgtggtggttttgtagcttggaatagtttggggcagcctcacgtaaatggcaggcttgcaatgacaagaagtattggagatttggaccttaagaccagtggtgtcatagcagaacctgaaactaagaggattaaggcaatacagtacggtactgaggataacagtactgcagtagtagtgccttttggtgcctggggaaaatataagaactctgaaatcaacttctcattcagcagaagctttgcctccagtggacgatgggcctgattaccagctgggacttagagtttctgtgcaacagtttttcactgagcatgtcaagaaactgataagatcaaaaaggtctcctaactcactagatcagcgcacaagtcagtgtaaaccacttagatagtagttttttcataaatgctcatcatatttatgttccgctgtacatgttcagtataaatatatgtgtagtgaagctactgtgagtctttaaatggaaagagcaaatgagaagtggtttggatacacttgatgagagatgagagtgtcacattaataatttttaagactcttaggcagctatgggtttcttttgatcatttttgttctttattcatttgaacacgtttttgaagttcttcaaaactagtcagtttgaattttgacagctattcaatatgtgatctccaagtttaaaaaaatttttttccagacttccctaatcctaaaatgcgagtttttatttttaataactgtaccaaggaataagtatgaaaacagttctctgttaccatattttgtattctggaccacttactggtgaaagcaaccatgcaaaagaaattaatttggccaggcacagtggctcatgcctgtaatcccagcactttgagaggccaaggtgggtagatcatctgaggtcaggaattcaagaccagcctggccaacatggtgaaaccctgtctctagtaaaaatccaaaaaaaaaaaaaaaaaaaaaa

SEQ ID NO: 171438 - DNA, 923 bp, Homo sapiens
  Payload ID: 13718
  Gene Symbol: PPM1K
  Gene Name: protein phosphatase, Mg2+/Mn2+ dependent, 1K
  ENST ID: ENST00000508256
  CDS Start-End: 444-905
ggatctgctgtcagtcagcgggaacagacttctccctctccatctggtcaactgcgggagaaaaattttcgagaatttccagcaggcaaggcagtggccgctttgactgcttgcttcggagatccgagacgacggagaaggcactcttatttaccgaccaagaaagctcctcccccgtcctccgttagctaattaaaacatttttcagggacgtagccatccagagggatttgcttcctaaggagaagaacttggaaactctgttgaccttggcttttctagaaatagataaagccttttcgagtcatgcccgcctgtctgctgatgcaactcttctgacctctgggactactgcaacagtagccctattgcgagatggtattgaactggttgtagccagtgttggggacagccgggctattttgtgtagaaaaggaaaacccatgaagctgaccattgaccatactccagaaagaaaagatgaaaaagaaaggatcaagaaatgtggtggttttgtagcttggaatagtttggggcagcctcacgtaaatggcaggcttgcaatgacaagaagtattggagatttggaccttaagaccagtggtgtcatagcagaacctgaaactaagaggattaagttacatcatgctgatgacagcttcctggtcctcaccacagatggaattaacttcatggtgaatagtcaagagatttgtgactttgtcaatcagtgccatgatcccaacgaagcagcccatgcggtgactgaacaggcaatacagtacggtactgaggataacagtactgcagtagtagtgccttttggtgcctggggaaaatataagaactctgaaatcaacttctcattcagcagaagctttgcctccagtggacgatgggcctgattaccagctgggacttag

SEQ ID NO: 171439 - DNA, 572 bp, Homo sapiens
  Payload ID: 13718
  Gene Symbol: PPM1K
  Gene Name: protein phosphatase, Mg2+/Mn2+ dependent, 1K
  ENST ID: ENST00000510548
  CDS Start-End: 510-572
atctggtcaactgcgggagaaaaattttcgagaatttccagcaggcaaggcagtggccgctttgactgcttgcttcggagatccgagacgacggagaaggcactcttatttaccgaccaagaaagctcctcccccgtcctccgttagctaattaaaacatttttcagggacgtagccatccagagacattccattattgttccattgacctttccctcatcactgagtcctttggagctgagttatgtcaacagctgccttaattactttggtcagaagtggtgggaaccagggatttgcttcctaaggagaagaacttggaaactctgttgaccttggcttttctagaaatagataaagccttttcgagtcatgcccgcctgtctgctgatgcaactcttctgacctctgggactactgcaacagtagccctattgcgagatggtattgaactggttgtagccagtgttggggacagccgggctattttgtgtagaaaaggaaaacccatgaagctgaccattgaccatactccagaaagaaaagatgaaaaagaaaggatcaagaaatgt

SEQ ID NO: 171440 - DNA, 566 bp, Homo sapiens
  Payload ID: 13718
  Gene Symbol: PPM1K
  Gene Name: protein phosphatase, Mg2+/Mn2+ dependent, 1K
  ENST ID: ENST00000505022
  CDS Start-End: 176-566
agctatttgcgaggcttcgcaggcaggcgggcgtgtgttcttcccaccgtgtgtcaccctgaccacccgcctgtcagggccagcgagccgaggccaggatcctgagctgtacccagacattccattattgttccattgacctttccctcatcactgagtcctttggagctgagttatgtcaacagctgccttaattactttggtcagaagtggtgggaaccaggtgagaaggagagtgctgctaagctcccgcctgctgcaggacgacaggcgggtgacacccacgtgccacagctccacttcagagcctaggtgttctcggtttgacccagatggtagtgggagtccagctacctgggacaattttgggatctgggataaccgcattgatgagccaattctgctgccacccagcattaagtatggcaagccaattcccaaaatcagcttggaaaatgtggggtgcgcctcacagattggcaaacggaaagagaatgaagatcggtttgacttcgctcagctgacagatgaggtcctgtactttgcagtgtatgatggacacggtg

SEQ ID NO: 171441 - DNA, 563 bp, Homo sapiens
  Payload ID: 13718
  Gene Symbol: PPM1K
  Gene Name: protein phosphatase, Mg2+/Mn2+ dependent, 1K
  ENST ID: ENST00000509340
  CDS Start-End: 547-563
gagtcggcgcttggccggcggcctctcggagttctcagagcgtcgctttcttccctttggaggtcgtgagcagctcgtcggggtgaggcggggcccagctgggctgcctgcgccccgggcggcgggtttccagcccagactgcgctcggccttgaatgtggccgcaggctggagggccagcgcggcgcgaggcgggcagggtgggtgggctgggactggagacccttgcccgaggccccggaagcgaggatgctgcggggtgggtgccgcgttgcctcccgggcgagggaaacgtggcgacaacgggctcggtacgcccagagggaggttgggaggcggagacctggcggcagaaggtgccgagggagcccagctatttgcgaggcttcgcaggcaggcgggcgtgtgttcttcccaccgtgtgtcaccctgaccacccgcctgtcagggccagcgagccgaggccaggatcctgagctgtacccagacattccattattgttccattgacctttccctcatcactgagtcctttggagctgagttatgtcaacagctgcctt

SEQ ID NO: 171442 - DNA, 2962 bp, Homo sapiens
  Payload ID: 13718
  Gene Symbol: PPM1K
  Gene Name: protein phosphatase, Mg2+/Mn2+ dependent, 1K
  ENST ID: ENST00000514204
  CDS Start-End: 424-972
cgtcgctccgccgcgcagctggaagcctgcgaagtcaaatagcagccgcggggaggctcgttcccatcggcatctgtgactggctgcgatcgagggcccgggcggccggccagccgtctcgccgagtgcggactggccggatctgctgtcagtcagcgggaacagacttctccctctccatctggtcaactgcgggagaaaaattttcgagaatttccagcaggcaaggcagtggccgctttgactgcttgcttcggagatccgagacgacggagaaggcactcttatttaccgaccaagaaagctcctcccccgtcctccgttagctaattaaaacatttttcagggacgtagccatccagagacattccattattgttccattgacctttccctcatcactgagtcctttggagctgagttatgtcaacagctgccttaattactttggtcagaagtggtgggaaccaggtgagaaggagagtgctgctaagctcccgcctgctgcaggacgacaggcgggtgacacccacgtgccacagctccacttcagagcctaggtgttctcggtttgacccagatggtagtgggagtccagctacctgggacaattttgggatctgggataaccgcattgatgagccaattctgctgccacccagcattaagtatggcaagccaattcccaaaatcagcttggaaaatgtggggtgcgcctcacagattggcaaacggaaagagaatgaagatcggtttgacttcgctcagctgacagatgaggtcctgtactttgcagtgtatgatggacacggtggacctgcagcagctgatttctgtcatacccacatggagaaatgtattatggatttgcttcctaaggagaagaacttggaaactctgttgaccttggcttttctagaaatagataaagccttttcgagtcatgcccgcctgtctgctgatggtatgtaaaactatcacattccttggatcctagggagtacatggggtgggggaggagtaaaaaggaaacactttaagtcctttgggggaggggattttaatggacaattgtttgtaaggatttatgtagaaatgagtttatatgaagaatcacattaaatgctgttgggaactccaattaatgttaatacctcacttttaaatgaaatatattggagaatttttcagaaagagaagccccgaaacagttctgatgttgtactttagtttttaaaagattttaaaaatgtttaatctgtttgcttattttatggacaaaatgtccatactatgagttttgttttgggtttttggttttttttttagatggatctggtgaccaagtgctgaaatacactacagggtaatcacatctagcgaggacagtcattgtccaacaagaaaaaaattgcaaataggtcctaaatagaaaaagacaatggttaatatgcactaatttgtataactagaaggaaaatatttttctgtcacttcttaaaaagctcaatcttgcagcttttctctggtaactagtgatattttcagcataaggtcatgctagctgaatttaaaattttgtgtactgtatgtccttaaattttgaaagtgaaatgtttctggttttgactaaatttatcaaaaccatttcacgaaaattcagcaaacgttttctagttagctagtcccaaatcttttgctgttaaagttaaccctgaaaatttctgtaccagccaaatgaatgtgtgcatgtaaccttgtaaatgatttgaaaatgaatcatgcaataatcttgatctgtatttggttcatccttttcttaaaaaaaagaaagaaaccaagtgcaccacagaaatgtcatttgcacagtcttcagttggaatacataaggatagagattgtttgcatttcacagcgaaggaactgaagattagagtggtaaaggtcagttcagagttagggctgggattttcctgaccaccagcattatctctcttctctcatgaggagaggagaaggtaactctgcgatggctctatttaccatcttgagattttttcctgagctttttttgagaaccttactatcacactcctcaggaaagcattacagtccactctcttcagggatatgttttccagtttgtagatcatttaggcccattttcttttctttcattcctttggaatttttctttttcctttcaactggacccttacctttaagaagacagaagctgaaagaggtaaactttatgcataagacttagctcttgttccaaatagttaaaacacatgaaggaaaagaggaaatgaaatattttcttatggttttatttttattacttcctgaattttggtatgctcttatttcatagtaactgagttggctgtgcatctggctatgtctcacaccacaatgtttgttgactgtagtgtcggtggtgtgccccagctgttctgtaaatagctgcagcttactgggcaaggtttttggatgagaatgtccaaatttatcccaggcatgtgaccaccaaccaaaaacattggccttctcaatgccatcagcctcttttaaaagtatctagtcaatgtagatgcttaaaccaatcggtgattgacttgatgtaaaatatgacaggactccttttattattgaatgaagtataactcaacagaattttgaacttaaagaatttaattaacttgcctatcttaaaagaaactttctaaagatacctttgtcacaaaaacattaaacagttgtataaagaaattaatcacaaaaatgtaattcatatgctaacttcagcagcacatacactaaaattggaatgatacagagatcagcatggtccttgtgcaaggatggcacacaaatgcatgaagagttccatattttttattcttactaaaatcaattcatttgtaataaagaaattaaaatgcattatttaatttaa

SEQ ID NO: 171443 - DNA, 6484 bp, Homo sapiens
  Payload ID: 13718
  Gene Symbol: PPM1K
  Gene Name: protein phosphatase, Mg2+/Mn2+ dependent, 1K
  Uniprot ID: Q8N3J5
  ENST ID: ENST00000608933
  CDS Start-End: 391-1509
gtcaaatagcagccgcggggaggctcgttcccatcggcatctgtgactggctgcgatcgagggcccgggcggccggccagccgtctcgccgagtgcggactggccggatctgctgtcagtcagcgggaacagacttctccctctccatctggtcaactgcgggagaaaaattttcgagaatttccagcaggcaaggcagtggccgctttgactgcttgcttcggagatccgagacgacggagaaggcactcttatttaccgaccaagaaagctcctcccccgtcctccgttagctaattaaaacatttttcagggacgtagccatccagagacattccattattgttccattgacctttccctcatcactgagtcctttggagctgagttatgtcaacagctgccttaattactttggtcagaagtggtgggaaccaggtgagaaggagagtgctgctaagctcccgcctgctgcaggacgacaggcgggtgacacccacgtgccacagctccacttcagagcctaggtgttctcggtttgacccagatggtagtgggagtccagctacctgggacaattttgggatctgggataaccgcattgatgagccaattctgctgccacccagcattaagtatggcaagccaattcccaaaatcagcttggaaaatgtggggtgcgcctcacagattggcaaacggaaagagaatgaagatcggtttgacttcgctcagctgacagatgaggtcctgtactttgcagtgtatgatggacacggtggacctgcagcagctgatttctgtcatacccacatggagaaatgtattatggatttgcttcctaaggagaagaacttggaaactctgttgaccttggcttttctagaaatagataaagccttttcgagtcatgcccgcctgtctgctgatgcaactcttctgacctctgggactactgcaacagtagccctattgcgagatggtattgaactggttgtagccagtgttggggacagccgggctattttgtgtagaaaaggaaaacccatgaagctgaccattgaccatactccagaaagaaaagatgaaaaagaaaggatcaagaaatgtggtggttttgtagcttggaatagtttggggcagcctcacgtaaatggcaggcttgcaatgacaagaagtattggagatttggaccttaagaccagtggtgtcatagcagaacctgaaactaagaggattaagttacatcatgctgatgacagcttcctggtcctcaccacagatggaattaacttcatggtgaatagtcaagagatttgtgactttgtcaatcagtgccatgatcccaacgaagcagcccatgcggtgactgaacaggcaatacagtacggtactgaggataacagtactgcagtagtagtgccttttggtgcctggggaaaatataagaactctgaaatcaacttctcattcagcagaagctttgcctccagtggacgatgggcctgattaccagctgggacttagagtttctgtgcaacagtttttcactgagcatgtcaagaaactgataagatcaaaaaggtctcctaactcactagatcagcgcacaagtcagtgtaaaccacttagatagtagttttttcataaatgctcatcatatttatgttccgctgtacatgttcagtataaatatatgtgtagtgaagctactgtgagtctttaaatggaaagagcaaatgagaagtggtttggatacacttgatgagagatgagagtgtcacattaataatttttaagactcttaggcagctatgggtttcttttgatcatttttgttctttattcatttgaacacgtttttgaagttcttcaaaactagtcagtttgaattttgacagctattcaatatgtgatctccaagtttaaaaaaatttttttccagacttccctaatcctaaaatgcgagtttttatttttaataactgtaccaaggaataagtatgaaaacagttctctgttaccatattttgtattctggaccacttactggtgaaagcaaccatgcaaaagaaattaatttggccaggcacagtggctcatgcctgtaatcccagcactttgagaggccaaggtgggtagatcatctgaggtcaggaattcaagaccagcctggccaacatggtgaaaccctgtctctagtaaaaatccaaaaaaaaaaaaaaaaaaaaaaaaaaaattggctgggcgtggtggcagacacctgtaatcccagctactcgggaggctgaggaaagaggaatcacttgaacccaggagatgggggttgcagtgagctgagatcatgccattgcactccagcctgggcagcaagagcgaaaaactccatctcaaaaaaaaaaaaaaaaagaaagaaaagaaattaattcagatgatgtgacattactaaattgtatacatatttataaatgtgtatttcagctgtctcatcagccctcccctccatttattcctatttttctgtagttaagaatactgtaaaaatgtgactattccttaatatcagaaaagaatgcacaggctgagtcttccggtcaaaagttaaatactgatggaatcaagtattttgtatgaagttctcatttgttatctctaacgctattttgtgttttgcatatagtattatagtatgtgtatatcactttttgtatagagtaagcaattgaataatttgttaataaaaataataccacattgactgatactgctatagacatagcttgagttttatgtctcctttttgctcattttctaagacttaggagaaagaataaatctaaaatgaccattaaaacattctccatttcagcttgctgtgtaacttaggaagtataaaactatacttctctttatctgcatgtaagtttgctgttaaaatgtgaatttctaaatgtgtatttggaattatttccgtagtttatttctgcaaactatgtaaatttgttatatgtgtgagtatgtgtacatatgtatattttagagtaatataaaattaaagggaacaatcttgcatagctctttcaccagttttaaattattgatacgttatttttaaggactcttgacaaactaggggcaattttcttatagtggagacccagtgattatcagcagatgaggaaataggttaaaaattgctatatggcaatttgtatataaagtaataggatgtgagaaaaatactgaatcttaagaatgacatggaattctgtggcagaaacaaaagaaaaagttgatgtagtatataccttcaactgtgttttgagttgacttttttttttttctttaagctttgggtaaaaatgtatgaggagggagagggcccaatataaatatttacatcttcttacctttttggaaatggaagaagataaatcttgagtttttctgcctatattaatcaggaattgccctttgaaaaaagtgctaaataaatattttgattttttttttcaagggaagttaggtgaaagaaggaaaaacatcacaggaaagactgttaacattctgtttgttgtctgagaggtgaggaaccaaagggaggcaactaaagcgggaaaccatcttgctttttctaatcagttcttggaacagaaatgtggaagctacctttaggaacatggagaatttccaaaccaacaggcaaaggaaaactaacgcacaaaaatgacattctgaagatgcaggtttcagccaggcgcggtggctcaagcctgtaatcctagcactttgggaggccaaggcaggtggatcacctgaggtcaagagttagagaccagcctggccaacatggtgaaacctcatcttgaccaaaaaatgcaaaaattagccaggcgtggtggtgggtgcctgtaatcccagctactggggaggctgaggaaggagaattgcttgaacctgggaggcggaggttgcagtgagtcgagatcgcgccattgcactccagcctggacagcagagcaaaaactccatctcagataaataaataaacaaatatgcaggtttcatttttgttttgaatgctttacattactattcctatcttttactttaaaaactaagatgaggagtgatgttgtcaagttcaaaggcatgagggtgattgatggattgaggtagatagccaagtttgtctgtttttgttttttatagttacagagtctcactttgttgtccaggctgaagtgcagtggtgcaatcatagctcactgagattgccaggttcgacaaagaggaatttataggatggggatatagggtagacttgactctgctttatccgggaaagcttttaaaactctgagccagttaactttgagtaagcataaaacatactgtattggtgtttgtatttttcatgccacaatattaaaatggaattttaaatgtagattattataatctataaaagataagtatgcatgtattaggatactggaaaatatgcaaatcatagtaaaaaaaaagggactgctctagtttttcagttataactgaatttgccatgtgggtataggcatagtgtaaattacattaatgtagtaaaacatcaattgtggttcggtttgtctttcatttatgtgtagtatagaaatcacctttctaatatgtgttgccaaactatttgccaccatctatttggtgaaatattcattgtcattgtgattttccacaagtataagttcttaagtactttatagattcagaagtaaatgctgtcctgttctccatcagctgttcgtttgttacagattttgtatttctttttttttttttttgagatggagtctcactctgtcacacaggctggagtacagtggtgcggtctcggctccctgcaacctctgcctcccgggttcaaacgattcttctgcctcagcctcctgagtagctgggactacaggcgcgtgccaccacccctggctaatttttgtatttttttttcttttttttttttgagaaggagtctctctctgtcacccaggctggagtgcagtggcacgatctcggctcactgcaagctgcgcctcctgggttcacgccattctcctgcctcagcctcccgagtagctggaattacaggcgtccgccaccgtgcccggctaatttttttgtatttttagtagagatggggttttgccatattggccaggctggtctcgaactcctgacctcaagtgatccacccacctcggcctcccaaagtgctgggattacaggcatgagccaccgcacctggccagatctttgtatgtcttaagtgtttcaaagttataagcatttttctggggggatgtccattttggagggatccattttgatcctttgtactctataatgtgaactttcccctgttccaacacttaaaagagaattattagcacataatctaaaagatggaattttttttttttcttgagacagagtctcgctctgtcgccaggctggagtgcagtggcgcgatcttggctcactgcaacctctgcctcctgggtttaagcgattctcctgcctcagcctctggagtagctgggactactcgtgcatgccaccacgcccggctaatttttgtatttttagtagagacagggtttcaccatattggccaggatggtctcgatctcttgacctcgtgatccacctgcctcggcctcccaaattgctgggattacagcactgtgccctcctaggaaattattttttaagtgaaattttatttttattttttttaggattttggtagagaatgagtaggcctactcatcaatatcaaacaggacatttagtttctttccttagaacagacataaatttaatttcatggtaatatgataataagaaaatgcttctatttttctttagcacctccatggttctcatatacccatgtctgtaaaaagtgacatgagaattttgttgggttacattttattgtatttattagattcgcttatatagatgacttaggcagaaataaagtcatgtctttagaaggtgaacaagccaacttgtgatggcctgccttttgcttttggcagttgggatgagaacaattgactctcccattggttgttagatagttgaaatggtgcgttggtggtcatacttagtgttctaggctgtgaaatcatggagttcttccacttccaagaatgactcatttgctgttggattctagtacagaatttagcagcctgatgtgtccccaaactgatttaatttctactgaagtgcccttgtgtacatttgttttgtaatttaccaaagtactacctgagtgtataatgactcctgcagtgagttaatgtaattgctgctttgaccattgttttaaatctgtgtactagagtaactgtgagcagaatgaaatcacattatctcagtgttcaaaatatcattctaataaagtacatgcattaaacaa

SEQ ID NO: 171444 - DNA, 1449 bp, Homo sapiens
  Payload ID: 13719
  Gene Symbol: PPM1L
  Gene Name: protein phosphatase, Mg2+/Mn2+ dependent, 1L
  Uniprot ID: Q5SGD2
  ENST ID: ENST00000295839
  CDS Start-End: 49-750
gggtaggagggatgctggtgccattagcagagagggctagaccagaacatgcctgctttttcaacaactgcagctgaatatgtaaaatctcgactcccagaggcccttaaacagcatcttcaggactacgagaaagacaaagaaaatagtgtattatcttaccagaccatccttgaacagcagattttgtcaattgaccgagaaatgctagaaaaattgactgtatcctatgatgaagcaggcacaacgtgtttgattgctctgctatcagataaagacctcactgtggccaacgtgggtgactcgcgcggggtcctgtgtgacaaagatgggaacgctattcctttgtctcatgatcacaagccttaccagttgaaggaaagaaagaggataaagagagcaggtggtttcatcagtttcaatggctcctggagggtccagggaatcctggccatgtctcggtccctgggggattatccgctgaaaaatctcaacgtggtcatcccagacccagacatcctgacctttgacctggacaagcttcagcctgagttcatgatcttggcatcagatggtctctgggatgctttcagcaatgaagaagcagttcgattcatcaaggagcgcttggatgaacctcactttggggccaagagcatagttttacagtcattttacagaggctgccctgacaatataacagtcatggtggtgaagttcagaaatagcagcaaaacagaagagcagtgaacccttcaggggtctcagctgccttagactaaaggactttcaacacactggtctcttttaatttagtgaaaagtgtgggagttgtaattaggatcatccaccccagacatggaatcccccctccctggtggtcttaggtctataatcagtgacgaacagagggtgcccttggccaatgtagttaagaaactggaaaatggtttcttcatgttttcccaactctttcatccagtgtccaaaatatataagtaaatagctgtagagtcacatatatgaagtgaatagcatatgtgtcatttagtctccctgaagattcttttcaagatcctgttcagggtcctccaggcatcagctgttgtgtcctctctttgtaacagtggacaggacagaccacccagtgctgcaggagacaggccactgcgtcacctgtgagtggtcaggggctgatgtggcaacaccctctgccaagagacagagctgtcctgagaatgctttgtccttctgagcccatgttttctgctcagtagcagcttggaagcagatttggaatggtttactattttggctgctcttggggactgcgagaagcagagagaatgagagaccagtggcaactgcctgcacagcagagataaccctcttcccttgcttcctttaatagttaaatagactttgtataccacctgaccagcctttgtg

SEQ ID NO: 171445 - DNA, 10934 bp, Homo sapiens
  Payload ID: 13719
  Gene Symbol: PPM1L
  Gene Name: protein phosphatase, Mg2+/Mn2+ dependent, 1L
  Uniprot ID: Q5SGD2
  ENST ID: ENST00000498165
  CDS Start-End: 102-1184
ctccgcctccctcccggcgggctgtccccgcagtgctcccggacccggcgagccttcggggcgcgcgtcgctggtggtggttgaggctctagcgataataaatgatagaggatacaatgactttgctgtctctgctgggtcgcatcatgcgctacttcttgctgagacccgagacgcttttcctgctgtgcatcagcttggctctatggagttacttcttccacaccgacgaggtgaagaccatcgtgaagtccagccgggacgccgtgaagatggtgaagggcaaggtagccgagatcatgcagaacgatcgactcggggggcttgatgtgctcgaggccgagttttccaagacctgggagttcaagaaccacaacgtggcggtgtactccatccagggccggagagaccacatggaggaccgcttcgaagttctcacggatctggccaacaagacgcacccgtccatcttcgggatcttcgacgggcacgggggagagactgcagctgaatatgtaaaatctcgactcccagaggcccttaaacagcatcttcaggactacgagaaagacaaagaaaatagtgtattatcttaccagaccatccttgaacagcagattttgtcaattgaccgagaaatgctagaaaaattgactgtatcctatgatgaagcaggcacaacgtgtttgattgctctgctatcagataaagacctcactgtggccaacgtgggtgactcgcgcggggtcctgtgtgacaaagatgggaacgctattcctttgtctcatgatcacaagccttaccagttgaaggaaagaaagaggataaagagagcaggtggtttcatcagtttcaatggctcctggagggtccagggaatcctggccatgtctcggtccctgggggattatccgctgaaaaatctcaacgtggtcatcccagacccagacatcctgacctttgacctggacaagcttcagcctgagttcatgatcttggcatcagatggtctctgggatgctttcagcaatgaagaagcagttcgattcatcaaggagcgcttggatgaacctcactttggggccaagagcatagttttacagtcattttacagaggctgccctgacaatataacagtcatggtggtgaagttcagaaatagcagcaaaacagaagagcagtgaacccttcaggggtctcagctgccttagactaaaggactttcaacacactggtctcttttaatttagtgaaaagtgtgggagttgtaattaggatcatccaccccagacatggaatcccccctccctggtggtcttaggtctataatcagtgacgaacagagggtgcccttggccaatgtagttaagaaactggaaaatggtttcttcatgttttcccaactctttcatccagtgtccaaaatatataagtaaatagctgtagagtcacatatatgaagtgaatagcatatgtgtcatttagtctccctgaagattcttttcaagatcctgttcagggtcctccaggcatcagctgttgtgtcctctctttgtaacagtggacaggacagaccacccagtgctgcaggagacaggccactgcgtcacctgtgagtggtcaggggctgatgtggcaacaccctctgccaagagacagagctgtcctgagaatgctttgtccttctgagcccatgttttctgctcagtagcagcttggaagcagatttggaatggtttactattttggctgctcttggggactgcgagaagcagagagaatgagagaccagtggcaactgcctgcacagcagagataaccctcttcccttgcttcctttaatagttaaatagactttgtataccacctgaccagcctttgtgcatttatcctaatcatgcatgaccgttaaccttttgcttagtccttaccatatgtaataggcagctgttaaattcaccaacagataccctgatttttcatcttacgtgaccaagaaaccacgttaggggaaatgaaaaaagcaagccacaataccatgattccttccattttcaacagtagatgaaggaaatgatactgaatgagtcacagtgttccctggcaagtaagctgtttgcattgagaaaggagtgagctggtgaggttaccaccctgaattgagctccagctgccagtttttgtgtttttccttgcccctttccaagtggttttcaagtgtcaggcagtgttctgagaagcagcagcctataactgtatgtgtgttccttgaagccaggtgcagagttcccagctactgcagcttgggatttggtgggaaactactgggataagcttctccttgacaatggaaaggcagcagtcttcaacatttggttgcaaatctccatccacatcagggagctttccccaggcaaatacaaaccgccccgtggcctgcaggcctgcaggggaggcagcaaagggacctggcagttgcaacacagtaagtcaggaattcaagcgtgaacccatattgataagtgggccagaattatttaggggcctggcttgctgctctccatttcctgtatcgctaatttatcatttttccaaccttggtattttatattatttagagaaaatgctgggtcactctctttgcctaaggtgactcaaacagccaaacgaaacttccgttgcctcccagccctctgtatccacctggttttgttctttccctgtgagcatttgtggttatagcttcccatatgccacattcaccggccacctcctcgccgtggaaccctgccctctcccctcctgctgctgtagagttttcccaaagcagtgtccaggagagaatttgagagagtgaagaaattgccttgtagatgtggagggctgcaatctgtcttgatttctccaagcacttaactttctttgactgcactgagaattgctaatgatttcccatgagatttgcttacttttgtatactgtattttccagcattacagaaccttggttattgttttttagccatagaatcttctagtaaaaaatatctgccaccattttagatttaagcatttgcctatggggagacactgaatatgtggatgtgtgtattaatatttggggtggggacagggaagggaatgtggaaaacaaatgctggctgtgagcagtgctgagatggccaggccaggcggctgagtttgcttggaaattcaggacattctgactcctaagagttgcccccacccaccatcaaactgaaatcagcaccaatggtgtcagcactttacagcccatagccaactttctttatttttaacgtagcacaaaaatgtataatagcaaggaaaagacatttttaaattccggttatttttattgtctaaaatgaaagcaacagtgttttgataaagatgaaaaagaaaagctactaaattagtaaatcagtggttacgtgccctgcagaatttcttaacagatggtgctgagtgcacgagttacataactttctctctaattgaggttcacaaggcgtcttctaaattttgctttgtacaattaattcatttctgatgttaaccaaatagagtgtatatatcctactcccattactgcctctttcccccctactatggcttgtagattttcaaaagatagaagttctaggcaaaactgtagcagtttcattaatagttgttaggatagttatatctaaaatcagagtattttgttcccttccttctggagctctctctccctagcccttttccagctgttggggatgtgcagacatcactcctgggggtgccctatggtacactggctgctccccagggacctgggaatgctgaatctagccattagggaaattgatttgagatgtttgcatgtgaagcttccctaagcagcactgccaaagctttggaattgtcacccaaggcttcctagactccctagctagctcgagttcgaattgccaatagtccccatggtgccaaattttgggatggttttacagtcttttagaaatgaagacaggaatggccatgtgcttctgagaccccagcacgatgccaggcccaggtctccattaatgcagtgctctgctgctgctccactggcaatttgtactcttaacataggttgggggagggacagctagggaaattttttttaattaattgtatctaaaattctttcatcataggaataaacaacacatatagaaagctccaaagctgttcccaagacctgtattatttattttatatgaccaacttgccccaaggcaattaactctgaattgctgttctaatgtgacatatctgtgtacatatgtacatagtactggtaaccagtggctgcattttattccttgctgtggactgaggtattggcttcttgaatcttgtatatgtcataagaatattatacagagagtgttatagtgaaggatgtaagctggataatttaaaacagaccttatttcatacaagtgtaattattacatcattttgggtaaatggcaaacaggattgcatgagagtgatggcatcatcatttcaattgaatctgaagtgattctaggaaattgattccactgttggattctaggaaattgagtccactgttttcctttgcgtttaatttcctttgtgtttaatttgaccacagaaacttttttgagtagcacctagtaacattgcaaggaacttgtgtatcaaggtgtatcttgattatcctgattttttttgttctctaagttgttgccagatctctcttgcaactgtgtcaatgaaaggtctgtgtttagaaaaggcagcatatcattgtatatttgaaactataggaatatatactttgtataaaacttttccaatgatttcagaaattcttttttcctccttttgacccacaactagactgttcataccctaatagttccccaaaattgccttagcatgtcacaccagcatttgtcatccagctctggagaaatgacatgactgttagatactatgcctgtttaattgcctctggattaagtcattgatagctagacttttgagctagttagctgtagaaataatagaatccagtgtttcccaaagtgtgttccaaagaacacaagttccaaagatgctcttctaaatataggattctaggatgaaataagtttggaaaacacataccatcttagaaagttagtgaacatgagcacatcaaaggctctaatttaaatgtcctgtgaggagagaaaaacacaacaaatatctactgtcagttagcccagtgttttccagattaatttgaccacagaaacttttttgagtggcacctagtaacactgcaaggaacttgtgttctaaagaacaccctttgggaaattctggtatattgaaatattgctgtgttttcattcacgatgactcttagtagcagtacaatttgcaacttagaagcatgagcctttcatatatgaagctgacttgttaataaaagcagtgttaagaagtagtatgacttaatatgaccaacagcagcctcatattgatagcagaacaatcctacttaaagctctaaacatcatccccccctttttttttttaacggaatctcgctctgtcacccaggctggaatgccgtggcgcaatgtcaggtcactgcaagctccgcctcccaggttcacaccattctcctgcctcagcctcctgagcagctgggactacaggcggcctccaccacacctggctaattttttgtatttttagtagagacggggtttcaccatgttagccaggatggtcttgatatcctgaccttgtaatccaccagccttggcctcccaaagtgctgggattacaggtgtgagccactgcacccggccatccctttcttttatatgaataatgagcaagagccctgccatagctaaatatgtctcaaattcattccaagatctttccattgcttttttgcagttacctttgctttttgggttgaatcaaaatgaatatttttatatttcattactatatgatatttaaaaatatacagaaaatcacagaaaaggaaaaacagaaatttgattttaattcacttttgaaattttaacgatttttaaaactaatgatctgttatataataactgaaatgtaaactattaacagttatttactttctttcctttattgtcctctctggattcagtgaaataatttgaaatcaattagagctcataccttctaaaactcctgtcccatatcatcccacctttcatgttttatgtacatagttaagtttggcatgttatctcttgcctaaaatgtgaggccttcctgtagttccacagtagttactcttggctgcagaaataggtttgggaagctatgagagattaccccaaagtcatggatgaaacaaatctagtcgaaaacatggtacagagtgaattaaggcaaaagtcattaacttaaaattacatccaatatttaggaatagctcatcctctgcacattatccaaaatattttaaaaaactaaaagtaagatctcttaggctaggtggcggattgcaaagggcagggggcagttgataccatgaagcttccaatagatgcatttctaaacattttttctaatatgtaaatttgctgatccttagtaatgttaatgctttgtctatttgttatttttaccactgttgaacagcaaactgttgaggctagggttgattattgataatttttatgtgtttagtaataaccacagcatcatacgtacaactgctttaataaatccaagttaaggactttgaggagagcatgtagcaagtattcattttaacaaatcatcacagacagtttccctgttcaaagctccaccaaaaagcaagcatgcagcaaaggcatagactgtatttagagatgtggtttcatttattcttgaagtcctataaccttgcattatttaaacacaaaatcccacctaacatttgccaaatccaagttaatctcaaaaacctccgaggacattgagcacaagcagattactgtaagggcactggtggcagattgtggtggagagagggctgagtgacccagagcaaagcctgcccgggttactcgctgccacttcaggagagggattgtatcagctctcattaccttttgtcatgaggcagttcataaattaaatatgatatcatgcattatctcaaaatatttctatattaattagataattcacgatgtaaaacgtgttcatgcagaagcaaaggcggatgtaatagtcaagtatcagggaaaaacccctttaggatacccagacattaaaaatgtaaaaagtagcttataagaaatgtggattatcagatttttactatatataggttgtgtttaatagtaatttctgacacctgcacatagatgaagaaaaggcagttgttaccacttttcaccattcaaaaaatgggcttgtctcttagagtattggttaatgctttgcttatttgttaatgaagacagcattttaattttaaagcttccttttgtaggactgatggcacgggcagaatcacatttaagaaaaatggtttggaacactttttaataaaaaattgtaaaatcagtttccagtgtggtcaaaattagaatgtaaaggaaagcatttttaagaaaatacagaagcccaaatcaagggagagtaatataaaaggaaatattttaaattaagaaaaggaggtgttatagtttattacatcatgaattatgctttctgtacttacgctcttagtgaaggagataacattgaagtgagaaaatgaacattctcagttatttgcgaagttagtaaaattgcagtccctattccatttttttctgatgaaaatggatacatgagatctcatttattgctctcctcaacacctttactgtcccagattccattcacgttccaaatcgtggacagtaaaactgaagtcagataaacacagtcacaggtacaactgggagcgagttttaacatagtggtaattttgcaaatgccaacatgaatactagtgagtactcaatttacgacagacaatttcacaaaaaccaaccacagagtgatttgatattcttgcttcttagagagttttctaatccatataatgcaatgggtcaggttgctcatatgattaaaaaaattaatcctgtagaaatgatgtattagacatctctaacccaagaaaaagatgtcttttgtataacttttaaattcccatttgtctatcttaggacaaatgatgacttcttcgtgtagtaatgaaaacgtctaaatcctgctctgtggagaaaagctagaaccatgggacattaagcaagaatactcctctgatttaggctcccagactacaactaacagtctttatgtatttatcatcttggttattgttttatctcaagcatatacagtgtgcagaaagtagaataatgaataaaatatgaccatggagaaaacccataacttttgcttctattatagaaagcagtgtttgttctttttaatttattacatgttcacattgaaacattaacatctacaatattgtctttcagtttactcttcaattactaaagcaaatgattttgatttatagcacttacacaactgcagttcaggtcacagaattgaaatctatttgataatgtctcagcattctcatgggcagccaggaaaaaaaaaaagagagagaaagacaaatagaaattttagtgggttcagataaatgattattctgacaaacctggaaaatagtaattaaacagttcattccaaaagaccccaatgtaaactctgctcacatacataatttgtataaggaaaatgtatgagtttttttcttaaaaataaatagaagcatcattgcatttataacagattgatcaatcttatgaacagattacattgggaaagtcactattattgctgtgtgtttgtatattttattctttccttttttgtgtgagcatctactatgtgccaggcagtgactgtgtctgagtgaatgtatccatggtgagcactcaggcgccatcactgccttcttggggcttacaccctattggggtgtcagagatattataacactcaatattgacccaatgggatgaaaattgttatcttcatgatttcttccaatgggcttagatttgttgggacagggcagaattagaataattatttctcacatataagagtaagtgatatgagattgggaatttcttgccaacactcaagcaaactgcagaagataattactccattttactagctcacctagtttctgaaggatggggtggggagtgagacatggagcctctggggacaaggataggggggtgggactgtcccagtggagggtgccactggaagcctccacccaagtgggccagcagctgtgcaagggtgcagcagtaggctggtgaaagccaggttgtccagatctttctaggggaagagaaggattatagaaaaggagaaaagggaggagcaagaacatctctccatggcctatttttatttttgttcccaagagactagtgtaataaccttatgcccccaaagacagcccagaactgagtatcttcagtgttcctgagtgtaaatcagtgaatctgttatatagaaagttaacatttcaggagcacaattatttcctgatttcaaatatgaacagaagactaaatgtcatttttttaaatcataaatttggtatccatagttactttacacattccagagtctaagcatggaatttaagttttgtattttgaacaaaaatagcaacatctgttttctgtatggcaaagaaaaactaaatcccagacttttatttttaaccacagaaaccatcacttctttctaaattatttgcttgcctgctcatttcccctaaacatctctgtttatgccaatggctttttaaatccaaataatactagttattgccaaattgcattagaatcctattgaattagaataattcatatacttcatatactaggcagtaaatggttagagacggtaaagatctgattgtgatcaaaagtagggtttttgttttgtttttaatcatgagcacatataaaaggaaattcaaatgaaaccaagccaatttctgatttagtaagattaaaaccatagatggagctcagttattaaggatggaaaggaggaaagcacagagtgaggagagaaaaaggggaaggaaaaaaagtagtgtttttttggggaacagtataatgtctcagaagttcttctctcttatcctgctgatgttgagacagtggctttgtataagcttttatttatacctatttcaacatcatgaaaatttttccatcagcattttcttgcaactttaaaaatcacaagggattatttgtttataaagagatacaggatctataatttattggcaatactttattttaggaatcttcaaattgtacttaataaataaatcacaggtcaaaatgactgtaaaatcaatcaggctttctcgtaagttatttcctgaaaaccatccatgataaatacaacaaggcttggcgaaacctcattactcttggaagtcttcagaggttattatacctactgatctgtatttgtctctaagagacatttgaaacacagttacaatgtcaatttggtgtaacattacctgtagtagagctcagagtatatggcagtgcacggtcactcaagatgcatggcgtgtcatttgggtcgctttgatgggtgctcgggtagaattagccttgtagagactaatgtgttcatgctatctctgatcctgtggtgttgtataaaaatgaacagctaaaaatttacccatgacaagattaaagcaaaaataaacacaaagttgttagactttaaacatga

SEQ ID NO: 171446 - DNA, 1589 bp, Homo sapiens
  Payload ID: 13719
  Gene Symbol: PPM1L
  Gene Name: protein phosphatase, Mg2+/Mn2+ dependent, 1L
  Uniprot ID: Q5SGD2
  ENST ID: ENST00000497343
  CDS Start-End: 708-1292
ccgggaggtgcctgggagaggcaggcagagcccagccggccgcctgcggctcagtaccgaccgtgccgcgtcgccgggctctgcgtacccctgtctctgcccaggctcccgcaaaacttttattctctggggcccccggggtgtgtgaaggaattggaaccttccgccatctccgcgctccccttcggcggcgaccgaggggacctgcgtccctcgtccgccgggctctggagccctgcgcctcacctgctgatcgctctccggagtctcgagggggcacccccggagggaccgcgcgggcgccggcgcccctgaactctcccgctcaccgcggcagacccgcccagcgcaactttaacttgattcttcttgcccaaccggggcaccagcggctgctgctgcggcggctgctgctaccgccgccgccgcggtctcacaaaggggctcagggaagggaggcggcgcgggcggcagggacgggcctccgggccgccgaggcggggagacaaaagggaagctgcctctgctcgcgctgcctgctcggagccgcttgctcggctgcctctggctgggctccgcgatcctctcccccaccctcgggcactgctccgcctccctcccggcgggctgtccccgcagtgctcccggacccggcgagccttcggggcgcgcgtcgctggtggtggttgaggctctagcgataataaatgatagaggatacaatgactttgctgtctctgctgggtcgcatcatgcgctacttcttgctgagacccgagacgcttttcctgctgtgcatcagcttggctctatggagttacttcttccacaccgacgaggtgaagaccatcgtgaagtccagccgggacgccgtgaagatggtgaagggcaaggtagccgagatcatgcagaacgatcgactcggggggcttgatgtgctcgaggccgagttttccaagacctgggagttcaagaaccacaacgtggcggtgtactccatccagggccggagagaccacatggaggaccgcttcgaagttctcacggatctggccaacaagacgcacccgtccatcttcgggatcttcgacgggcacgggggagagactgcagctgaatatgtaaaatctcgactcccagaggcccttaaacagcatcttcaggactacgagaaagacaaagaaaatagtgtattatcttaccagaccatccttgaacagcagattttgtcaattgaccgagaaatgctagaaaaattgactgtatcctatgatgaagcagttactttttgaatgactgcttggagactgcaagtaacaccttagcttcaaaatatctagttcatattaattctaaactaatttcgattttaaacaaagactttgctttaatataccactattccctccccattctctgtgctgttgtcaaccaaattatatgcttatacattataatgtcatcaataatttcataattatttctttatgcatttattttttaaattagaagaaaaaagttaacaaataagatcaaattagaacaaaatataattctttttaaattaaaatcctgcttctgtaaaaaaa

SEQ ID NO: 171447 - DNA, 2735 bp, Homo sapiens
  Payload ID: 13719
  Gene Symbol: PPM1L
  Gene Name: protein phosphatase, Mg2+/Mn2+ dependent, 1L
  Uniprot ID: Q5SGD2
  ENST ID: ENST00000464260
  CDS Start-End: 319-864
atgcaggtggaagagggtaggagggatgctggtgccattagcagagagggctagaccagaacatgcctgctttttcaacacatgtaagaagtgcctttcatctcctgccatgattctgaggcctccccagccatgtggaactggaaatccaattaaacctctttttcttcccagtctcagactgcagctgaatatgtaaaatctcgactcccagaggcccttaaacagcatcttcaggactacgagaaagacaaagaaaatagtgtattatcttaccagaccatccttgaacagcagattttgtcaattgaccgagaaatgctagaaaaattgactgtatcctatgatgaagcaggcacaacgtgtttgattgctctgctatcagataaagacctcactgtggccaacgtgggtgactcgcgcggggtcctgtgtgacaaagatgggaacgctattcctttgtctcatgatcacaagccttaccagttgaaggaaagaaagaggataaagagagcaggtggtttcatcagtttcaatggctcctggagggtccagggaatcctggccatgtctcggtccctgggggattatccgctgaaaaatctcaacgtggtcatcccagacccagacatcctgacctttgacctggacaagcttcagcctgagttcatgatcttggcatcagatggtctctgggatgctttcagcaatgaagaagcagttcgattcatcaaggagcgcttggatgaacctcactttggggccaagagcatagttttacagtcattttacagaggctgccctgacaatataacagtcatggtggtgaagttcagaaatagcagcaaaacagaagagcagtgaacccttcaggggtctcagctgccttagactaaaggactttcaacacactggtctcttttaatttagtgaaaagtgtgggagttgtaattaggatcatccaccccagacatggaatcccccctccctggtggtcttaggtctataatcagtgacgaacagagggtgcccttggccaatgtagttaagaaactggaaaatggtttcttcatgttttcccaactctttcatccagtgtccaaaatatataagtaaatagctgtagagtcacatatatgaagtgaatagcatatgtgtcatttagtctccctgaagattcttttcaagatcctgttcagggtcctccaggcatcagctgttgtgtcctctctttgtaacagtggacaggacagaccacccagtgctgcaggagacaggccactgcgtcacctgtgagtggtcaggggctgatgtggcaacaccctctgccaagagacagagctgtcctgagaatgctttgtccttctgagcccatgttttctgctcagtagcagcttggaagcagatttggaatggtttactattttggctgctcttggggactgcgagaagcagagagaatgagagaccagtggcaactgcctgcacagcagagataaccctcttcccttgcttcctttaatagttaaatagactttgtataccacctgaccagcctttgtgcatttatcctaatcatgcatgaccgttaaccttttgcttagtccttaccatatgtaataggcagctgttaaattcaccaacagataccctgatttttcatcttacgtgaccaagaaaccacgttaggggaaatgaaaaaagcaagccacaataccatgattccttccattttcaacagtagatgaaggaaatgatactgaatgagtcacagtgttccctggcaagtaagctgtttgcattgagaaaggagtgagctggtgaggttaccaccctgaattgagctccagctgccagtttttgtgtttttccttgcccctttccaagtggttttcaagtgtcaggcagtgttctgagaagcagcagcctataactgtatgtgtgttccttgaagccaggtgcagagttcccagctactgcagcttgggatttggtgggaaactactgggataagcttctccttgacaatggaaaggcagcagtcttcaacatttggttgcaaatctccatccacatcagggagctttccccaggcaaatacaaaccgccccgtggcctgcaggcctgcaggggaggcagcaaagggacctggcagttgcaacacagtaagtcaggaattcaagcgtgaacccatattgataagtgggccagaattatttaggggcctggcttgctgctctccatttcctgtatcgctaatttatcatttttccaaccttggtattttatattatttagagaaaatgctgggtcactctctttgcctaaggtgactcaaacagccaaacgaaacttccgttgcctcccagccctctgtatccacctggttttgttctttccctgtgagcatttgtggttatagcttcccatatgccacattcaccggccacctcctcgccgtggaaccctgccctctcccctcctgctgctgtagagttttcccaaagcagtgtccaggagagaatttgagagagtgaagaaattgccttgtagatgtggagggctgcaatctgtcttgatttctccaagcacttaactttctttgactgcactgagaattgctaatgatttcccatgagatttgcttacttttgtatactgtattttccagcattacagaaccttggttattgttttttagccatagaatcttctagtaaaaaatatctgccacc

SEQ ID NO: 171448 - DNA, 2429 bp, Homo sapiens
  Payload ID: 13720
  Gene Symbol: PPM1M
  Gene Name: protein phosphatase, Mg2+/Mn2+ dependent, 1M
  Uniprot ID: Q96MI6
  ENST ID: ENST00000296487
  CDS Start-End: 405-1217
cttgccctcacctccgaatcctgacaacttcccggtcatcccgacccagcgttttccttgggattccgacctccccctcagagaagacaggaggtcgggaaggacctgcagcccaggggcttccaagatgaggcccagagactcggattatcaatgcagagaaatctgaattcaatgaggatcaagccgcctgtgggaagctgtgcatccggagatgtgagtttggggctgaagaagagtggctgaccctgtgcccagaggagttcctgacaggccattactgggcactgttcgatgggcacggcggtcctgcagcagccatcttggctgccaacaccctgcactcctgcttgcgccggcagctggaggccgtggtggaaggcttggtggccactcagccccccatgcacctcaatggccgctgcatctgccccagtgaccctcagtttgtggaggaaaagggcatcagggcagaagacttggtgatcggggcattggagagtgcctttcaggaatgtgatgaggtgatcgggcgggagctggaggcctcaggccagatgggcggctgcacagccctggtggctgtgtccctgcagggaaagctgtacatggccaatgctggggatagcagggccatcttggtgcggagagatgagatacggccactgagcttcgagttcaccccagagactgagcggcagcggatccagcagctggcctttgtctatcctgagcttctggctggtgagttcacccgactggagttccctcggcggctgaagggggatgacttgggacagaaggttttgttcagggatcaccacatgagtggctggagctacaaacgtgtggagaaatcggatctcaagtacccactgatccatggacagggtaggcaggctcggttactaggaacactggctgtctcccggggcctgggagaccatcagctcagagtcctggacacaaacatccagctcaagcccttcttgctctctgtgccacaggtgactgtgctggatgtggaccagctggagctacaggaggatgatgtggttgtcatggcaactgatggactctgggatgtactgtccaacgagcaggtggcatggctggtgcggagcttcctccctgggaaccaagaggacccacacaggtactgtagctgctggggacctgcctgggcctgggttggtgccagcagcaagcccaagtagttatggctgagaagacagagcactgacaatgagctggcagctggccaggatcagggctgtctcaagcttcttggaggaggcagggagaccgtgggttccgaaaatccctggatttagactctcatggtccagcccgtggccctcccagacttgctgcttgcttggtccacagtcggactgcattgcttgggtccccatgtccagccttgtgcagtgagttctcctaaggtctggccttgcccctttgctctgcccctgaagtctatctgcaggatggtcttcacaggttctcaaagctggcccagatgctgatacacagcacacagggaaaggaagacagtctcacagaggaagggcaggtgtcctacgatgacgtctctgtgttcgtgattcccttgcacagtcagggccaagagagcagtgaccactgaggattcagacactgtatcccagaactgctctagtgcccgggtgtggtctgggcatccctccagtgtgaccaagagcaaatcctgcctgccctatccctagccaccgcccagtgctctcactatccacctcaacacacatccatctcaagaggaacatttataccaggcagtcagagctggaagtgtatggagagcccagcccaccaggtcctgccttttgcggtgataaccttctctggcagagtgactttacaacttaactaggaaacccatgtgaggctcctcagacaggatcttgaacagcccaaagtatcattctcagataggggcacccaagctaagggtattagccaaagatgccaggatgggtagctagcccatgtttagatccaggtctccaattcatggttatcagggcatgtgttcaacaacccccaaagtccacgcaggtggcttgtagaaacctttgggcagcctcatgtctgctaaaacagccatcttcaagacagcccctgaaaagagaccagttcaggtcctgccctgctgttctttgctggagatgaggaacaggtgctggggctaaagtttggggtagagcacaagggacaagaggaactcttggagttggctgggtgagagggctctccatttgctacctgtagtagcctgcctcttaactggttgcttctccctagttccagccctgccctggtctgatgccccaacactgcccttgctttgttttccctgtcacctccctattattaaatgttttctacag

SEQ ID NO: 171449 - DNA, 2193 bp, Homo sapiens
  Payload ID: 13720
  Gene Symbol: PPM1M
  Gene Name: protein phosphatase, Mg2+/Mn2+ dependent, 1M
  ENST ID: ENST00000323588
  CDS Start-End: 33-1412
gcgctccgcgggcagccccctgccgccgcgccatgtccgccggctggttccggcgccgcttcctgcctggggagccgctccccgcgccgcggccgcctgggccgcatgccagccccgtgccctaccgacggccccgcttccttcgcggctccagctccagccccggggcggccgacgcctcgcgccgcccagactcccggcccgtgcgcagccccgcacgaggacgcacgctaccctggaatgcaggctacgccgagattatcaatgcagagaaatctgaattcaatgaggatcaagccgcctgtgggaagctgtgcatccggagatgtgagtttggggctgaagaagagtggctgaccctgtgcccagaggagttcctgacaggccattactgggcactgttcgatgggcacggcggtcctgcagcagccatcttggctgccaacaccctgcactcctgcttgcgccggcagctggaggccgtggtggaaggcttggtggccactcagccccccatgcacctcaatggccgctgcatctgccccagtgaccctcagtttgtggaggaaaagggcatcagggcagaagacttggtgatcggggcattggagagtgcctttcaggaatgtgatgaggtgatcgggcgggagctggaggcctcaggccagatgggcggctgcacagccctggtggctgtgtccctgcagggaaagctgtacatggccaatgctggggatagcagggccatcttggtgcggagagatgagatacggccactgagcttcgagttcaccccagagactgagcggcagcggatccagcagctggcctttgtctatcctgagcttctggctggtgagttcacccgactggagttccctcggcggctgaagggggatgacttgggacagaaggttttgttcagggatcaccacatgagtggctggagctacaaacgtgtggagaaatcggatctcaagtacccactgatccatggacagggtaggcaggctcggttactaggaacactggctgtctcccggggcctgggagaccatcagctcagagtcctggacacaaacatccagctcaagcccttcttgctctctgtgccacaggtgactgtgctggatgtggaccagctggagctacaggaggatgatgtggttgtcatggcaactgatggactctgggatgtactgtccaacgagcaggtggcatggctggtgcggagcttcctccctgggaaccaagaggacccacacaggttctcaaagctggcccagatgctgatacacagcacacagggaaaggaagacagtctcacagaggaagggcaggtgtcctacgatgacgtctctgtgttcgtgattcccttgcacagtcagggccaagagagcagtgaccactgaggattcagacactgtatcccagaactgctctagtgcccgggtgtggtctgggcatccctccagtgtgaccaagagcaaatcctgcctgccctatccctagccaccgcccagtgctctcactatccacctcaacacacatccatctcaagaggaacatttataccaggcagtcagagctggaagtgtatggagagcccagcccaccaggtcctgccttttgcggtgataaccttctctggcagagtgactttacaacttaactaggaaacccatgtgaggctcctcagacaggatcttgaacagcccaaagtatcattctcagataggggcacccaagctaagggtattagccaaagatgccaggatgggtagctagcccatgtttagatccaggtctccaattcatggttatcagggcatgtgttcaacaacccccaaagtccacgcaggtggcttgtagaaacctttgggcagcctcatgtctgctaaaacagccatcttcaagacagcccctgaaaagagaccagttcaggtcctgccctgctgttctttgctggagatgaggaacaggtgctggggctaaagtttggggtagagcacaagggacaagaggaactcttggagttggctgggtgagagggctctccatttgctacctgtagtagcctgcctcttaactggttgcttctccctagttccagccctgccctggtctgatgccccaacactgcccttgctttgttttccctgtcacctccctattattaaatgttttctacag

SEQ ID NO: 171450 - DNA, 1790 bp, Homo sapiens
  Payload ID: 13720
  Gene Symbol: PPM1M
  Gene Name: protein phosphatase, Mg2+/Mn2+ dependent, 1M
  Uniprot ID: Q96MI6
  ENST ID: ENST00000409502
  CDS Start-End: 264-1007
cccgacccagcgttttccttgggattccgacctccccctcagagaagacaggaggtcgggaaggacctgcagcccaggggcttccaagatgaggcccagagactcggattatcaatgcagagaaatctgaattcaatgaggatcaagccgcctgtgggaagctgtgcatccggagatgtgagtttggggctgaagaagagtggctgaccctgtgcccagaggaggatgaggtgatcgggcgggagctggaggcctcaggccagatgggcggctgcacagccctggtggctgtgtccctgcagggaaagctgtacatggccaatgctggggatagcagggccatcttggtgcggagagatgagatacggccactgagcttcgagttcaccccagagactgagcggcagcggatccagcagctggcctttgtctatcctgagcttctggctggtgagttcacccgactggagttccctcggcggctgaagggggatgacttgggacagaaggttttgttcagggatcaccacatgagtggctggagctacaaacgtgtggagaaatcggatctcaagtacccactgatccatggacagggtaggcaggctcggttactaggaacactggctgtctcccggggcctgggagaccatcagctcagagtcctggacacaaacatccagctcaagcccttcttgctctctgtgccacaggtgactgtgctggatgtggaccagctggagctacaggaggatgatgtggttgtcatggcaactgatggactctgggatgtactgtccaacgagcaggtggcatggctggtgcggagcttcctccctgggaaccaagaggacccacacaggttctcaaagctggcccagatgctgatacacagcacacagggaaaggaagacagtctcacagaggaagggcaggtgtcctacgatgacgtctctgtgttcgtgattcccttgcacagtcagggccaagagagcagtgaccactgaggattcagacactgtatcccagaactgctctagtgcccgggtgtggtctgggcatccctccagtgtgaccaagagcaaatcctgcctgccctatccctagccaccgcccagtgctctcactatccacctcaacacacatccatctcaagaggaacatttataccaggcagtcagagctggaagtgtatggagagcccagcccaccaggtcctgccttttgcggtgataaccttctctggcagagtgactttacaacttaactaggaaacccatgtgaggctcctcagacaggatcttgaacagcccaaagtatcattctcagataggggcacccaagctaagggtattagccaaagatgccaggatgggtagctagcccatgtttagatccaggtctccaattcatggttatcagggcatgtgttcaacaacccccaaagtccacgcaggtggcttgtagaaacctttgggcagcctcatgtctgctaaaacagccatcttcaagacagcccctgaaaagagaccagttcaggtcctgccctgctgttctttgctggagatgaggaacaggtgctggggctaaagtttggggtagagcacaagggacaagaggaactcttggagttggctgggtgagagggctctccatttgctacctgtagtagcctgcctcttaactggttgcttctccctagttccagccctgccctggtctgatgccccaacactgcccttgctttgttttccctgtcacctccctattattaaatgttttctacagaa

SEQ ID NO: 171451 - DNA, 398 bp, Homo sapiens
  Payload ID: 13720
  Gene Symbol: PPM1M
  Gene Name: protein phosphatase, Mg2+/Mn2+ dependent, 1M
  ENST ID: ENST00000443681
  CDS Start-End: 1-364
gttactaggaacactggctgtctcccggggcctgggagaccatcagctcagagtcctggacacaaacatccagctcaagcccttcttgctctctgtgccacaggtgactgtgctggatgtggaccagctggagctacaggaggatgatgtggttgtcatggcaactgatggactctgggatgtactgtccaacgagcaggtggcatggctggtgcggagcttcctccctgggaaccaagaggacccacacagtctatctgcaggatggtcttcacaggttctcaaagctggcccagatgctgatacacagcacacagggaaaggaagacagtctcacagaggaagggcaggtgtcctacgatgacgtctctgtgttcgtgattcccttgcacagtcag

SEQ ID NO: 171452 - DNA, 770 bp, Homo sapiens
  Payload ID: 13720
  Gene Symbol: PPM1M
  Gene Name: protein phosphatase, Mg2+/Mn2+ dependent, 1M
  ENST ID: ENST00000457454
  CDS Start-End: 1-770
cgcctgggccgcatgccagccccgtgccctaccgacggccccgcttccttcgcggctccagctccagccccggggcggccgacgcctcgcgccgcccagactcccggcccgtgcgcagccccgcacgaggacgcacgctaccctggaatgcaggctacgccgagattatcaatgcagagaaatctgaattcaatgaggatcaagccgcctgtgggaagctgtgcatccggagatgtgagtttggggctgaagaagagtggctgaccctgtgcccagaggaggatgaggtgatcgggcgggagctggaggcctcaggccagatgggcggctgcacagccctggtggctgtgtccctgcagggaaagctgtacatggccaatgctggggatagcagggccatcttggtgcggagagatgagatacggccactgagcttcgagttcaccccagagactgagcggcagcggatccagcagctggcctttgtctatcctgagcttctggctggtgagttcacccgactggagttccctcggcggctgaagggggatgacttgggacagaaggttttgttcagggatcaccacatgagtggctggagctacaaacgtgtggagaaatcggatctcaagtacccactgatccatggacagggtaggcaggctcggttactaggaacactggctgtctcccggggcctgggagaccatcagctcagagtcctggacacaaacatccagctcaagcccttcttgctctctgtgccacag

SEQ ID NO: 171453 - DNA, 895 bp, Homo sapiens
  Payload ID: 13721
  Gene Symbol: PPM1N
  Gene Name: protein phosphatase, Mg2+/Mn2+ dependent, 1N (putative)
  Uniprot ID: Q8N819
  ENST ID: ENST00000396735
  CDS Start-End: 132-470
gggagagttagtggaagggacttaagagaaagggcgtggtcttttggaaaggggcgattctgggtcgtaggagccgggccggaagtattgattagtgctggaaggtggaagagcagggcagcctggacaacatgacctgcatcctggtctgcttccctggggcccctaggccttctgaggaggcgatcaggagggagctagcactggacgcagccctgggctgcagaatcgctgaactgtgtgcctctgctcagaagccccccagcctgaacacagttttcaggactctggcctcagaggacatcccagatttacctcctgggggagggctggactgcaaggccactgtcattgctgaagtttattctcagatctgccaggtctcagaagagtgcggagagaaggggcaggatggggctgggaagtccaaccccacgcatttgggctcagccttggacatggaggcctgacagctgttgtcctttggggatcctttgcttctctggggcctcaacagaactaaagaagaaaaccgaccctttccccaactacatgtaccagcggaaggaaggaaggccaatgtaggaacccaaaatgcttatttcttcttctcttacttccctctcacagaaaagtcttacgaatggggaaattccaccaacatccagaccaaaaagaaaaaagcccaaatcgaaaaaaaaaaaaaaaaaaaaaaaaaacaaaaaaacccaaccaaatgtttttgaaatattcagagccgaacagattctgagagataacccagtccaataacctctttccttcttattactcatctgtttttgaggggaagtagagttttgattattaaactttatttacataagtgattccaaatacattttcttgtaaaaaa

SEQ ID NO: 171454 - DNA, 527 bp, Homo sapiens
  Payload ID: 13721
  Gene Symbol: PPM1N
  Gene Name: protein phosphatase, Mg2+/Mn2+ dependent, 1N (putative)
  ENST ID: ENST00000396736
  CDS Start-End: 4-417
aacatgacctgcatcctggtctgcttccctggggcccctaggccttctgaggaggcgatcaggagggagctagcactggacgcagccctgggctgcagaatcgctgaactgtgtgcctctgctcagaagccccccagcctgaacacagttttcaggactctggcctcagaggacatcccagatttacctcctgggggagggctggactgcaagtctcagaagagtgcggagagaaggggcaggatggggctgggaagtccaaccccacgcatttgggctcagccttggacatggaggcctgacagctgttgtcctttggggatcctttgcttctctggggcctcaacagaactaaagaagaaaaccgaccctttccccaactacatgtaccagcggaaggaaggaaggccaatgtaggaacccaaaatgcttatttcttcttctcttacttccctctcacagaaaagtcttacgaatggggaaattccaccaacatccagaccaaaaagaaaaaagcccaaatcgaa

SEQ ID NO: 171455 - DNA, 872 bp, Homo sapiens
  Payload ID: 13721
  Gene Symbol: PPM1N
  Gene Name: protein phosphatase, Mg2+/Mn2+ dependent, 1N (putative)
  Uniprot ID: Q8N819
  ENST ID: ENST00000396737
  CDS Start-End: 109-447
gggaagagggaaggaggcctggagtctggcgagggacttgggagaggatggtgaacgagccacggcagagaggatgagagcgtggatccctggggcagcctggacaacatgacctgcatcctggtctgcttccctggggcccctaggccttctgaggaggcgatcaggagggagctagcactggacgcagccctgggctgcagaatcgctgaactgtgtgcctctgctcagaagccccccagcctgaacacagttttcaggactctggcctcagaggacatcccagatttacctcctgggggagggctggactgcaaggccactgtcattgctgaagtttattctcagatctgccaggtctcagaagagtgcggagagaaggggcaggatggggctgggaagtccaaccccacgcatttgggctcagccttggacatggaggcctgacagctgttgtcctttggggatcctttgcttctctggggcctcaacagaactaaagaagaaaaccgaccctttccccaactacatgtaccagcggaaggaaggaaggccaatgtaggaacccaaaatgcttatttcttcttctcttacttccctctcacagaaaagtcttacgaatggggaaattccaccaacatccagaccaaaaagaaaaaagcccaaatcgaaaaaaaaaaaaaaaaaaaaaaaaaacaaaaaaacccaaccaaatgtttttgaaatattcagagccgaacagattctgagagataacccagtccaataacctctttccttcttattactcatctgtttttgaggggaagtagagttttgattattaaactttatttacataagtgattccaaatacattttcttgtaaaaaa

SEQ ID NO: 171456 - DNA, 771 bp, Homo sapiens
  Payload ID: 13721
  Gene Symbol: PPM1N
  Gene Name: protein phosphatase, Mg2+/Mn2+ dependent, 1N (putative)
  Uniprot ID: Q8N819
  ENST ID: ENST00000401705
  CDS Start-End: 219-557
tcgccctcccaccccctagccatgcagaggtgaatgggggaacccaggaggggctgagagctccaggccaccttgagggaatccacgaggtcttctaccaggaagaagtgccgcagctgcgtggccgccgagaccacgcgggaggtgatctggtgggacaaacgttccgtctgctcccgagtcagggtgaggtccacatccagggcagcctggacaacatgacctgcatcctggtctgcttccctggggcccctaggccttctgaggaggcgatcaggagggagctagcactggacgcagccctgggctgcagaatcgctgaactgtgtgcctctgctcagaagccccccagcctgaacacagttttcaggactctggcctcagaggacatcccagatttacctcctgggggagggctggactgcaaggccactgtcattgctgaagtttattctcagatctgccaggtctcagaagagtgcggagagaaggggcaggatggggctgggaagtccaaccccacgcatttgggctcagccttggacatggaggcctgacagctgttgtcctttggggatcctttgcttctctggggcctcaacagaactaaagaagaaaaccgaccctttccccaactacatgtaccagcggaaggaaggaaggccaatgtaggaacccaaaatgcttatttcttcttctcttacttccctctcacagaaaagtcttacgaatggggaaattccaccaacatccagaccaaaaagaaaaaag

SEQ ID NO: 171457 - DNA, 548 bp, Homo sapiens
  Payload ID: 13721
  Gene Symbol: PPM1N
  Gene Name: protein phosphatase, Mg2+/Mn2+ dependent, 1N (putative)
  ENST ID: ENST00000401593
  CDS Start-End: 16-438
ggcagcctggacaacatgacctgcatcctggtctgcttccctggggcccctaggccttctgaggaggcgatcaggagggagctagcactggacgcagccctgggctgcagaatcgctgaactgtgtgcctctgctcagaagccccccagcctgaacacagttttcaggactctggcctcagaggacatcccagatttacctcctgggggagggctggactgcaaatctgccaggtctcagaagagtgcggagagaaggggcaggatggggctgggaagtccaaccccacgcatttgggctcagccttggacatggaggcctgacagctgttgtcctttggggatcctttgcttctctggggcctcaacagaactaaagaagaaaaccgaccctttccccaactacatgtaccagcggaaggaaggaaggccaatgtaggaacccaaaatgcttatttcttcttctcttacttccctctcacagaaaagtcttacgaatggggaaattccaccaacatccagaccaaaaagaaaaaagcccaaatcgaa

SEQ ID NO: 171458 - DNA, 618 bp, Homo sapiens
  Payload ID: 13721
  Gene Symbol: PPM1N
  Gene Name: protein phosphatase, Mg2+/Mn2+ dependent, 1N (putative)
  ENST ID: ENST00000456399
  CDS Start-End: 124-516
gcagagggcgcagcctttaggggaagagggaaggaggcctggagtctggcgagggacttgggagaggatggtgaacgagccacggcagagaggatgagagcgtggatccctggcctggacaacatgacctgcatcctggtctgcttccctggggcccctaggccttctgaggaggcgatcaggagggagctagcactggacgcagccctgggctgcagaatcgctgaactgtgtgcctctgctcagaagccccccagcctgaacacagttttcaggactctggcctcagaggacatcccagatttacctcctgggggagggctggactgcaaaaggggcaggatggggctgggaagtccaaccccacgcatttgggctcagccttggacatggaggcctgacagctgttgtcctttggggatcctttgcttctctggggcctcaacagaactaaagaagaaaaccgaccctttccccaactacatgtaccagcggaaggaaggaaggccaatgtaggaacccaaaatgcttatttcttcttctcttacttccctctcacagaaaagtcttacgaatggggaaattccaccaacatccagaccaaaaagaaaaaagccc

SEQ ID NO: 171459 - DNA, 1293 bp, Homo sapiens
  Payload ID: 13721
  Gene Symbol: PPM1N
  Gene Name: protein phosphatase, Mg2+/Mn2+ dependent, 1N (putative)
  Uniprot ID: Q8N819
  ENST ID: ENST00000451287
  CDS Start-End: 1-1293
atggcggtcctggcccgccagctgcagcgtctcctctggaccgcttgcaagaaaaaggagagggagaaggaggggagggaggaagaggaggaggaggaggcggggcgcagggcccccgaagggcctcggtctctgttgacagcgccgcgccgcgcccagcggccgcacgggggtgccgaggcgtctgggggcctgcgcttcggggcgagcgcagcgcaaggctggcgcgcgcgcatggaggatgctcactgcacttggctttcgttacctggtctgcccccgggctgggccttgtttgccgtcctcgacggccacggtggggctcgagctgcccgcttcggtgcacgccatttgccaggccatgtgctccaggagctgggcccggagcctagcgagcccgagggcgtgcgcgaggcgctgcgccgagccttcttgagcgccgacgagcgcctgcgctccctctggccccgcgtggaaacgggcggctgcacggccgtggtgttgctggtctccccgcggtttctgtacctggcgcactgcggtgactcccgcgcggtgctgagccgcgctggcgccgtggccttcagcacagaggaccaccggccccttcgaccccgggaacgcgagcgcatccacgccgctggcggcaccatccgccgccgccgcgtcgagggctctctggccgtgtcgcgagcgttgggcgactttacctacaaggaggctccggggaggccccccgagctacagctcgtttctgcggagccagaggtggccgcactggcacgccaggctgaggacgagttcatgctcctggcctctgatggcgtctgggacactgtgtctggtgctgccctggcgggactggtggcttcacgcctccgcttgggcctggccccagagcttctctgcgcgcagctgttggacacgtgtctgtgcaagggcagcctggacaacatgacctgcatcctggtctgcttccctggggcccctaggccttctgaggaggcgatcaggagggagctagcactggacgcagccctgggctgcagaatcgctgaactgtgtgcctctgctcagaagccccccagcctgaacacagttttcaggactctggcctcagaggacatcccagatttacctcctgggggagggctggactgcaaggccactgtcattgctgaagtttattctcagatctgccaggtctcagaagagtgcggagagaaggggcaggatggggctgggaagtccaaccccacgcatttgggctcagccttggacatggaggcctga

SEQ ID NO: 171460 - DNA, 1953 bp, Homo sapiens
  Payload ID: 13721
  Gene Symbol: PPM1N
  Gene Name: protein phosphatase, Mg2+/Mn2+ dependent, 1N (putative)
  ENST ID: ENST00000415077
  CDS Start-End: 1-1123
gttgacagcgccgcgccgcgcccagcggccgcacgggggtgccgaggcgtctgggggcctgcgcttcggggcgagcgcagcgcaaggctggcgcgcgcgcatggaggatgctcactgcacttggctttcgttacctggtctgcccccgggctgggccttgtttgccgtcctcgacggccacggtggggctcgagctgcccgcttcggtgcacgccatttgccaggccatgtgctccaggagctgggcccggagcctagcgagcccgagggcgtgcgcgaggcgctgcgccgagccttcttgagcgccgacgagcgcctgcgctccctctggccccgcgtggaaacgggcggctgcacggccgtggtgttgctggtctccccgcggtttctgtacctggcgcactgcggtgactcccgcgcggtgctgagccgcgctggcgccgtggccttcagcacagaggaccaccggccccttcgaccccgggaacgcgagcgcatccacgccgctggcggcaccatccgccgccgccgcgtcgagggctctctggccgtgtcgcgagcgttgggcgactttacctacaaggaggctccggggaggccccccgagctacagctcgtttctgcggagccagaggtggccgcactggcacgccaggctgaggacgagttcatgctcctggcctctgatggcgtctgggacactgtgtctggtgctgccctggcgggactggtggcttcacgcctccgcttgggcctggccccagagcttctctgcgcgcagctgttggacacgtgtctgtgcaaggtcctgggggcgtggcgtggtacctttggggcttggtgcagcagagggagagagcctcggggttttggggaggagggctttgatagagaggcaagagtaaagctagcaaaggaggggataggactcaagcgaagggcgtggcctgaagtgggcagggccaaaatacaggggcggagcctgagggatgctttgaggcacgggagagttagtggaagggacttaagagaaagggcgtggtcttttggaaaggggcgattctgggtcgtaggagccgggccggaagtattgattagtgctggaaggtggaagagcaggtaaacatcagagcgggcggagctttagggaaaaggcattgttctctcaattgggagcgcctaggaccgggtttggtcccagtaagagaggattggcaggtgggtgggacgcgaaagaaatgggcataagtagaatgaagtgggggacttgaacctggggattgttgggaagctctgccttggactctcccccaccgggctcctttttctccaccggcttcagggcagcctggacaacatgacctgcatcctggtctgcttccctggggcccctaggccttctgaggaggcgatcaggagggagctagcactggacgcagccctgggctgcagaatcgctgaactgtgtgcctctgctcagaagccccccagcctgaacacagttttcaggactctggcctcagaggacatcccagatttacctcctgggggagggctggactgcaaggccactgtcattgctgaagtttattctcagatctgccaggtctcagaagagtgcggagagaaggggcaggatggggctgggaagtccaaccccacgcatttgggctcagccttggacatggaggcctgacagctgttgtcctttggggatcctttgcttctctggggcctcaacagaactaaagaagaaaaccgaccctttccccaactacatgtaccagcggaaggaaggaaggccaatgtaggaacccaaaatgcttatttcttcttctcttacttccctctcacagaaaagtcttacgaatggggaaattccaccaacatccagaccaaaaagaaaaaagcccaaatcgaaaaaaaaaaaaaaaaaaaaaaaaaacaaaaaaa

SEQ ID NO: 171461 - DNA, 1417 bp, Homo sapiens
  Payload ID: 13722
  Gene Symbol: PTAR1
  Gene Name: protein prenyltransferase alpha subunit repeat containing 1
  Uniprot ID: Q7Z6K3
  ENST ID: ENST00000340434
  CDS Start-End: 5-1213
caacatggccgagaccagcgaggaggtggcggtgctggtgcagcgggttgtgaaggacatcactaacgccttcaggaggaacccacacatagatgaaattggcctgatcccatgtcctgaagctaggtataaccggagtcccatagtcctggttgaaaacaaactgggtgtggagagctggtgtgtcaagttccttttaccatatgtccacaacaagctccttttgtacagaacaagaaagcaatggctgaacagagatgaattgatagatgtcacatgtaccctgctgcttctaaacccagactttaccactgcatggaacgtgaggaaagagctgatcctctctggcactttaaatccaattaaggatttacatctgggaaaactcgccttaaccaagtttccaaagagtccagaaacatggattcacaggcgatgggtgctacaacagctaattcaggaaacctccttgccttcctttgtgaccaaaggaaacttgggaacaattcccacagaaagggcacagcgactcatacaagaagagatggaggtctgtggtgaagcagcagggagatacccaagcaactataatgcttggtcccatcgcatctgggttttacagcacttggccaagctagatgtcaagattcttcttgatgaactatcttctactaaacattgggcatctatgcacgtttcagaccacagtggatttcactaccgccagtttttgcttaagtctttgattagccaaactgtgatagacagttctgtgatggagcaaaatcctttgagaagtgagccagccctagttcctccaaaagatgaagaagcagcagtttcaacagaagaaccaaggattaatcttccccatcttctagaagaagaagttgaattcagcactgatcttattgattcctacccaggacatgaaaccctttggtgtcataggcggcatattttctaccttcagcatcacttaaatgcaggctcccagctgtctcaagcaatggaagtagatggactgaatgactctagcaagcaaggctattcccaggaaaccaaacgcctgaagcggacgccagttccagactccctaggcctagaaatggagcacaggttcattgatcaagtattgtccacctgtcggaacgtggagcaagccaggtttgccagtgcatacaggaaatggctggttactttgagtcaatgaaagaggtgaattagtcctacaaggttccccttttagtgcaatattgctttcttttattatttacatagttgcatgaactgtttactattattggctaaccatatgttcttcgtctttaggttgaaagtccatagtaaatctttcattttatttattttgttaataactggcattcctgtggggataaaataatcgtatagttcc

SEQ ID NO: 171462 - DNA, 9876 bp, Homo sapiens
  Payload ID: 13722
  Gene Symbol: PTAR1
  Gene Name: protein prenyltransferase alpha subunit repeat containing 1
  ENST ID: ENST00000377200
  CDS Start-End: 4-1056
aacatggccgagaccagcgaggaggtggcggtgctggtgcagcgggttgtgaaggacatcactaacgccttcaggaggaacccacacatgaaagagctgatcctctctggcactttaaatccaattaaggatttacatctgggaaaactcgccttaaccaagtttccaaagagtccagaaacatggattcacaggcgatgggtgctacaacagctaattcaggaaacctccttgccttcctttgtgaccaaaggaaacttgggaacaattcccacagaaagggcacagcgactcatacaagaagagatggaggtctgtggtgaagcagcagggagatacccaagcaactataatgcttggtcccatcgcatctgggttttacagcacttggccaagctagatgtcaagattcttcttgatgaactatcttctactaaacattgggcatctatgcacgtttcagaccacagtggatttcactaccgccagtttttgcttaagtctttgattagccaaactgtgatagacagttctgtgatggagcaaaatcctttgagaagtgagccagccctagttcctccaaaagatgaagaagcagcagtttcaacagaagaaccaaggattaatcttccccatcttctagaagaagaagttgaattcagcactgatcttattgattcctacccaggacatgaaaccctttggtgtcataggcggcatattttctaccttcagcatcacttaaatggtaggtttcctcacagcatgacccagttgtcacctgcagacagccctggggggactttgagtgacttgcaccttatcccagcaggctcccagctgtctcaagcaatggaagtagatggactgaatgactctagcaagcaaggctattcccaggaaaccaaacgcctgaagcggacgccagttccagactccctaggcctagaaatggagcacaggttcattgatcaagtattgtccacctgtcggaacgtggagcaagccaggtttgccagtgcatacaggaaatggctggttactttgagtcaatgaaagaggtgaattagtcctacaaggttccccttttagtgcaatattgctttcttttattatttacatagttgcatgaactgtttactattattggctaaccatatgttcttcgtctttaggttgaaagtccatagtaaatctttcattttatttattttgttaataactggcattcctgtggggataaaataatcgtatagttccttcctgctgaacagcgagtcttaaattttctgtttaacttctcaccctttgtatttctatatgtggggcttctcatttggttttcctgattggttcacacacacacacctctacccccctcagtccaattgctgcataggcaaattcttttaaaaattaaaaatttaaggcctaggcaggaggattgcctgagcccaggactttgagaccaacctgggccacatagcaagacccgatttctacaaaaagtaaaacaaaatagctaggcatggtgctatgcaactgtgttcctagctatgcaggaagctgaggcagaaggattgcttgagccccaggtgtttgtggctgtagtgagccatgattgcaccactgtactcagcctgggcaatagagttgagaccctgtctctaaaacaaattgaaaataaacatttatgttgcagttcaactgaagaatgttggtatgaatgccgaataacttgatgtaattgttttgagaatcaaatggctagatgggcgaatgtttaaaaatgtaaactagttctctttctctagcatgttctacccaattaccaaagtcagaagtattggaatttatatgaaaaaaatgcttccaatgtaatccattttttaaatggttatttaagaaaaaactaacttaagagtttatgtaattgcagtaaaggaaaattatttttattgctagttttgatagattatttttacctcaaatttggtatatgccaaaacacatcagtccttataaaattgatttttttttcctgaaaacctggaatgccatttttagctattactactttttaatttcaaattcacttatgacaaatgggagaaatatataaagaaatagatccataaaaatattcctttttaaaaatctaaattattgaggatacactatggaaactataaaattatcatgaagtgactgttaaagtttactggcaaatgccaagggaaggaatagtatgtgcaaaacaaaacactttgatactgaacttaatcagggatgaggtaccaaagtatccacattatagccgtatcttatgtttccaataacaagggctgagtttttcaggtaggtgggatgagggtggggaatgggccatgtaatgtctgctttcttatatttgcccttttgtaagtggtctgtttcttcttttcatatactttgttttgccaatccattacgtattttttgtcacttttgtgtgtcatttttgtatacctttcctttcttacttcaggggtgtgtcttcaagatttctaccccctatttgcaatgaatttcatacctcatctaaaatacattcatataccagaaatatgaagagtggcccttctaaaagtttccctaatgatggaagctgtcagttgtcctatctgtgcagaatgtgagtaatagtggcagaaataagtgtgacaacaatgctttgcctgttgttctttttacttgctaggtaatttgtaaagtggggataaagatgtagggaaagtaaacctctctctcactgttacggaaagcctggacttgagttaggtagactgccttaaagaagaagaaatatgtccttttctttggcatcatggttttgttgagtggcagactgttgaagtgagttgagacttaagaacgccagaaaagttgtctagcctggccccagtagacagaatttgttcttctctcaagtaaaaaattacctttttatagcttttatattatttagatgaaaaaataccattatgaacataattccatggccctttgtgtacaaagcatattttgaattaaatacctcaaggtccacctagacctctatggataaaatcataagtttatgatttttagctcctgtgagtgtttgggggcaaactacacagagaagacatgggtggttcagcccattccactaaaatatgttgccagattctggcctaactcagtattaccttttttcctaaaaatcatttttcacattttgagtaatagggcttatgctttgatgtgaaaaaatgtcaggaaatgagtgtagacaataccctataaaacactagctaagttttatagtgctccatgcctttgtgtaccttccactgattatcttgcctatctttggtgtgtaaactattttcatatcttctaaggctcttaacccactcttttctgaagccgcacagtcctttaatatgtcttgtttccttcctaaaagtttaaagtagagagcaaaaatgcaaatacccaaaggatactgttagtatgtaacttttgtgtgctgctttatttctagagtttgcattttttaattgttcattcacagaaaatcctaatattgccctatatggttggtttttttcctaagtggttaatatttaaacccgctagctgtagcatgataatgtctttgactgagcttatgtagtagaaaggatgtgtctgttttctgggacttttagtcttcacttatttttctataacaatctaattgttaaaaggaaaagatggcttattgacacatatttcattaaactttcactggaagaacagtgggtcatcctactgtggattaagaatactactgacaagcaaaaagcattaagctctgtaactgtctccaacaccaccttcaccccgcctttagtgtaccttagtgtactttagtgtacctattttggcagtacggtgttttccagattctacttgtgccctgcacattgtgaggactcattaaatatttattaaattaatgaatgactaacaggaagagaaagattgtttgtgagtgttaagaatgagtgatgattgagaaattgatggattagtgcaatggattgggaatgaatgatgctttctagtttcgtaatacttgggaagagctattgcatatagagtaagttgatttagactttttttttcttcatttcattaccttgtttaaacttgttaaatcccagccaagaaatgcagctctgtaattgtcaattaactgtattataatatatattaaaaatttgtagagctaaagaacccacttgcattaagaacaccactttctgttcatttgtgatactagaggacagatcctgcatacagagccgaaactgcttttaatcatctgaagaaattctttgatttcagtgacttactgatctgtacctgtgcacatatcattttatgcttctccttttttccccgcaacttgaactgtgactctttcagatatttcttaaatctgtatgagtcattttttaagcttagggatttgatatgtattaatgtcccctttgtcttctgtagattttagcattttattacctcttaagaaactctgggcccagactttcagtcatatttcttattcctatggtacagttctcacttaaaggcttaattattagtagggttaaatatatacaggttatctctaaaagtacttaaatttttaaataagggcttatgtgatacaagatacggaaacaaaagtttttggatttttatgcagtagtttgcaggaaagcaaatacatagtagatcgtatgccacttaggtatgttcaggtcatgccagtttattcttgttgggccacacacacatgtatgtgtgtgtaaaaggaatttttagtattgaagcaaacaaattgtcagtttaataattttctcttacatagcacaagatggcagataccacctactgtacaacaatctaataatccctaccttagttcccctgagttatagaagatgctaaagatttagttgtaaagggaagtaacatgattttttttttctaaaaagctgttttaagctaactattattttgctactggaaaattatattttaaaacttacagatatttaaagtatgctagaaaatttgaacctgataacaactgaaccttttgtcttgaataaatttctcaaatagaactgtgcaaaccctagcactttatgtgttgctgcctccccatacctaggtatgctctgtaataagctcccatttaatggagagatgtgtggaggcactgagaagttaatgaagaaaaatcaaccctaagaattccttattgtcacatagtgtcttttaaaaaataactgtagagactgtgttaattcgagtgcctttcttacttttttgggagcaagattatatttaatgtttaagaaaacaggatggaagttttatcaaacagttgattgtggcccattgttttatttattcccatcgctaggcatggccccgtagggtattttatccttcagtgagagactgatataagcaggcaggatgctttgattattccattagttatcattttaagcaccctaccaagatttagttctttctttctggcaactaacgttttgggggttggaggcatcccatttagaggatggtgtgtgcacaaatagattagcctgaaacctgcgtccaaagggaaacagtggcactctgccctaaaataaaggccagaacgttgtcctaaatgaatcctttgccttactttaggaccttccttccctctcaaattcaggcataatgtaatatagttgaaagggggaaaacagtacttgctttctctcaggtattggaggaaaagaagtaaatgcgtagatgaaattttaaatgtatcattttatctgtttgtatatggagaagggagggataggaattccatatttcaagatagcaaatataatttcatagaaatatatagctaaagattccaaagtgcttttacagagaactgttgaataatatattcctaaagggcagcaatatgccatgttcatggtgaagacagaaaaccaatgaatcagttgtggatctcaggtgggagaggaaacctcaggctcccaactttgacttctctactctcaccaggccatgttaacactgtaaaaccaaactctttgctaagaacaatacagggcagtagtttagtctgctgatgaaaccttgtgcttccaagaatattagctatatataatttgtgctttctggatgattctattgtccagaaagctaaccctgacgttacttttattagtctgttgttattcctcagggtgtagaagatttagtaaattcaggacaaattttatattcagtggcaaaaagaaaaggcaaaaatatgctaaatatattattagctcttaaattttagtatagatcgtattttttataaactattaccagtacagtagctagtagatattctgtgactgcctcattgtttatcttgctgctttggtccctatggctctagtatgaacattctcgtgtcttctgtggaaatgatttctgtgttatagttccatctttggtagaggtggggatgattgtattttgttttagttgacatcattctcaacttttagaaatactgttgaggaaaatgattaccgttggttttcaaattgacaactattttgcttccaaagacttcagtttccctttgttttatgtgtagacctcatatatgttcaacacattgcatactgccttgcacattgtaggaattcaacaagtcaagagttgataaaagctagaaagataaaactagcttagctatcatatcatcattgtccatattcttagctttgggaaaaatataccattttgcataaaatacataatcagtttcaaatgcataaggcaaagatatacagttgcacaacattgcaagtgaaatttacaaaggatttttatttttgtgtatgctaaaagtgctcctacttaaagcagttttctttattagaccaacaccttccagcaaagttagaaaccaaacacaagtgctcatttgcccaaattaaccagatagttatgtaaactgttcatattaagtctttagtggtttacaaacaataacattctggcttttcttccataccttttaggaatcagccttaattttaagtatagcagtcactttcctcaaggtactatgcagcatactttagattgcttatttatcattataaggtgataggtaataaatttgaggtttacttgtcatataatttcatatggcagatattgattcaaggagcattctattagaaaaagttgataaattatcctcccttacaaatatcatcttgcatttggagcaggtatttttttcttattagttaaagactgggtacagttatagtagatgctcaataaatgcttagtcagtgattgatctaacatcaaactaacagctttcagaaaggagactgttgacatcttttcaccaaggagtatatttgtagagtaatatatgtgtggaattttgaaattatatcatttgacatgatttatgaggcttatttaagctggagttagtaacgtaatagaagtattatttatacagaacatagttgaaagataggagatgtgaaagattaagtagtattttcttgtgcaaggcatattaataaatgtaattaaatgtcttaataagcagctggctgaactctagagagaactgctgtagtcttctgcaatcagtctctgtattggtatatccagtactatcgggtttaggttctttttatttttccttaaatcttacttgtttctagcgtcttaagagtggtaatggtaaaatgtgaagttacaataaacttctgcttgttttctcagaacatctttggcatgaggaagaactttttgtgaatgatacagtagtctcagcatctgttaatttgtggttttcaaagcatttttgacagagtttacctaatgtaaaaagattaaacagttttataaaacacaaataaacattcctacctgaactgtgaggaacagagtgtatagtacaaatgtaattaggcattgcctcctggcgaggttcttgatgcatgacttcgatgctggctgctgactgaggtgaccactgtcagtattgtactttggcatatgttgtttttaggaaaataatggaatgcattcttagattaacttactgtttttgagttggaaaaaataaaagatgaggtattataagtatgccaaatatttatacactacaaaagattaaaaaaggagagggagaaaaaaaaaggccagttatgattttaatagcgtctaatttttttttgactcgaattttgtggacactagtcaattgcataatttaacatggaggagctttcatttaaaagaagttctcagctactatattctgccattaaaattaaccatgcctgttaattttacattgcttgaagatataagtaagctgccgtcaatattgttttaagattttcttatagtttatgtttaaatggaaaagttacatatataatctatggtgcagggtcaggcattggccattaaagataagtttggctaactattttactgaagagactaatggtcttccctctgttgtactgctatgtttcttgatctgtttttccccaatgtaacagtctacattgaagtcctttagctctctccatatactaattgacatttgttaaggattcaatattttgtgaattctttttacccttaaaatgcatatctttcagagagataagaatgaattttgcaataatttatatgcagagtgtgcttatgggtttctgggagttcaagttagtaccccagagtgcttaaaagtatgatgctaaattctaaggctaatgtaatgactgtagattatctatgtccacattgttcaacagaaatataatgtgaaccacaacataatttttaattttctagtagccatattaaaaaagaaacaagcaaaattaattttaataacagtttatgtaacccagtatattaaaaatatcatttcaacatgtaatcaatataaaagattattaatgaaacaccttatcttctttttcttccatactaagtcttagatttgagtgtattttgcactcacagcacatctcaattctgactggccacattttaagtgctcagtagtcacatatggctaagggctactatactggacagtacagattcatagagtataaaatatgactttaactttggagatggtgaggtaggcctgtaattatggtactttaaaaattcagaatatttagaaaagcatctaatagaattatccacttgttttccttcatcttcattttaatatgttctagaagtaggatcagcctgttccaatttgccaagcattattaaggaggaataattccataccatgtaaaataccatgatatgctgattatactacattaacaaatttttaagttgcgttcactaaattctgtcctgtttcttcaaaataatatagcttaaattgcatgttaattgtatatcttacctattttgtttttatattattcttacaatataatcatgtatattaacaaacagccctgggattctaatcttcctctgcaactgtcttccaggacttactggcacttattacactgtgataagtggcagaaaagtagaatgaaatattctttttccattagatttgttcttatgtgaccatgtaccaagccagctataaagtattgtatttctgtagaatatggaaaatagtatttgtcttacctttgctaaatgtttgcaatttctaagtaaaccttttatctcctaaaatga

SEQ ID NO: 171463 - DNA, 826 bp, Homo sapiens
  Payload ID: 13722
  Gene Symbol: PTAR1
  Gene Name: protein prenyltransferase alpha subunit repeat containing 1
  ENST ID: ENST00000415701
  CDS Start-End: 1-505
cagtggatttcactaccgccagtttttgcttaagtctttgattagccaaactgtgatagacagttctgtgatggagcaaaatcctttgagaagtgagccagccctagttcctccaaaagatgaagaagcagcagtttcaacagaagaaccaaggattaatcttccccatcttctagaagaagaagttgaattcagcactgatcttattgattcctacccaggacatgaaaccctttggtgtcataggcggcatattttctaccttcagcatcacttaaatggctcccagctgtctcaagcaatggaagtagatggactgaatgactctagcaagcaaggctattcccaggaaaccaaacgcctgaagcggacgccagttccagactccctaggcctagaaatggagcacaggttcattgatcaagtattgtccacctgtcggaacgtggagcaagccaggtttgccagtgcatacaggaaatggctggttactttgagtcaatgaaagaggtgaattagtcctacaaggttccccttttagtgcaatattgctttcttttattatttacatagttgcatgaactgtttactattattggctaaccatatgttcttcgtctttaggttgaaagtccatagtaaatctttcattttatttattttgttaataactggcattcctgtggggataaaataatcgtatagttccttcctgctgaacagcgagtcttaaattttctgtttaacttctcaccctttgtatttctatatgtggggcttctcatttggttttcctgattggttcacacacacacacctctacccc

SEQ ID NO: 171464 - DNA, 1689 bp, Homo sapiens
  Payload ID: 13722
  Gene Symbol: PTAR1
  Gene Name: protein prenyltransferase alpha subunit repeat containing 1
  ENST ID: ENST00000472967
  CDS Start-End: 22-111
actgtcgcggccgccgccaacatggccgagaccagcgaggaggtggcggtgctggtgcagcgggttgtgaaggacatcactaacgccttcaggaggaacccacacatgtgatgattgtaaaacagttaagaagccgttggatgttttgctcccttgtggcacacaattggagacgtgcaactgtgccacattaaaaacaaaacactgctggcctcaaaacacacctgccacctctgacagcatccacttccctcccccttatgactgctgcctttttcaaaatgagagtgtttggaatgatttcctggcagtatccatagtggttgctgagccttctaaagaatgctttgatgccttgctgtatatcagtctttcgatttctttttgagaatgggagccttagtgcaagtaagagacgacctcaaaaaaaaaaaaagttggacaaatgaagagtgtattttctcatcactggtatttttctagaagaaattacagcagagattagaaatctaatacaaaatgtcgtaatcatcttatgttctcttctttgaggtagactaaaagagcatcattatatttgaagaaaccaagattgaatgttcattggcttggcagtttttaacacagtgcagtttggaacatgtcccagttcttgtggatcacatttatggaaactcttaaaggactttaatgcccctccctaatcctttttctactgtaaaacctcattaatatatcctcaatgtataatttattagtaataaggatttgggtcattcgagatttaaaactttgagataagttggatattcggaataatgtaatgatttgtaatataggtcttaaacatttaaatagcttaactcattgtttaagactagtcatcagctatatttgaatacatattccccacagtaaaactattttcaataatattactatgcatctttgtaagtgccttataatttgggcttttaaaaattgcctgcgctttcttcccttaatttagcccatttactcccaaaataaagaggctgtgtttctttttttttttttaaggcattgtttatctgtaacgtttgtatctaactttactgtatctaattacactttcagtattatacaaaaatttttttgtttttcttgtccaaacttaagatcggttgtaattttattggccaacatctacttcattaaatacattgactttgtttatgtagaaatatttagccagaaggagttgaggatgcagtggtgagatgtggattttgttactgtatgatgtgaataggtaccttctctcagcctcagtttcctcttgatcttgtgaggctgatgaaaacaggaaaatcacctcacacagtggtacttagttgccactcaataaatattagaccttccctgaatctctgtgttcctcaccaaaaatatattggacaaatgattggtgaatatgaagcactttataaacctggataatactatataaatgctgtttgtatggttgagtattagataatcatattggattctctaaaactgaaaacttgacctagggatagtctttaacttagtgtatggaccctgtgctaatgtagaagacaacagtttataatgtaaacagtcacgttaaaattaatcttatccagcaagttattgttttttctattaaatattgaactcactgtt

SEQ ID NO: 171465 - DNA, 2030 bp, Homo sapiens
  Payload ID: 13723
  Gene Symbol:
  Gene Name: Protein RCC2  [Source:UniProtKB/Swiss-Prot
  Acc:Q9P258]
  Uniprot ID: Q9P258
  ENST ID: ENST00000628984
  CDS Start-End: 48-1616
cccgtccattgtgcgccgctgccccgtgtctccctccagccgcgaccatgcccaggaagaaggcggcggcggcggcctgggaggagccgagctcgggcaacggcactgcccgcgccgggcccaggaaacgcggcggcccggcgggcaggaagcgcgagcggcccgagcgctgcagtagcagcagcggcggcggcagcagcggcgacgaggacggcctggagctcgacggggcccccggcgggggcaagcgcgcggcgcggccggcgacagcaggcaaggcgggcggcgcggccgtggtcatcaccgaacccgagcacaccaaggagcgcgtcaaacttgaagggtcaaagtgcaaagggcagcttttgatttttggggcaaccaactgggacttgattggtcgaaaagaagtgcctaaacagcaagctgcttaccgcaatctcggtcagaatttgtgggggccccacagatatgggtgcctggcgggggtccgggtgcggacagtggtctcgggctcgtgtgctgcacacagcctcctcatcaccacggaagggaagctgtggagctggggtcgaaatgagaaggggcagctgggacatggtgacaccaagagagtagaagcccctagactcatcgagggtcttagccacgaagtgattgtgtctgcagcatgtgggcggaaccacaccttggccttgacggaaacgggctccgtgtttgcgtttggggaaaacaagatggggcagctgggccttggcaaccagacagacgctgttcccagccccgcgcagataatgtacaacggccagccaattaccaaaatggcctgtggggctgaattcagtatgataatggactgcaaaggaaacctctattcctttgggtgccctgaatatggtcagctgggacacaactcagatgggaagttcatcgcccgggcacagcggatagagtacgactgtgaactagttccccggcgagtggccatcttcattgagaagacgaaagatggacagattctgcctgtaccaaacgtggttgtacgagacgtggcctgtggcgctaaccacacgctggtcctggactcccagaagcgagtcttctcctggggctttggtggctatggccggctgggccacgcagagcagaaggatgagatggtcccccgcctggtgaagctgtttgacttccctgggcgtggggcttcccagatctatgctggttacacctgctcctttgctgtcagtgaagtgggtggtctgtttttctggggggccaccaacacctcccgtgaatctaccatgtacccaaaagcagtgcaggacctctgcggctggagaatccggagcctggcttgtgggaagagcagcatcattgtggccgccgatgagagcaccatcagctggggtccgtcaccgacctttggggaactgggctacggggaccacaagcccaagtcttccactgcagcccaggaggtaaagactctggatggcattttctcagagcaggtcgccatgggctactcacactccttggtgatagcaagagatgaaagtgagactgagaaagagaagatcaagaaactgccagaatacaacccccgaaccctctgatgctcccggagactcctccgactccacacctctcgcggcagctgtcatttccatgtgcactgggacgggaagtcaaacgaggaatttaaaaaagcaaaagttgaccgaaggtgcatttttgtttagactccctgaggttccgttttacacatgatccaacgttaactacctttttttctgtatgctttccaaagtccttttttttcccttaatgttgaattaaaatacttgctcatagttgatttaccattcctacaaaagaggcagaaactttgagcaatctaggttttttttttttttaagttttttctttcttcctctcctgaatacactccccaaaacacccctttccagttacaattagcatcgtgatccaagcagatgccacatggaagaggaatcgccatttactca

SEQ ID NO: 171466 - DNA, 4087 bp, Homo sapiens
  Payload ID: 13723
  Gene Symbol:
  Gene Name: Protein RCC2  [Source:UniProtKB/Swiss-Prot
  Acc:Q9P258]
  Uniprot ID: Q9P258
  ENST ID: ENST00000631021
  CDS Start-End: 189-1757
cgcacatgtgtttctgttttgtgttgtagcatttgttctggaagctcgtatttacattttaagtgtatctggtgagtgggctggagccctcgtctgggccggaaaaaaaaaagccctccgatccgtcttttagttgcttctcttccttttttctctccggtttctcatcactccaaccagccgcgaccatgcccaggaagaaggcggcggcggcggcctgggaggagccgagctcgggcaacggcactgcccgcgccgggcccaggaaacgcggcggcccggcgggcaggaagcgcgagcggcccgagcgctgcagtagcagcagcggcggcggcagcagcggcgacgaggacggcctggagctcgacggggcccccggcgggggcaagcgcgcggcgcggccggcgacagcaggcaaggcgggcggcgcggccgtggtcatcaccgaacccgagcacaccaaggagcgcgtcaaacttgaagggtcaaagtgcaaagggcagcttttgatttttggggcaaccaactgggacttgattggtcgaaaagaagtgcctaaacagcaagctgcttaccgcaatctcggtcagaatttgtgggggccccacagatatgggtgcctggcgggggtccgggtgcggacagtggtctcgggctcgtgtgctgcacacagcctcctcatcaccacggaagggaagctgtggagctggggtcgaaatgagaaggggcagctgggacatggtgacaccaagagagtagaagcccctagactcatcgagggtcttagccacgaagtgattgtgtctgcagcatgtgggcggaaccacaccttggccttgacggaaacgggctccgtgtttgcgtttggggaaaacaagatggggcagctgggccttggcaaccagacagacgctgttcccagccccgcgcagataatgtacaacggccagccaattaccaaaatggcctgtggggctgaattcagtatgataatggactgcaaaggaaacctctattcctttgggtgccctgaatatggtcagctgggacacaactcagatgggaagttcatcgcccgggcacagcggatagagtacgactgtgaactagttccccggcgagtggccatcttcattgagaagacgaaagatggacagattctgcctgtaccaaacgtggttgtacgagacgtggcctgtggcgctaaccacacgctggtcctggactcccagaagcgagtcttctcctggggctttggtggctatggccggctgggccacgcagagcagaaggatgagatggtcccccgcctggtgaagctgtttgacttccctgggcgtggggcttcccagatctatgctggttacacctgctcctttgctgtcagtgaagtgggtggtctgtttttctggggggccaccaacacctcccgtgaatctaccatgtacccaaaagcagtgcaggacctctgcggctggagaatccggagcctggcttgtgggaagagcagcatcattgtggccgccgatgagagcaccatcagctggggtccgtcaccgacctttggggaactgggctacggggaccacaagcccaagtcttccactgcagcccaggaggtaaagactctggatggcattttctcagagcaggtcgccatgggctactcacactccttggtgatagcaagagatgaaagtgagactgagaaagagaagatcaagaaactgccagaatacaacccccgaaccctctgatgctcccggagactcctccgactccacacctctcgcggcagctgtcatttccatgtgcactgggacgggaagtcaaacgaggaatttaaaaaagcaaaagttgaccgaaggtgcatttttgtttagactccctgaggttccgttttacacatgatccaacgttaactacctttttttctgtatgctttccaaagtccttttttttcccttaatgttgaattaaaatacttgctcatagttgatttaccattcctacaaaagaggcagaaactttgagcaatctaggttttttttttttttaagttttttctttcttcctctcctgaatacactccccaaaacacccctttccagttacaattagcatcgtgatccaagcagatgccacatggaagaggaatcgccatttactcagaaaaaatgtcccttacaggaaccggcagcagctaggcagtcaccggcccgcctccatccaaaatcacgctcgcgtgcttcggaagcatccgggtcactccttctccgctttttcttgcagatgggcctaggccggtgtcggttctgtttctccccttggctgcctgtacgcccacagccttctggctgcgacattatagaatcggccgtgtcccccctggtgggggattggggatctgtgtttagccatttatatctactttagctgttaaagaggtccaaatgaaaatcaggtgattgtggaaccatggggacttgggggtggggcagaggtgggaacatttgtatcagttgagtcagcttggtggctccctgtggagccagggctgagccttgtcacgcgcactcgccaattaagagatggaccagccagcagtcaagtgcattctccagtccttgcaagaaggatcagccctttctgtgccagcctcgatcgccttgtgctttggtctctttttctcccccccgcctggatcctgcctcgcgcgggccgtcctgttgctgagactcggggtaccgttctgctgacccagctccctttagtcacgtttgcttggctctggtaccaaatagttgggattaccgaagagtccccttccttgcgtgtcagcacggatgctgtgactgccacctgcgtcctcgtcaagtgcccgagctcgccgccgtgtgtgctgcgctgagtgagttatgaggtgcctttcccggaaccctcctctcgcctggacccaagagaggcgacagctgtggctggggctcttggtttccagagggtctggactggtttgggtgctttaaaatagatatttagttcagtggtgcttatgggggagatgggactagaacttaagtgtgagacttgggtggatgggaaagttaaatattggtctcttcaagttttttttttcttttgctttgttaccacttgtcactgtctccatgttaaaatgccaaaaatgatgtagttgttgttgcttttttccctattttccaccccagtcgctccttaccgtgactcctgcccttggagggcatgtagcagtgtctgtcctgccagtcccaaggccctgtgggaggagactggcctgcatctctctaagacttagtctgacgccacgcgcatctcttgttctgtgttcaatcagtagtccaggggagaagcttctgctacttcagagctttgctaaactaacctaatttgtccaaatcaccccaaaaccaccatctctgacgtaagcttccatgcgacagcctgatccgtttccctggacaggtctctttcctggaatgcagcccaggcacctgtgctcctggcacccttgaggtctctcctttgagccgtggtcaccgagagggttgaggacgcagcacccgaggtcccagcctttgcaggagcctccctgggcttagctggacttagatcttcggtggcctcatgtaaacgtggcagccagcctcttctagaaccctagcccagggactggagcaggaaagggaccttcaaagtgaagactgccttgtcccgcagctccttctggcttagattgaaaaatgggcttcctaatgggttaaatcctttaaaacaaggagttgtgggggaagggtgtcgtgcactcctagagaaaggtacacagttgcccggttgggaatgtgcttggcgctgaccctgcgggcatctgactggtcttccagctcaggaaaaagaatttgaaagaggcttagcgtgaaggggaatcaaagaggaggttgtgatttggtcgaaggtgcctggtttagtgctgtaattgtcttattattttttttatatatatatttcttggagtaaacattttaaataaacaacaacattgtctactgtc

SEQ ID NO: 171467 - DNA, 4087 bp, Homo sapiens
  Payload ID: 13724
  Gene Symbol: PRC1
  Gene Name: protein regulator of cytokinesis 1
  Uniprot ID: O43663
  ENST ID: ENST00000361188
  CDS Start-End: 1213-3033
tgccagtattattattttacctacaaaatgagcaaagatgtttagaagtacaatagaattcagccctgctgagggtaacaaaaggagggtacttttccggtgaggctttgtgcagaaggcaaattaataaagggagcattcagtaattacacctctaggaatcagccgtacgaaaatgcaggatgcatttataaatacatacatacacaaagatttatgtatgaagatattcagcccagccttatcttttaaattatcatctaaatatcaatagcagaatgggcgagatatctacacaccaggattcatgccaccatgccaccatgaatcactgggaaaaaacggtgatatataagcatttagggatgtaacatgttcatcgaggaaaggaggctacaaaagtaatgtctattttgagttttaaatttttcatgtaacgatttagaaactcatctaatttgataacgtgacttaggcaaatcattcaaatctttttgcgtttcctctgcaatggcgattgtggaggttaaatgggataactggcgttgaaacgttccaggcccatgagcaggactcaatgttccttcccttcccctttagtgtatggcttcttacatctggggaagagtcccaccaaagatcgattccaagcttcgcttcttggatgagcgagggaaactaggcgctaacttacctattcacccccgcgcccgttcccggcagccgggactcagggaagccaggtagccgcggtgctctcaactccctccccgcccgcgcacttcgaatccaaactgcgcggggcgaggcggggcggcgctccgatgaggtagctggcttgggagaggagtcccttgaggctgccgccaagccagggaagcgggaggcgcaggccacgcccggccactcacagacagtgacgtcatcccccgccgccactccggcgcttcccaggccctgctcgcgagtccccaccccgattgcgcacccgcgacttcagcccgaggggcggggattttcttggagcgacgggacgcgacgccaatcgcgacgaggcttcgccccgtggcgcggtttgaaattttgcggggctcaacggctcgcggagcggctacgcggagtgacatcgccggtgtttgcgggtggttgttgctctcggggccgtgtggagtaggtctggacctggactcacggctgcttggagcgtccgccatgaggagaagtgaggtgctggcggaggagtccatagtatgtctgcagaaagccctaaatcaccttcgggaaatatgggagctaattgggattccagaggaccagcggttacaaagaactgaggtggtaaagaagcatatcaaggaactcctggatatgatgattgctgaagaggaaagcctgaaggaaagactcatcaaaagcatatccgtctgtcagaaagagctgaacactctgtgcagcgagttacatgttgagccatttcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagcattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactcccccgtgtctcgacttcctccttctggcagcaagccagtcgctgcttccacctgttcagggaagaaaacaccccgtactggcaggcatggagccaacaaggagaacctggagctcaacggcagcatcctgagtggtgggtaccctggctcggcccccctccagcgcaacttcagcattaattctgttgccagcacctattctgagtttgcgcgagaactttcaaaggcttccaaatctgatgctacttctggaatcctcaattcaaccaacatccagtcctgagaagccctgatcagtcaaccagctgtggcttcctgtgcctagactggacctaattatatgggggtgactttagtttttcttcagcttaggcgtgcttgaaaccttggccaggttccatgaccatgggcctaacttaaagatgtgaatgagtgttacagttgaaagcccatcataggtttagtggtcctaggagacttggttttgacttatatacatgaaaagtttatggcaagaagtgcaaattttagcatatggggcctgacttctctaccacataattctacttgctgaagcatgatcaaagcttgttttatttcaccactgtaggaaaatgattgactatgcccatccctgggggtaattttggcatgtatacctgtaactagtaattaacatcttttttgtttaggcatgttcaattaatgctgtagctatcatagctttgctcttacctgaagccttgtccccaccacacaggacagccttcctcctgaagagaatgtctttgtgtgtccgaagttgagatggcctgccctactgccaaagaggtgacaggaaggctgggagcagctttgttaaattgtgttcagttctgttacacagtgcattgccctttgttgggggtatgcatgtatgaacacacatgcttgtcggaacgctttctcggcgtttgtcccttggctctcatctcccccattcctgtgcctactttgcctgagttcttctacccccgcagttgccagccacattgggagtctgtttgttccaatgggttgagctgtctttgtcgtggagatctggaactttgcacatgtcactactggggaggtgttcctgctctagcttccacgatgaggcgccctctttacctatcctctcaatcactactcttcttgaagcactattatttattcttccgctgtctgcctgcagcagtactactgtcaacatagtgtaaatggttctcaaaagcttaccagtgtggacttggtgttagccacgctgtttactcatacagtacgtgtcctgtttttaaaatatacaattattctta

SEQ ID NO: 171468 - DNA, 3034 bp, Homo sapiens
  Payload ID: 13724
  Gene Symbol: PRC1
  Gene Name: protein regulator of cytokinesis 1
  Uniprot ID: O43663
  ENST ID: ENST00000394249
  CDS Start-End: 79-1941
gtttgcgggtggttgttgctctcggggccgtgtggagtaggtctggacctggactcacggctgcttggagcgtccgccatgaggagaagtgaggtgctggcggaggagtccatagtatgtctgcagaaagccctaaatcaccttcgggaaatatgggagctaattgggattccagaggaccagcggttacaaagaactgaggtggtaaagaagcatatcaaggaactcctggatatgatgattgctgaagaggaaagcctgaaggaaagactcatcaaaagcatatccgtctgtcagaaagagctgaacactctgtgcagcgagttacatgttgagccatttcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagcattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactcccccgtgtctcgacttcctccttctggcagcaagccagtcgctgcttccacctgttcagggaagaaaacaccccgtactggcaggcatggagccaacaaggagaacctggagctcaacggcagcatcctgagtggtgggtaccctggctcggcccccctccagcgcaacttcagcattaattctgttgccagcacctattctgagtttgcgaaggatccgtccctctctgacagttccactgttgggcttcagcgagaactttcaaaggcttccaaatctgatgctacttctggaatcctcaattcaaccaacatccagtcctgagaagccctgatcagtcaaccagctgtggcttcctgtgcctagactggacctaattatatgggggtgactttagtttttcttcagcttaggcgtgcttgaaaccttggccaggttccatgaccatgggcctaacttaaagatgtgaatgagtgttacagttgaaagcccatcataggtttagtggtcctaggagacttggttttgacttatatacatgaaaagtttatggcaagaagtgcaaattttagcatatggggcctgacttctctaccacataattctacttgctgaagcatgatcaaagcttgttttatttcaccactgtaggaaaatgattgactatgcccatccctgggggtaattttggcatgtatacctgtaactagtaattaacatcttttttgtttaggcatgttcaattaatgctgtagctatcatagctttgctcttacctgaagccttgtccccaccacacaggacagccttcctcctgaagagaatgtctttgtgtgtccgaagttgagatggcctgccctactgccaaagaggtgacaggaaggctgggagcagctttgttaaattgtgttcagttctgttacacagtgcattgccctttgttgggggtatgcatgtatgaacacacatgcttgtcggaacgctttctcggcgtttgtcccttggctctcatctcccccattcctgtgcctactttgcctgagttcttctacccccgcagttgccagccacattgggagtctgtttgttccaatgggttgagctgtctttgtcgtggagatctggaactttgcacatgtcactactggggaggtgttcctgctctagcttccacgatgaggcgccctctttacctatcctctcaatcactactcttcttgaagcactattatttattcttccgctgtctgcctgcagcagtactactgtcaacatagtgtaaatggttctcaaaagcttaccagtgtggacttggtgttagccacgctgtttactcatacagtacgtgtcctgtttttaaaatatacaattattcttaaaaataaattaaaatctgtatacttacatttcaaaaaga

SEQ ID NO: 171469 - DNA, 2060 bp, Homo sapiens
  Payload ID: 13724
  Gene Symbol: PRC1
  Gene Name: protein regulator of cytokinesis 1
  Uniprot ID: O43663
  ENST ID: ENST00000442656
  CDS Start-End: 109-1686
ggagcggctacgcggagtgacatcgccggtgtttgcgggtggttgttgctctcggggccgtgtggagtaggtctggacctggactcacggctgcttggagcgtccgccatgaggagaagtgaggtgctggcggaggagtccatagtatgtctgcagaaagccctaaatcaccttcgggaaatatgggagctaattgggattccagaggaccagcggttacaaagaactgaggtggtaaagaagcatatcaaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagcattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactcccccgtgtctcgacttcctccttctggcagcaagccagtcgctgcttccacctgttcagggaagaaaacaccccgtactggcaggcatggagccaacaaggagaacctggagctcaacggcagcatcctgagtgcgagaactttcaaaggcttccaaatctgatgctacttctggaatcctcaattcaaccaacatccagtcctgagaagccctgatcagtcaaccagctgtggcttcctgtgcctagactggacctaattatatgggggtgactttagtttttcttcagcttaggcgtgcttgaaaccttggccaggttccatgaccatgggcctaacttaaagatgtgaatgagtgttacagttgaaagcccatcataggtttagtggtcctaggagacttggttttgacttatatacatgaaaagtttatggcaagaagtgcaaattttagcatatggggcctgacttctctaccacataattctacttgctgaagcatgatcaaagcttgttttatttcaccactgtaggaaa

SEQ ID NO: 171470 - DNA, 830 bp, Homo sapiens
  Payload ID: 13724
  Gene Symbol: PRC1
  Gene Name: protein regulator of cytokinesis 1
  ENST ID: ENST00000555455
  CDS Start-End: 1-716
atcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactcccccgtgtctcgacttcctccttctggcagcaagccagtcgctgcttccacctgttcagggaagaaaacaccccgtactggcaggcatggagccaacaaggagaacctggagctcaacggcagcatcctgagtggtgggtaccctggctcggcccccctccagcgcaacttcagcattaattctgttgccagcacctattctgagtttgcgaaggatccgtccctctctgacagttccactgttgggcttcaggacagccttcctcctgaagagaatgtctttgtgtgtccgaagttgagatggcctgccctactgccaaagaggtgacaggaaggctgggagcagctttgttaaattgtgttcagttctgttacacagtgcattgccctttgttgggggtatgcatgtatgaacacacatgcttgtcggaacgctttctcg

SEQ ID NO: 171471 - DNA, 584 bp, Homo sapiens
  Payload ID: 13724
  Gene Symbol: PRC1
  Gene Name: protein regulator of cytokinesis 1
  ENST ID: ENST00000559828
  CDS Start-End: 1-584
tttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagccagtcgctgcttccacctgttcagggaagaaaacaccccgtactggc

SEQ ID NO: 171472 - DNA, 414 bp, Homo sapiens
  Payload ID: 13724
  Gene Symbol: PRC1
  Gene Name: protein regulator of cytokinesis 1
  ENST ID: ENST00000559811
  CDS Start-End: 84-414
ccggtgtttgcgggtggttgttgctctcggggccgtgtggagtaggtctggacctggactcacggctgcttggagcgtccgccatgaggagaagtgaggtgctggcggaggagtccatagtatgtctgcagaaagccctaaatcaccttcgggaaatatgggagctaattgggattccagaggaccagcggttacaaagaactgaggtggtaaagaagcatatcaaggaactcctggatatgatgattgctgaagaggaaagcctgaaggaaagactcatcaaaagcatatccgtctgtcagaaagagctgaacactctgtgcagcgagttacatgttgagccatttcaggaattcacttggaatcttataacagtggtacgttgtcttattcaggaagaaggagagacgacca

SEQ ID NO: 171473 - DNA, 571 bp, Homo sapiens
  Payload ID: 13724
  Gene Symbol: PRC1
  Gene Name: protein regulator of cytokinesis 1
  ENST ID: ENST00000557905
  CDS Start-End: 109-571
ggagcggctacgcggagtgacatcgccggtgtttgcgggtggttgttgctctcggggccgtgtggagtaggtctggacctggactcacggctgcttggagcgtccgccatgaggagaagtgaggtgctggcggaggagtccatagtatgtctgcagaaagccctaaatcaccttcgggaaatatgggagctaattgggattccagaggaccagcggttacaaagaactgaggtggtaaagaagcatatcaaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagcattagaccacaccccagacacaagct

SEQ ID NO: 171474 - DNA, 755 bp, Homo sapiens
  Payload ID: 13724
  Gene Symbol: PRC1
  Gene Name: protein regulator of cytokinesis 1
  ENST ID: ENST00000560423
  CDS Start-End: 1-194
gtagcattcggcctatctttggagggacagtctaccactcccccgtgtctcgacttcctccttctggcagcaagccagtcgctgcttccacctgttcagggaagaaaacaccccgtactggcaggcatggagccaacaaggagaacctggagctcaacggcagcatcctgagtgaaggatccgtccctctctgacagttccactgttgggcttcagcgagaactttcaaaggcttccaaatctgatgctacttctggaatcctcaattcaaccaacatccagtcctgagaagccctgatcagtcaaccagctgtggcttcctgtgcctagactggacctaattatatgggggtgactttagtttttcttcagcttaggcgtgcttgaaaccttggccaggttccatgaccatgggcctaacttaaagatgtgaatgagtgttacagttgaaagcccatcataggtttagtggtcctaggagacttggttttgacttatatacatgaaaagtttatggcaagaagtgcaaattttagcatatggggcctgacttctctaccacataattctacttgctgaagcatgatcaaagcttgttttatttcaccactgtaggaaaatgattgactatgcccatccctgggggtaattttggcatgtatacctgtaactagtaattaacatcttttttgtttaggcatgttcaattaatgctgtagctatcatagctttgctcttacctgaagccttgtccc

SEQ ID NO: 171475 - DNA, 728 bp, Homo sapiens
  Payload ID: 13724
  Gene Symbol: PRC1
  Gene Name: protein regulator of cytokinesis 1
  ENST ID: ENST00000556972
  CDS Start-End: 1-141
cgacttcctccttctggcagcaagccagtcgctgcttccacctgttcagggaagaaaacaccccgtactggcaggcatggagccaacaaggagaacctggagctcaacggcagcatcctgagtggacagccttcctcctgaagagaatgtctttgtgtgtccgaagttgagatggcctgccctactgccaaagaggtgacaggaaggctgggagcagctttgttaaattgtgttcagttctgttacacagtgcattgccctttgttgggggtatgcatgtatgaacacacatgcttgtcggaacgctttctcggcgtttgtcccttggctctcatctcccccattcctgtgcctactttgcctgagttcttctacccccgcagttgccagccacattgggagtctgtttgttccaatgggttgagctgtctttgtcgtggagatctggaactttgcacatgtcactactggggaggtgttcctgctctagcttccacgatgaggcgccctctttacctatcctctcaatcactactcttcttgaagcactattatttattcttccgctgtctgcctgcagcagtactactgtcaacatagtgtaaatggttctcaaaagcttaccagtgtggacttggtgttagccacgctgtttactcatacagtacgtgtcctgtttttaaaatatacaattattcttaaaaataaattaaaatctgtatacttac

SEQ ID NO: 171476 - DNA, 806 bp, Homo sapiens
  Payload ID: 13725
  Gene Symbol: PROS1
  Gene Name: protein S (alpha)
  ENST ID: ENST00000348974
  CDS Start-End: 114-806
cgcgcagcacggctcagaccgaggcgcacaggctcgcagctccgcggcgcctagcgctccggtccccgccgcgacgcgccaccgtccctgccggcgcctccgcgcgcttcgaaatgagggtcctgggtgggcgctgcggggcgctgctggcgtgtctcctcctagtgcttcccgtctcagaggcaaacttttgtttatattttagaaatgattttatatacaaccgtgcatgcatttctgtattggtcggcttatctggatgcaattttttctattctatatgctttttgtcaaagcaacaggcttcacaagtcctggttaggaagcgtcgtgcaaattctttacttgaagaaaccaaacagggtaatcttgaaagagaatgcatcgaagaactgtgcaataaagaagaagccagggaggtctttgaaaatgacccggaaacggattatttttatccaaaatacttagtttgtcttcgctcttttcaaactgggttattcactgctgcacgtcagtcaactaatgcttatcctgacctaagaagctgtgtcaatgccattccagaccagtgtagtcctctgccatgcaatgaagatggatatatgagctgcaaagatggaaaagcttcttttacttgcacttgtaaaccaggttggcaaggagaaaagtgtgaatttgacataaatgaatgcaaagatccctcaaatataaatggaggttgcagtcaaatttgtgataatacacctggaagttaccactgttcctgtaaaaatggttttgttatgctttcaaataagaaagattgt

SEQ ID NO: 171477 - DNA, 3560 bp, Homo sapiens
  Payload ID: 13725
  Gene Symbol: PROS1
  Gene Name: protein S (alpha)
  Uniprot ID: P07225
  ENST ID: ENST00000394236
  CDS Start-End: 318-2348
aaaagcagcaactagggagctggtgaagaaggatgtctcagcagtgtttactaggcctccaacactagagcccatcccccagctccgaaaagcttcctggaaatgtccttgttatcacttcccctctcgggctgggcgctgggagcgggcggtctcctccgcccccggctgttccgccgaggctcgctgggtcgctggcgccgccgcgcagcacggctcagaccgaggcgcacaggctcgcagctccgcggcgcctagcgctccggtccccgccgcgacgcgccaccgtccctgccggcgcctccgcgcgcttcgaaatgagggtcctgggtgggcgctgcggggcgctgctggcgtgtctcctcctagtgcttcccgtctcagaggcaaactttttgtcaaagcaacaggcttcacaagtcctggttaggaagcgtcgtgcaaattctttacttgaagaaaccaaacagggtaatcttgaaagagaatgcatcgaagaactgtgcaataaagaagaagccagggaggtctttgaaaatgacccggaaacggattatttttatccaaaatacttagtttgtcttcgctcttttcaaactgggttattcactgctgcacgtcagtcaactaatgcttatcctgacctaagaagctgtgtcaatgccattccagaccagtgtagtcctctgccatgcaatgaagatggatatatgagctgcaaagatggaaaagcttcttttacttgcacttgtaaaccaggttggcaaggagaaaagtgtgaatttgacataaatgaatgcaaagatccctcaaatataaatggaggttgcagtcaaatttgtgataatacacctggaagttaccactgttcctgtaaaaatggttttgttatgctttcaaataagaaagattgtaaagatgtggatgaatgctctttgaagccaagcatttgtggcacagctgtgtgcaagaacatcccaggagattttgaatgtgaatgccccgaaggctacagatataatctcaaatcaaagtcttgtgaagatatagatgaatgctctgagaacatgtgtgctcagctttgtgtcaattaccctggaggttacacttgctattgtgatgggaagaaaggattcaaacttgcccaagatcagaagagttgtgaggttgtttcagtgtgccttcccttgaaccttgacacaaagtatgaattactttacttggcggagcagtttgcaggggttgttttatatttaaaatttcgtttgccagaaatcagcagattttcagcagaatttgatttccggacatatgattcagaaggcgtgatactgtacgcagaatctatcgatcactcagcgtggctcctgattgcacttcgtggtggaaagattgaagttcagcttaagaatgaacatacatccaaaatcacaactggaggtgatgttattaataatggtctatggaatatggtgtctgtggaagaattagaacatagtattagcattaaaatagctaaagaagctgtgatggatataaataaacctggacccctttttaagccggaaaatggattgctggaaaccaaagtatactttgcaggattccctcggaaagtggaaagtgaactcattaaaccgattaaccctcgtctagatggatgtatacgaagctggaatttgatgaagcaaggagcttctggaataaaggaaattattcaagaaaaacaaaataagcattgcctggttactgtggagaagggctcctactatcctggttctggaattgctcaatttcacatagattataataatgtatccagtgctgagggttggcatgtaaatgtgaccttgaatattcgtccatccacgggcactggtgttatgcttgccttggtttctggtaacaacacagtgccctttgctgtgtccttggtggactccacctctgaaaaatcacaggatattctgttatctgttgaaaatactgtaatatatcggatacaggccctaagtctatgttccgatcaacaatctcatctggaatttagagtcaacagaaacaatctggagttgtcgacaccacttaaaatagaaaccatctcccatgaagaccttcaaagacaacttgccgtcttggacaaagcaatgaaagcaaaagtggccacatacctgggtggccttccagatgttccattcagtgccacaccagtgaatgccttttataatggctgcatggaagtgaatattaatggtgtacagttggatctggatgaagccatttctaaacataatgatattagagctcactcatgtccatcagtttggaaaaagacaaagaattcttaaggcatcttttctctgcttataataccttttccttgtgtgtaattatacttatgtttcaataacagctgaagggttttatttacaatgtgcagtctttgattattttgtggtcctttcctgggatttttaaaaggtcctttgtcaaggaaaaaaattctgttgtgatataaatcacagtaaagaaattcttacttctcttgctatctaagaatagtgaaaaataacaattttaaatttgaatttttttcctacaaatgacagtttcaatttttgtttgtaaaactaaattttaattttatcatcatgaactagtgtctaaatacctatgtttttttcagaaagcaaggaagtaaactcaaacaaaagtgcgtgtaattaaatactattaatcataggcagatactattttgtttatgtttttgtttttttcctgatgaaggcagaagagatggtggtctattaaatatgaattgaatggagggtcctaatgccttatttcaaaacaattcctcagggggaacagctttggcttcatctttctcttgtgtggcttcacatttaaaccagtatctttattgaattagaaaacaagtgggacatattttcctgagagcagcacaggaatcttcttcttggcagctgcagtctgtcaggatgagatatcagattaggttggataggtggggaaatctgaagtgggtacattttttaaattttgctgtgtgggtcacacaaggtctacattacaaaagacagaattcagggatggaaaggagaatgaacaaatgtgggagttcatagttttccttgaatccaacttttaattaccagagtaagttgccaaaatgtgattgttgaagtacaaaaggaactatgaaaaccagaacaaattttaacaaaaggacaaccacagagggatatagtgaatatcgtatcattgtaatcaaagaagtaaggaggtaagattgccacgtgcctgctggtactgtgatgcatttcaagtggcagttttatcacgtttgaatctaccattcatagccagatgtgtatcagatgtttcactgacagtttttaacaataaattcttttcactgtattttatatcacttataataaatcggtgtataattttaaaatgcatgtgaatatctttattatatcaactgtttgaataaaacaaaattacataatagacatttaactcttcataca

SEQ ID NO: 171478 - DNA, 3335 bp, Homo sapiens
  Payload ID: 13725
  Gene Symbol: PROS1
  Gene Name: protein S (alpha)
  ENST ID: ENST00000407433
  CDS Start-End: 562-2199
gaatgaggaagacgcaaaagcagaaacccctgataaaaccatcagacttcatgagacttattcaccaccatgagaacagtatgggggaaaccaccccagtgattcaattttctcccaccagttgcctcccacaacatgtggcaattatgggagttcaattaaagatgagatttggatggggacacagagccaaaccatatcaagtacaaagaaaagagtctcataagatgcaagtgaggaagagttttgtcaaagcaacaggcttcacaagtcctggttaggaagcgtcgtgcaaattctttacttgaagaaaccaaacagggtaatcttgaaagagaatgcatcgaagaactgtgcaataaagaagaagccagggaggtctttgaaaatgacccggaaacggattatttttatccaaaatacttagtttgtcttcgctcttttcaaactgggttattcactgctgcacgtcagtcaactaatgcttatcctgacctaagaagctgtgtcaatgccattccagaccagtgtagtcctctgccatgcaatgaagatggatatatgagctgcaaagatggaaaagcttcttttacttgcacttgtaaaccaggttggcaaggagaaaagtgtgaatttgacataaatgaatgcaaagatccctcaaatataaatggaggttgcagtcaaatttgtgataatacacctggaagttaccactgttcctgtaaaaatggttttgttatgctttcaaataagaaagattgtaaagatgtggatgaatgctctttgaagccaagcatttgtggcacagctgtgtgcaagaacatcccaggagattttgaatgtgaatgccccgaaggctacagatataatctcaaatcaaagtcttgtgaagatatagatgaatgctctgagaacatgtgtgctcagctttgtgtcaattaccctggaggttacacttgctattgtgatgggaagaaaggattcaaacttgcccaagatcagaagagttgtgaggttgtttcagtgtgccttcccttgaaccttgacacaaagtatgaattactttacttggcggagcagtttgcaggggttgttttatatttaaaatttcgtttgccagaaatcagcagattttcagcagaatttgatttccggacatatgattcagaaggcgtgatactgtacgcagaatctatcgatcactcagcgtggctcctgattgcacttcgtggtggaaagattgaagttcagcttaagaatgaacatacatccaaaatcacaactggaggtgatgttattaataatggtctatggaatatggtgtctgtggaagaattagaacatagtattagcattaaaatagctaaagaagctgtgatggatataaataaacctggacccctttttaagccggaaaatggattgctggaaaccaaagtatactttgcaggattccctcggaaagtggaaagtgaactcattaaaccgattaaccctcgtctagatggatgtatacgaagctggaatttgatgaagcaaggagcttctggaataaaggaaattattcaagaaaaacaaaataagcattgcctggttactgtggagaagggctcctactatcctggttctggaattgctcaatttcacatagattataataatgtatccagtgctgagggttggcatgtaaatgtgaccttgaatattcgtccatccacgggcactggtgttatgcttgccttggtttctggtaacaacacagtgccctttgctgtgtccttggtggactccacctctgaaaaatcacaggatattctgttatctgttgaaaatactgtaatatatcggatacaggccctaagtctatgttccgatcaacaatctcatctggaatttagagtcaacagaaacaatctggagttgtcgacaccacttaaaatagaaaccatctcccatgaagaccttcaaagacaacttgccgtcttggacaaagcaatgaaagcaaaagtggccacatacctgggtggccttccagatgttccattcagtgccacaccagtgaatgccttttataatggctgcatggaagtgaatattaatggtgtacagttggatctggatgaagccatttctaaacataatgatattagagctcactcatgtccatcagtttggaaaaagacaaagaattcttaaggcatcttttctctgcttataataccttttccttgtgtgtaattatacttatgtttcaataacagctgaagggttttatttacaatgtgcagtctttgattattttgtggtcctttcctgggatttttaaaaggtcctttgtcaaggaaaaaaattctgttgtgatataaatcacagtaaagaaattcttacttctcttgctatctaagaatagtgaaaaataacaattttaaatttgaatttttttcctacaaatgacagtttcaatttttgtttgtaaaactaaattttaattttatcatcatgaactagtgtctaaatacctatgtttttttcagaaagcaaggaagtaaactcaaacaaaagtgcgtgtaattaaatactattaatcataggcagatactattttgtttatgtttttgtttttttcctgatgaaggcagaagagatggtggtctattaaatatgaattgaatggagggtcctaatgccttatttcaaaacaattcctcagggggaacagctttggcttcatctttctcttgtgtggcttcacatttaaaccagtatctttattgaattagaaaacaagtgggacatattttcctgagagcagcacaggaatcttcttcttggcagctgcagtctgtcaggatgagatatcagattaggttggataggtggggaaatctgaagtgggtacattttttaaattttgctgtgtgggtcacacaaggtctacattacaaaagacagaattcagggatggaaaggagaatgaacaaatgtgggagttcatagttttccttgaatccaacttttaattaccagagtaagttgccaaaatgtgattgttgaagtacaaaaggaactatgaaaaccagaacaaattttaacaaaaggacaaccacagagggatatagtgaatatcgtatcattgtaatcaaagaagtaaggaggtaagattgccacgtgcctgctggtactgtgatgcatttcaagtggcagttttatcacgtttgaatctaccattcatagccagatgtgtatcagatgtttcactgacagtttttaacaataaattcttttcactgtattttatatcacttataataaatcggtgtataattttaaaa

SEQ ID NO: 171479 - DNA, 562 bp, Homo sapiens
  Payload ID: 13725
  Gene Symbol: PROS1
  Gene Name: protein S (alpha)
  ENST ID: ENST00000472684
  CDS Start-End: 395-562
agcattgtcgactgaactgcgtgccctggttggtaggattttcttctctagagctgcagcctcctagaaagtttccattttgtcaaagcaacaggcttcacaagtcctggttaggaagcgtcgtgcaaattctttacttgaagaaaccaaacagggtaatcttgaaagagaatgcatcgaagaactgtgcaataaagaagaagccagggaggtctttgaaaatgacccggaaacggattatttttatccaaaatacttagtttgtcttcgctcttttcaaactgggttattcactgctgcacgtcagtcaactaatgcttatcctgacctaagaagctgtgtcaatgccattccagaccagtgtagtcctctgccatgcaatgaagatggatatatgagctgcaaagatggaaaagcttcttttacttgcacttgtaaaccaggttggcaaggagaaaagtgtgaatttgacataaatgaatgcaaagatccctcaaatataaatggaggttgcagtcaaatttgtgataatacacctggaagttaccactgttcctgtaaa

SEQ ID NO: 171480 - DNA, 3481 bp, Homo sapiens
  Payload ID: 13726
  Gene Symbol: PSKH1
  Gene Name: protein serine kinase H1
  Uniprot ID: P11801
  ENST ID: ENST00000291041
  CDS Start-End: 171-1445
gagaatggcggcggcggcggcggcggcggcggccgctgccattgcccggagatggccggcagagccgccgagacgccgaagagcccgccgcccgcgcgaggtgtagacggggcactgccttcagagcaggtcctgccagcctcgctggagaggatgccctcgtgtccgtgatgggctgtgggacaagcaaggtccttcccgagccacccaaggatgtccagctggatctggtcaagaaggtggagcccttcagtggcactaagagtgacgtgtacaagcacttcatcacagaggtggacagtgttggccctgtcaaagccgggttcccagcagcaagtcagtatgcacacccctgccccggtcccccgactgctggccacacggagcctccctcagaaccaccacgcagggccagggtagctaagtacagggccaagtttgacccacgtgttacagctaagtatgacatcaaggccctaattggccgaggcagcttcagccgagtggtacgtgtagagcaccgggcaacccggcagccgtatgccatcaagatgattgagaccaagtaccgggaggggcgggaggtgtgtgagtcggagctgcgtgtgctgcgtcgggtgcgtcatgccaacatcatccagctggtggaggtgttcgagacacaggagcgggtgtacatggtgatggagctggccactggtggagagctctttgaccgcatcattgccaagggctccttcaccgagcgtgacgccacgcgggtgctgcagatggtgctggatggcgtccggtatctgcatgcactgggcatcacacaccgagacctcaaacctgagaatctgctctactaccatccgggcactgactccaagatcatcatcaccgacttcggcctggccagtgctcgcaagaagggtgatgactgcttgatgaagaccacctgtggcacgcctgagtacattgccccagaagtcctggtccgcaagccatacaccaactcagtggacatgtgggcgctgggcgtcattgcctacatcctactcagtggcaccatgccgtttgaggatgacaaccgtacccggctgtaccggcagatcctcaggggcaagtacagttactctggggagccctggcctagtgtgtccaacctggccaaggacttcattgaccgcctgctgacagtggaccctggagcccgtatgactgcactgcaggccctgaggcacccgtgggtggtgagcatggctgcctcttcatccatgaagaacctgcaccgctccatatcccagaacctccttaaacgtgcctcctcgcgctgccagagcaccaaatctgcccagtccacgcgttccagccgctccacacgctccaataagtcacgccgtgtgcgggaacgggagctgcgggagctcaacctgcgctaccagcagcaatacaatggctgagccgcctggctgtgcacacatgcagcacgacccagcctggccacacactgtggtgccatctgggtccgatgccctctctggagataggcctatgtggcccacagtaggtgaagaatgtctggctccagccctttctctgtgccttcagcagcccctgtcctcaccatgggcctgggccaggtgtgacagagtagaggtagcacagggggctgtgactccccctgaactgggagcctggcctggcactgatacccctcttggtgggcagctgctctggtggagttgggaagggataggacctggccttcactgtctcccttgccctttgacttttccccaatcaaagggaactgcagtgctgggtggagtgtcctgtggcctcaggaccctttgggacagttacttctgggaccccctttcctccacagagcccttctccctggtttcacacattcccatgcatcctgatccttaagattatgctccagtgggagaccctggtaggcacaaagcttgtgccttgactggacccgtagcccctggctaggtcgaaacagccctccacctcccagccaagatctgtcttccttcatggtgcctccagggagccttcctggtcccaggacctctggtggagggccatggcgtggaccttcacccttctggactgtgtggccatgctggtcatcggcttgcccaggctccagcctctccagattctgaggggtctcagcccaccgcccttggtgccttctttgtagagcccaccgctacctccctctccccgttggatgtccattccattccccaggtgcctccttcccaactgggggtggttaaagggagccccactgctgctacctggggaatggggcacctgggggccaaggcagagggaagggggtcctcccgattagggtcgagtgtcagcctgggttctatcctttggtgcagccccattgccttttcccttcaggctctgttgctccctcctctgcagctgcacgaaggcgccatctggtgtctgcatgggtgttggcagcctgggagtgatcactgcacgcccatcgtgcacacctgcccatcgtgcacacccacccatggtgcacacctgtagtcctccatgaggacatgggaaggtaggagttgccgccctgggggagggtcccgggctgctcacctctccccttctgctgagcttctgcgcacccctccctggaacttagccatactgtgtgacctgcctctgaaaccagggtgccaggggcactgccttctcacagctggccttgccccgtccaccctgtgctgcttcccttcacagcattaaccttccagtctgggtcccactgagcctcaagctggaaggagcccctgcgggaggtgggtggggttgggtggctgctttcccagaggcctgagccagaaccatccccatttcttttgtggtatctccccctaccacaaaccaggctggaacccaagccccttcctccacagctgccttcagtgggtagaatggggccagggcccagctttggccttagcttgacggcagggcccctgccattgcaggagggtttggttcccactcagcttctgccggtcggcagcctgggccaggcccttttcctgcatgtgccacctccagtgggaaacaaaactaaagagaccactctgtgccaagtcgactatgccttagacacatcctcctaccgtccccaatgccccctgggcaggaggcagtggagaaccaagccccatggcctcagaatttccccccagttccccaagtgtctctggggacctgaagccctggggcttacgttctctcttgcccagggtgggcctggtcctgagggcaggacagggggtttggagatgtgggcctttgatagacccacttgggccttcatgccatggcctgtggatggagaatgtgcagttatttattatgcgtattcagtttgtaaacgtatcctctgtattcagtaaacaggctgcctctccagggagggctgccattcattccaaca

SEQ ID NO: 171481 - DNA, 1509 bp, Homo sapiens
  Payload ID: 13726
  Gene Symbol: PSKH1
  Gene Name: protein serine kinase H1
  ENST ID: ENST00000570631
  CDS Start-End: 171-1232
gagaatggcggcggcggcggcggcggcggcggccgctgccattgcccggagatggccggcagagccgccgagacgccgaagagcccgccgcccgcgcgaggtgtagacggggcactgccttcagagcaggtcctgccagcctcgctggagaggatgccctcgtgtccgtgatgggctgtgggacaagcaaggtccttcccgagccacccaaggatgtccagctggatctggtcaagaaggtggagcccttcagtggcactaagagtgacgtgtacaagcacttcatcacagaggtggacagtgttggccctgtcaaagccgggttcccagcagcaagtcagtatgcacacccctgccccggtcccccgactgctggccacacggagcctccctcagaaccaccacgcagggccagggtagctaagtacagggccaagtttgacccacgtgttacagctaagtatgacatcaaggccctaattggccgaggcagcttcagccgagtggtacgtgtagagcaccgggcaacccggcagccgtatgccatcaagatgattgagaccaagtaccgggaggggcgggaggtgtgtgagtcggagctgcgtgtgctgcgtcgggtgcgtcatgccaacatcatccagctggtggaggtgttcgagacacaggagcgggtgtacatggtgatggagctggccactggtggagagctctttgaccgcatcattgccaagggctccttcaccgagcgtgacgccacgcgggtgctgcagatggtgctggatggcgtccggtatctgcatgcactgggcatcacacaccgagacctcaaacctgagaatctgctctactaccatccgggcactgactccaagatcatcatcaccgacttcggcctggccagtgctcgcaagaagggtgatgactgcttgatgaagaccacctgtggcacgcctgagtacattgccccagaagtcctggtccgcaagccatacaccaactcagtggacatgtgggcgctgggcgtcattgcctacatcctactcagtggcaccatgccgtttgaggatgacaaccgtacccggctgtaccggcagatcctcaggggcaagtacagttactctggggaggtgagtctgtcctgcccctgtcctggatgttggggaggcacctgcgggggcaggtatatcctgcagctctcagtcagaggtatgtcctcagggccatgctcgtgagggccaggcaggtcatataaaagggacaaagtgagactatcagaatgtagtttgggttccctcaaggtgagccctgagacaaggacttgggagcagatagtttatttgggatgtgatttgagtaactaaaagtgaaggagtgggaaaagtgaggcaggaagggagaaagtcagtagagtatattgagaaatggactgccactgtgggccactgggaaccttggtaataaccatgtggaatgtgcctcatagttgtaccaccaaagagcaggaacgtg

SEQ ID NO: 171482 - DNA, 1322 bp, Homo sapiens
  Payload ID: 13727
  Gene Symbol: PSKH2
  Gene Name: protein serine kinase H2
  Uniprot ID: Q96QS6
  ENST ID: ENST00000276616
  CDS Start-End: 76-1233
tgataaagggcggaggaacggggctggctgcttcccgagtccccaggtcccgcgagcggcgggcgtgttgcgggtatggggtgcggcgccagcaggaaggtggtcccggggccaccagcgctggcttgggccaagcacgaaggtcaaaaccaagccggcgtcggaggcgcggggcctgggcccgaggcggcggcccaggcggcgcagaggatacaggtggctcgcttccgagccaagttcgacccccgggtccttgccagatatgacatcaaagctcttattgggacaggcagtttcagcagggttgtcagggtagagcagaagaccaccaagaaaccttttgcaataaaagtgatggaaaccagagagagggaaggtagagaagcgtgcgtgtctgagctgagcgtcctgcggcgggttagccatcgttacattgtccagctcatggagatctttgagactgaggatcaagtttacatggtaatggagctggctaccggaggggagctctttgatcgactcattgctcagggatcctttacagagcgggatgccgtcaggatcctccagatggttgctgatgggattaggtatttgcatgcgctgcagataactcataggaatctaaagcctgaaaacctcttatactatcatccaggtgaagagtcgaaaattttaattacagattttggtttggcatactccgggaaaaaaagtggtgactggacaatgaagacactctgtgggaccccagagtacatagctcctgaggttttgctaaggaagccttataccagtgcagtggacatgtgggctcttggtgtgatcacatatgctttacttagcggattcctgccttttgatgatgaaagccagacaaggctttacaggaagattctgaaaggcaaatataattatacaggagagccttggccaagcatttcccacttggcgaaggactttatagacaaactactgattttggaggctggtcatcgcatgtcagctggccaggccctggaccatccctgggtgatcaccatggctgcagggtcttccatgaagaatctccagagggccatatcccgaaacctcatgcagagggcctctccccactctcagagtcctggatctgcacagtcttctaagtcacattattctcacaaatccaggcatatgtggagcaagagaaacttaaggatagtagaatcgccactgtctgcgcttttgtaagcagatgacctctaaaactatttttgcctattttaggaccatttcatcatgattagggcaccctcaagctccaaagacacgggactcca

SEQ ID NO: 171483 - DNA, 11464 bp, Homo sapiens
  Payload ID: 13728
  Gene Symbol:
  Gene Name: Protein SOGA3  [Source:UniProtKB/Swiss-Prot
  Acc:Q5TF21]
  Uniprot ID: Q5TF21
  ENST ID: ENST00000481848
  CDS Start-End: 512-3355
ctctttggttacttctaccctatcgtcccttgcaatcccgccttctctcctgcccagttcggtgaggtcagctcatgaacatctctgcacttcctggggagcgtctggcccagcttggtacctcgcgtgttagcctgctgagagctgcagctccagcccagccgcggaccgccgggaagtcacccgctctgggggcagctgaatcttgacgttaccgccattgtttggagaaatcgagtgggtgtggaactgcggcgagcgagcccaaagtcatgctcagccggaaagtcgcatacaataatatgaagttgaactttcctcggcgcagaaaggcacaataataaaccctgagatccccggaatatcagaaggaaagtgctgttgatttgttcagctacttggaaacctcgcctctgctgagaacttaggaaggaaggttggcggcggtgaagagggaagaggatgatctagtaatgggctcttccaaatcgcatctggtaggttcatagccatgagtcagccaccaatcgggggcgctgcccctgccacagcagcagcttctcccgccgctgcagccactgaggctcgtctgcacccggagggcagcagcagaaagcagcagcgagctcagtcacccgctagaccgagggacagttcgctgcgacagacaatcgcggccacccggtccccagtgggggccggcactaaactcaattctgttcggcagcagcagctgcagcagcagcaacagcagggtaacaagaccgggagccgcacggggccgcccgccagcatccgaggaggcggaggtggggccgagaaggcgacgcccctggcgcccaaaggggccgctccgggagctgtccagcctgtggctggtgctgaagcggcccccgccgcgaccctggccgctttgggcggcaggaggcccggaccgcccgaggagccgcctcgggagctagagtccgtgccctcgaaactcggggaaccccctccgctcggagaagggggaggagggggcggggaaggaggaggagccggcggcggctccggggaaagggaggggggcgctccgcagccgccgccgcccaggggctggcgagggaaaggcgtacgcgctcagcagaggggcggcagcggcggggagggggcctccccttctccatcctcctcttctgcgggcaaaaccccaggaaccggcagcagaaactccggaagcggcgttgcggggggcggcagcggtggtggagggagctactggaaagaaggatgtctgcagtctgagctcatccagttccatctcaagaaggagcgggcggcagcggcggcggccgcggctcagatgcacgctaagaacggcggcggcagcagtagccgcagctccccggtgtctggcccccctgccgtttgcgagaccctggccgtcgcctccgcctccccaatggcggcggcggcggagggcccccagcagagcgcagagggcagcgcgagcggcgggggcatgcaggcggcagcgcccccttcgtcgcagccgcacccgcagcagctccaagagcaggaagaaatgcaagaggagatggagaagctgcgagaggaaaacgagactctcaagaacgagatcgatgagctgagaaccgagatggacgagatgagggacactttcttcgaggaggatgcctgtcaactgcaggaaatgcgccacgagttggagagagccaacaaaaactgccggatcctgcagtaccgcctccgcaaagccgagcgcaaaaggctccgctacgcccagaccggggaaatcgacggggagctgttgcgcagcctggagcaggacctcaaggttgcaaaggatgtatctgtgagacttcaccatgaattagaaaatgtggaagaaaagagaacaacaacagaagatgaaaatgagaaactgaggcaacagctcatagaagttgaaattgcaaagcaagctttacagaatgaactggaaaaaatgaaagagttatccttaaaaagaagaggaagcaaagatttgccaaaatctgaaaaaaaggctcaacagactcccacagaggaggacaatgaagatctgaagtgccagctgcagtttgttaaggaagaagccgctttgatgagaaagaaaatggccaagattgataaagaaaaggacagatttgaacacgagctccagaagtacagatccttttatggggatctggacagtcctttgcccaaaggagaagccggaggccctcccagcactagggaggccgagctcaagctacggctaaggctggtggaggaagaagccaacatcctgggcaggaaaatcgtcgaactggaggtggagaacagaggcctgaaggcggaactggacgaccttaggggcgatgacttcaacggctcggccaacccgctcatgagggagcagagcgaatccctgtcggagctgcggcagcacctgcagctggtggaagacgagacggagctgctgcggaggaacgtggccgacctggaggagcagaacaagcgcatcacggcggagctcaacaagtacaagtacaagtccggcggccacgacagcgcgcggcaccacgacaacgccaagaccgaggccctgcaggaggagctgaaggcggcgcgcctgcagatcaacgagctcagcggcaaggtcatgcagctgcagtacgagaaccgcgtgcttatgtccaacatgcagcgctacgacctggcctcgcacctgggcatccgcggcagcccccgcgacagcgacgccgagagcgacgcgggcaagaaggagagcgacgacgactcgcggcctccgcaccgcaagcgcgaagggcccatcggcggcgagagcgactcggaggaggtgcgcaacatccgctgcctcacgcccactcgctccttctacccggcgcccgggccctggcccaagagcttctccgatcggcagcagatgaaggacatccgctcggaggccgagcgcctgggcaagaccatcgaccggctcatcgccgacacgagcaccatcatcaccgaggcgcgcatctacgtggccaacggggacctgttcggactcatggacgaggaggacgacggcagccgcatccgggagcacgagctgctctaccgcatcaacgctcagatgaaggccttccgcaaggagctgcagaccttcatcgaccgcctcgaggtgcccaagtctgcggacgaccgcggcgccgaggagcccatttccgtgagtcagatgttccagcctatcattttacttattctcattcttgtattattttcatcactttcttacacaacaatatttaaacttgtcttcctttttacactgttttttgtactgtaaatctttcatcatttaccattcattgtagtattttcagtttgtttattttgttcacccttcaagacaagaagtaaaagaagtataatttctgtagtaaccaatgctataaaaacactgaagactgcttatttctttaaaaagatacaactcatcttaccaagaccaaattcaataagaagcccaaacactaaaatatttcaggctttattttaaaggcaagtgagactgcttcaaataaaacaacttcaagcttccaagaaacagttaagaggaggcagagaagagcagaaacacttctttgctgacacttacactgttgccatggacctacataagcagtgggagaacacagagactaactggcataaggaaaagatggaattactggaccagtttgacaatgaaagaaaggaatgggaaagtcaatggaagattatgcagaagaaaatagaagagctttgccgggaagtaaagctttggaggaaaatcaatatcaatgaaagtgctaagatcattgatctttaccatgagaagaccattccagagaaagtgatagaatcttccccaaattaccccgatttaggacaaagtgaatttataaggacgaatcacaaagatggtctgagaaaagaaaataaaagagagcagagcttagtcagtggaggaaatcaaatgtgtaaggaacaaaaagcaacaaaaaaatcaaaagtagggtttttggatcctttggctacagacaaccaaaaggaatgtgaggcctggcctgacctgaggacttctgaggaagacagcaagagctgttctggcgccctcagtacagctcttgaagaacttgcgaaggtgagtgaagaattatgcagctttcaagaggaaattcgaaagcggtctaaccatagaaggatgaagtcagattcttttctccaggaaatgccaaatgtaactaatatacctcatggggaccccatgatcaacaatgaccagtgcattcttccaatcagtttagaaaaagaaaaacagaaaaacaggaagaatctgagctgtaccaatgtgctccagagcaattctacgaaaaaatgtggaattgatacaatcgatttaaaaagaaatgaaactccaccagttcctcctccaagaagcacctctcgaaattttcccagctcggattctgaacaagcctatgaaagatggaaggaaaggttagaccacaacagctgggtgccccatgagggtcgaagtaaaaggaattacaaccctcacttccctttgagacaacaagagatgtctatgttgtatccaaatgaagggaaaacttcgaaagatggtatcatcttttcctctttggtaccagaagtcaaaatagatagcaagcctccaagtaatgaagatgttggacttagcatgtggtcatgtgacattgggataggtgcaaaaaggagcccctctacttcgtggtttcagaaaacctgctctacccccagtaatccaaaatatgaaatggtgatcccagatcaccctgctaaatctcatcctgatcttcatgtaagtaatgactgtagctcctcagtagcagagagcagtagcccacttagaaatttcagttgtggctttgaaaggactacaaggaatgagaagctggcagcaaagactgatgaatttaacagaactgtatttagaacagatagaaattgtcaggcaatacagcaaaatcacagctgctcaaaatcatcggaggatctcaagccctgtgatacctcatctactcacacaggtagcatatcacaaagtaacgatgtgtccggtatttggaaaaccaatgcccacatgcctgtgcccatggaaaatgtgcctgataatcccaccaagaaatccacaacaggcctagtaagacaaatgcagggacacctaagtcctcgcagttatcgaaatatgctccacgagcatgactggagaccgagtaatttgtctggccgtccgaggtcagctgatcccaggtcaaattatggtgttgtggaaaagctgctgaaaacctatgagacagcaacagagtctgcattgcaaaattctaagtgcttccaggataattggaccaaatgtaattctgatgtcagtggtggtgccacattaagtcagcatttagaaatgctccaaatggaacaacagtttcagcaaaagacagctgtgtgggggggacaggaagtgaagcaaggaatagatccgaaaaagataacagaggaatccatgtcagtgaacgcctcacatggaaaaggattttcccgacctgctagaccagcaaatcgtcgtctcccctccagatgggcatccagatctccatctgcaccccctgccttgcggagaactacccacaactataccatttctctgcgatccgaagcattgatggtttaagtctttggcctggattgctatattacagaagttctagtcccacttgtcaaacagagcattctgagtgtttacaggcggacctgttctcttccgacaagcaatttgaatcttaactttccatcagtcttcagtgtttttaatctaaggaataattatcttcctgcattttgatttcttagatcagaattttttaatgccatcctcattagttttccaatacaatataagttgaaacaatgtacaatattgtatattctttgttgcaagtggcagaaagtaaggttatgtgcatggccatgtgtttgtaggtgcatgtgttgaaataggaagtatcctagtatgtatttagatatgaaaaacttatgtgctagtgttgactttgaaattataacatgtatacctatatattctttgtgtttatttaaaagttttgaaaatatgcagtactgtttatattttgtataccttttaataggtatccacttaaggcatttgcagtacaaatattaattgaccacttccttggcccccagctacaatgaaaaagaagaattatgcacacatctaacattggtagatttctaaagacaactcataaataatttcttaacccatataaggataaaataataccattgatattcttgtttattctttttaaataaaaatgtcacaagtttaatagatcagccttgtaaagcaagcataaaatgttcataaatgttttatatattatttggtagtctagtatggctttaactgaatatttgatcctcagagacagtatcatgagactgcattataaatgacatgattaaatgatgaatttattttgtcagcctcagcaacaaacatttcctaaatgggatgcaaaaagaaactgaatgatgttgaattttagtttttctttaagttgtggtaagcttttagtttagctgctttaacatggagtcatacatacttagaggtaagtcatttattatttttttcctttttctaatcttttccttaaaattaatagataacaaactaagttacttttttactaacaaggaagatcaggaataatatttctttgaaagctgaaattatacttctcacagtttgctaccgaaaaaaggcttaaactaaaccttgacatccacagtagcatcaggaatagaaatgtgtattttggctacagtttgcatacagtgaacacataaaatctatattgaaaactgacagaaatatgaatgtcgaggggcttggaattctaaatggaagattttagaaggaactttgctctctactgtcactatataaaaccaattatgttatgttattagatattaactctatttaagcttttcttttactaagaaattcttatgccaaatgtattccaagagccatctccttatgatgtatttgaaccatttagagaaattcacttcattgtaccccatgacctgaggtaaagaaaataattttcaaattgcagacttccttgaaaggctcaagactgtagcatggtgatgtctagattcatactttactgtaaggacagtttcggtagttaagtggaattaaaggtctagagtgatttgtattggatggtaactaaggtctatacatctactcttttaattcttatttccttcaggaagatccttttccacaggaagctatcaaagaaaagtaaactagacaccaagtaatatcactctcataatatgctttccagctagaggggagaaaacaccaggaaagaggaaccctgggtcataaaatgacggacctgttaggaaaatgctgttgtgtgacaatggagagcctgcccaaggactgtgcaacctatctgttcctctccaccagtgtatcccaagtagtctggtatgatctgtggttccttagaatattgaggatctctttaaaaaatgaaatttctgatctcaccccatattactaaagcaaaatttccaggggtagggactgggactccagaaccattaataaaacaaaacaaaacaaagcaaaatattgatgatcaggcagatttgaaaacagtgacattgcttgatctctgaatggatggatgcccttgggtggtcacttttcttcctaggacttgcctttgttatctgtaaattagaatggctatactttcagacttcacaattttaagccacttttttctattaacagttgaatgaaccagtgggacacattttaacgtcttcttatgttgactaaaattatagttagagctgagaaaaaaaaaatagcatctagtccaactccttgattgtaaaactgaaaaactaaggttatttgaatgttctgttttctctttttaaatattttataacttttaaatggaaaaacctattaggtaaatggaaataatccttgaaaatagtttttgatgttttgtgatttttaactggtaaatttctactttaggtgggcattttcttccctagaatatgccctttattatgctatcattgctagatttaaagggacttgtaagcatttctggaaatatttgatttaaaaacatatattaatagatgttttccctagcagacttttggagcaaaaatattattttagttcagcagaggattactgatattatgggctgatctcagaaaggaataaggatgaggcagagaggagtacttgagtttgtgtgtgtgtgtgtgtgtgtgtgtttgtgtcagtgtcacataagttctccatattgccttatgtcccaaagccaaatataaaaatataaatgatgctttgtataattcattttatcaaaaattacccataactttcatttgtttttatatcgacaatgaagatgatcatatttcattttgcagatgtggccataaaatattatttacttctatataggtgattttaccaggtttagttatcctgagaaaacatctggacttaagagtttctgcttccctacaaagatctttaaagttatttttaggcacatttgtgacaaacaactacttgatattgaaatctccttcagccattagaagctatcaaataaagtaggtgtaaaaacaactgtctgtggcatttgtatacatcgagaacatttttctttccctcattttctgcagtgaactccagtaaagctaagtgtcttatgaaatctaaactcatatatgtacacagttcactctagcttcttccaaaatatctctaggtagtacaactgaagccaaacctgcctgacttcctgctcctggccacccaaaactccatatggcttctcgtacactgacatcctctctctacccatttaactgctaattgagtctgataaaagtcttctttgaaaaaagtttttacttctaagatttgcatttacatcataaaattaaaccattttcaggaaaatcagatttttttattacagtactatttgctttaaattcggcatgtttttcttaagtagcaagtacatgtatcggaacttagaactggtgggcgcggtggctcttgcctgtaatcccagcactttgggaggccaaggtggggggatcacgaggtcaggagatggagaccatcctggtttcatcacggtgaaaccccctctctgctaaaaatacaaaaaattagccaggcattgtggtggtcacctgtagtcccagctgctcgggaggctgaggcaggagaatggcatgaacccgggaggcagagcttgcagtgagcagagatcgcgccactgcactccagcctgggtgacagagtgagactctgtctcaaaaaaaaaaaaaaaaaagaacttataactatgacttgttcatctcaccctgaaaatatgttcctacaagaaaatgtgctttgcaaagcaaaaaaggcaaaaattggggatgagttcttcagacaagtaccaaaaatgatttctcgtcatttttattgtatgcatattcatcatagaaaataattttttgttttattgggaataaaatcatgatacttaaaatctgatacacatttcaatgatagtattaatccaataggttaaattaacaaattcttaggaaaaaaatctgtttatatgaagctatggagaaatctagaaagtaggtaacggtttagattttgagggacctatgaactcagaacaagttcatttagaggtgggaaacctgagattcaaagaggtctgcatggctgccaagattgcagggacagaatccaagcctgggctcactcatgatctgctctcctgtataaatgtcccatgtgcatctatgaccttattgtttgcaaagcaaattcatattccacgacttgtctgcttcttacaacaaactacaaggcaggcattgtgatttctaagtaagaaggaaaaattaagtagtcaagataatatttagaataaatatttttgaagatgatagttaaatagatggctcttcagactcctagctcaggctatttttccagccttcttttcccaaggaagagaagacaaaaaaaaaaaaagattgaacagctctttttcatttttgttttgttcattttatacatgacacaaattgtttatcttgctctcattgggagtttctgttgattccctctttcaatgatcatcaaaagtcatcacccctgacttaaatggttttatgaaattcaagaagttgtgaacaaggctttaacaaaatatttccacttttaatgcctatgctctgattttatataaattttgtatgtaggacatgatgttgaagtaaaaccaataaatagccaatcagtattcatctctagcgtcaactgaatcctgacctcaatcttcaaaagaatcagaatagtttcacacttcataagttacatatactccagaataaataaaagcagtttgcttgaagtattatcttggctcatttgtgctgctataacaaaacacacttgagactgggttatttataaagaacagaaatttatttctctacagttctggaggctgggaagtccaagatcaagctgcaagcagattcggtgtctggtgagggctgctgtgtgctttcaaggtggtgccttattgctgtgtctttatatggcagaaggggccaacaatggagaaacagcagaatagcaagaagcagctgaatgctatgtgatgcttcttttataagggccttaaatcccattcatgaaagagaagccttcataatccaatcacctcctaaaggccctacctcttaatattgaagattaagtttcaacatgaattttggaggtacgtattcaaaccatagcaagcatacagtaatttccaatataaacctcactcaaaattacagtcacatgctgcacaaaccagttcaatgcacatatatgatgataagattataatacaatatttttgctatactttttctatgtttacatatacagatatcattgtgttacaattgcctttagtattcagtacagtaacatgctgtacaggtttgtagcctaggagcaatagatcatactttcaagcctaccatctagatttatataattacactctgtgatgttcgctcagtgatgaaatcacctgagaacacgtttctcagatcatatccctgttgttaagcaatgtgactgcaattgtgctctgctgccagtttatttttgaagctttatttttcaattacttactcatggcaattttataagaatcattaaacaaatttaatccagcta

SEQ ID NO: 171484 - DNA, 3350 bp, Homo sapiens
  Payload ID: 13728
  Gene Symbol:
  Gene Name: Protein SOGA3  [Source:UniProtKB/Swiss-Prot
  Acc:Q5TF21]
  ENST ID: ENST00000473298
  CDS Start-End: 1-874
cgagacggagctgctgcggaggaacgtggccgacctggaggagcagaacaagcgcatcacggcggagctcaacaagtacaagtacaagtccggcggccacgacagcgcgcggcaccacgacaacgccaagaccgaggccctgcaggaggagctgaaggcggcgcgcctgcagatcaacgagctcagcggcaaggtcatgcagctgcagtacgagaaccgcgtgcttatgtccaacatgcagcgctacgacctggcctcgcacctgggcatccgcggcagcccccgcgacagcgacgccgagagcgacgcgggcaagaaggagagcgacgacgactcgcggcctccgcaccgcaagcgcgaagggcccatcggcggcgagagcgactcggaggaggtgcgcaacatccgctgcctcacgcccactcgctccttctacccggcgcccgggccctggcccaagagcttctccgatcggcagcagatgaaggacatccgctcggaggccgagcgcctgggcaagaccatcgaccggctcatcgccgacacgagcaccatcatcaccgaggcgcgcatctacgtggccaacggggacctgttcggactcatggacgaggaggacgacggcagccgcatccgggagcacgagctgctctaccgcatcaacgctcagatgaaggccttccgcaaggagctgcagaccttcatcgaccgcctcgaggtgcccaagtctgcggacgaccgcggcgccgaggagcccatttccatgttccagcctatcattttacttattctcattcttgtattattttcatcactttcttacacaacaatatttaaacttgtcttcctttttacactgttttttgtactgtaaatctttcatcatttaccattcattgtagtattttcagtttgtttattttgttcacccttcaagacaagaagtaaaagaagtataatttctgtagtaaccaatgctataaaaacactgaagactgcttatttctttaaaaagatacaactcatcttaccaagaccaaattcaataagaagcccaaacactaaaatatttcaggctttattttaaaggcaagtgagactgcttcaaataaaacaacttcaagcttccaagaaacagttaagaggaggcagagaagagcagaaacacttctttgctgacacttacactgttgccatggacctacataagcagtgggagaacacagagactaactggcataaggaaaagatggaattactggaccagtttgacaatgaaagaaaggaatgggaaagtcaatggaagattatgcagaagaaaatagaagagctttgccgggaagtaaagctttggaggaaaatcaatatcaatgaaagtgctaagatcattgatctttaccatgagaagaccattccagagaaagtgatagaatcttccccaaattaccccgatttaggacaaagtgaatttataaggacgaatcacaaagatggtctgagaaaagaaaataaaagagagcagagcttagtcagtggaggaaatcaaatgtgtaaggaacaaaaagcaacaaaaaaatcaaaagtagggtttttggatcctttggctacagacaaccaaaaggaatgtgaggcctggcctgacctgaggacttctgaggaagacagcaagagctgttctggcgccctcagtacagctcttgaagaacttgcgaaggtgagtgaagaattatgcagctttcaagaggaaattcgaaagcggtctaaccatagaaggatgaagtcagattcttttctccaggaaatgccaaatgtaactaatatacctcatggggaccccatgatcaacaatgaccagtgcattcttccaatcagtttagaaaaagaaaaacagaaaaacaggaagaatctgagctgtaccaatgtgctccagagcaattctacgaaaaaatgtggaattgatacaatcgatttaaaaagaaatgaaactccaccagttcctcctccaagaagcacctctcgaaattttcccagctcggattctgaacaagcctatgaaagatggaaggaaaggttagaccacaacagctgggtgccccatgagggtcgaagtaaaaggaattacaaccctcacttccctttgagacaacaagagatgtctatgttgtatccaaatgaagggaaaacttcgaaagatggtatcatcttttcctctttggtaccagaagtcaaaatagatagcaagcctccaagtaatgaagatgttggacttagcatgtggtcatgtgacattgggataggtgcaaaaaggagcccctctacttcgtggtttcagaaaacctgctctacccccagtaatccaaaatatgaaatggtgatcccagatcaccctgctaaatctcatcctgatcttcatgtaagtaatgactgtagctcctcagtagcagagagcagtagcccacttagaaatttcagttgtggctttgaaaggactacaaggaatgagaagctggcagcaaagactgatgaatttaacagaactgtatttagaacagatagaaattgtcaggcaatacagcaaaatcacagctgctcaaaatcatcggaggatctcaagccctgtgatacctcatctactcacacaggtagcatatcacaaagtaacgatgtgtccggtatttggaaaaccaatgcccacatgcctgtgcccatggaaaatgtgcctgataatcccaccaagaaatccacaacaggcctagtaagacaaatgcagggacacctaagtcctcgcagttatcgaaatatgctccacgagcatgactggagaccgagtaatttgtctggccgtccgaggtcagctgatcccaggtcaaattatggtgttgtggaaaagctgctgaaaacctatgagacagcaacagagtctgcattgcaaaattctaagtgcttccaggataattggaccaaatgtaattctgatgtcagtggtggtgccacattaagtcagcatttagaaatgctccaaatggaacaacagtttcagcaaaagacagctgtgtgggggggacaggaagtgaagcaaggaatagatccgaaaaagataacagaggaatccatgtcagtgaacgcctcacatggaaaaggattttcccgacctgctagaccagcaaatcgtcgtctcccctccagatgggcatccagatctccatctgcaccccctgccttgcggagaactacccacaactataccatttctctgcgatccgaagcattgatggtttaagtctttggcctggattgctatattacagaagttctagtcccacttgtcaaacagagcattctgagtgttt

SEQ ID NO: 171485 - DNA, 900 bp, Homo sapiens
  Payload ID: 13728
  Gene Symbol:
  Gene Name: Protein SOGA3  [Source:UniProtKB/Swiss-Prot
  Acc:Q5TF21]
  ENST ID: ENST00000464495
  CDS Start-End: 1-292
cctgttcggactcatggacgaggaggacgacggcagccgcatccgggagcacgagctgctctaccgcatcaacgctcagatgaaggccttccgcaaggagctgcagaccttcatcgaccgcctcgaggtgcccaagtctgcggacgaccgcggcgccgaggagcccatttccgtgagtcagatgttccagcctatcattttacttattctcattcttgtattattttcatcactttcttacacaacaatatttaaacttgtcttcctttttacactgttttttgtactgtaaatctttcatcatttaccattcattgtagtattttcagtttgtttattttgttcacccttcaagacaagaagtaaaagaagtataatttctgtagtaaccaatgctataaaaacactgaagactgcttatttctttaaaaagatacaactcatcttaccaagaccaaattcaataagaagcccaaacactaaaatatttcaggcaagtgagactgcttcaaataaaacaacttcaagcttccaagaaacagttaagaggaggcagagaagagcagaaacacttctttgctgacacttacactgttgccatggacctacataagcagtgggagaacacagagactaactggcataaggaaaagatggaattactggaccagtttgacaatgaaagaaaggaatgggaaagtcaatggaagattatgcagaagaaaatagaagagctttgccgggaagtaaagctttggaggaaaatcaatatcaatgaaagtgctaagatcattgatctttaccatgagaagaccattccagagaaagtgatagaatcttccccaaattaccccgatttaggacaaagtgaatttataaggacgaatcacaaagatggtc

SEQ ID NO: 171486 - DNA, 4414 bp, Homo sapiens
  Payload ID: 13729
  Gene Symbol: PTK2
  Gene Name: protein tyrosine kinase 2
  Uniprot ID: Q05397
  ENST ID: ENST00000340930
  CDS Start-End: 156-3353
tgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccaggtaaagaagaaaagaattgggcggaaagaaatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagt

SEQ ID NO: 171487 - DNA, 4415 bp, Homo sapiens
  Payload ID: 13729
  Gene Symbol: PTK2
  Gene Name: protein tyrosine kinase 2
  Uniprot ID: Q05397
  ENST ID: ENST00000395218
  CDS Start-End: 311-3331
gcgcacgcgcgcgggcccgcgccgacgcagcacggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctt

SEQ ID NO: 171488 - DNA, 1940 bp, Homo sapiens
  Payload ID: 13729
  Gene Symbol: PTK2
  Gene Name: protein tyrosine kinase 2
  ENST ID: ENST00000430260
  CDS Start-End: 459-1547
aacagcacattctagcctccagccaagcaggaatgtctttttaaacagttgagcaaattcccagattagaaagtctggtgcactgatgtcactctttcctgagtaatttttgggtggttgtttactgcacactatctaccaggagcctagaaactttgaatgagtgtcattattagaactctagagttgtaggaatgtaggaagagctgtttgccacagttaggacgagggtttcaaactgtctgctgagccctggggcatctgcgtggaatgggaaactagcaaagtctcgctttggctgcattctgaggggtttatgtgatggcaaacagccaagatgaagaagctgcctagcagtcgctgcagcggctgcagcgttatgtgggacttcagatagcttctgagtagtcaagcagtgcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatg

SEQ ID NO: 171489 - DNA, 574 bp, Homo sapiens
  Payload ID: 13729
  Gene Symbol: PTK2
  Gene Name: protein tyrosine kinase 2
  ENST ID: ENST00000520828
  CDS Start-End: 398-574
gtcgtctgccttcgcttcacggcgccgagccgcggtccgagcagaactggggctcccttgcatcttccagttacaaattcagtgccttctgcagtttccccagagctcctcaagaataacggaagggaggtatagtaatggttaagaaactttgcaaagaaagtgaataatgccagtactgtcaccttttggaacttgttggtatttcctgttgtctgtctttggaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagct

SEQ ID NO: 171490 - DNA, 569 bp, Homo sapiens
  Payload ID: 13729
  Gene Symbol: PTK2
  Gene Name: protein tyrosine kinase 2
  ENST ID: ENST00000522424
  CDS Start-End: 171-569
aaatacaagtaggagttggccagagaaagaagagaaaggtgttccaggcaagagacacaacataaagaggcatgggagagcataatgacttcggagaacttgccaggacataaaggaagaaggtgtatagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcag

SEQ ID NO: 171491 - DNA, 542 bp, Homo sapiens
  Payload ID: 13729
  Gene Symbol: PTK2
  Gene Name: protein tyrosine kinase 2
  ENST ID: ENST00000521907
  CDS Start-End: 186-542
ttagtagagacggggttttaccgtcttggccaggctggtcttgaactcctgacttcaggtgatccacccaccttggcctcccaaagtgttgggattacaggcctgagccaccgtgcccggcagtgcttggtcttattaaacgctttatgaaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggag

SEQ ID NO: 171492 - DNA, 556 bp, Homo sapiens
  Payload ID: 13729
  Gene Symbol: PTK2
  Gene Name: protein tyrosine kinase 2
  ENST ID: ENST00000521791
  CDS Start-End: 80-280
ccgtgaggaggttgggggccctcgcggaggccgagaggcttaaggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgt

SEQ ID NO: 171493 - DNA, 571 bp, Homo sapiens
  Payload ID: 13729
  Gene Symbol: PTK2
  Gene Name: protein tyrosine kinase 2
  ENST ID: ENST00000520892
  CDS Start-End: 180-545
gaggccggtggccgtgaggaggttgggggccctcgcggaggccgagaggcttaaggaggcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaagtaagatacaaacctgctttggtgtgatgc

SEQ ID NO: 171494 - DNA, 592 bp, Homo sapiens
  Payload ID: 13729
  Gene Symbol: PTK2
  Gene Name: protein tyrosine kinase 2
  ENST ID: ENST00000521250
  CDS Start-End: 1-219
accattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagca

SEQ ID NO: 171495 - DNA, 576 bp, Homo sapiens
  Payload ID: 13729
  Gene Symbol: PTK2
  Gene Name: protein tyrosine kinase 2
  ENST ID: ENST00000519024
  CDS Start-End: 71-576
gtaatagtgttttaagaatatttcagcgtagtagaggatttaagcagatcgctttgcctactttaattatatgaaataccaggaggtcagatgtttaacctctttcaacatatctgtttcttttcctgcagaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctct

SEQ ID NO: 171496 - DNA, 542 bp, Homo sapiens
  Payload ID: 13729
  Gene Symbol: PTK2
  Gene Name: protein tyrosine kinase 2
  ENST ID: ENST00000523670
  CDS Start-End: 69-287
aatagtgttttaagaatatttcagcgtagtagaggatttaagcagatcgctttgcctactttaattatatgaaataccaggaggtcagatgtttaacctctttcaacatatctgtttcttttcctgcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccataacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgatt

SEQ ID NO: 171497 - DNA, 573 bp, Homo sapiens
  Payload ID: 13729
  Gene Symbol: PTK2
  Gene Name: protein tyrosine kinase 2
  ENST ID: ENST00000520151
  CDS Start-End: 63-437
gttttaagaatatttcagcgtagtagaggatttaagcagatcgctttgcctactttaattatatgaaataccaggaggtcagatgtttaacctctttcaacatatctgtttcttttcctgcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagcctctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttac

SEQ ID NO: 171498 - DNA, 3236 bp, Homo sapiens
  Payload ID: 13729
  Gene Symbol: PTK2
  Gene Name: protein tyrosine kinase 2
  ENST ID: ENST00000523539
  CDS Start-End: 1-2175
attgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagt

SEQ ID NO: 171499 - DNA, 4388 bp, Homo sapiens
  Payload ID: 13729
  Gene Symbol: PTK2
  Gene Name: protein tyrosine kinase 2
  ENST ID: ENST00000519993
  CDS Start-End: 288-488
aactccggactgagaccgggtcgggcgtgcgctgccgagagaggacgcgcgcctcagccggctgccgcgcacgcgcgcgggcccgcgccgacgcagcacggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagt

SEQ ID NO: 171500 - DNA, 552 bp, Homo sapiens
  Payload ID: 13729
  Gene Symbol: PTK2
  Gene Name: protein tyrosine kinase 2
  ENST ID: ENST00000521981
  CDS Start-End: 1-387
gcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggct

SEQ ID NO: 171501 - DNA, 570 bp, Homo sapiens
  Payload ID: 13729
  Gene Symbol: PTK2
  Gene Name: protein tyrosine kinase 2
  ENST ID: ENST00000520475
  CDS Start-End: 101-570
acgtaaattttaagaaacttgttgggatggttgtgttctaaagttaaggaatcaaggatgatgtcaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgtt

SEQ ID NO: 171502 - DNA, 535 bp, Homo sapiens
  Payload ID: 13729
  Gene Symbol: PTK2
  Gene Name: protein tyrosine kinase 2
  ENST ID: ENST00000524357
  CDS Start-End: 169-535
gcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcagggtgaagagcgattatatgttagagatagctgatcaagtggaccaggaaattgctttgaagttgggttgtctagaaatacgaaaagatgttggtttaaagcgattttttcctaagagtttactggattctgtcaaggccaaaacactaagaaaactgatccaacaaacattta

SEQ ID NO: 171503 - DNA, 3014 bp, Homo sapiens
  Payload ID: 13729
  Gene Symbol: PTK2
  Gene Name: protein tyrosine kinase 2
  ENST ID: ENST00000524202
  CDS Start-End: 1-959
tagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagcctgccattacacatctttgcactggaattggtgcagatatataagtgatcctaatgttgatgctgcccagaccccaggaatgcagagtaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaa

SEQ ID NO: 171504 - DNA, 504 bp, Homo sapiens
  Payload ID: 13729
  Gene Symbol: PTK2
  Gene Name: protein tyrosine kinase 2
  ENST ID: ENST00000523679
  CDS Start-End: 461-504
gcgccgccccgtcgtcgtctgccttcgcttcacggcgccgagccgcggtccgagcagaactggggctcccttgcatcttccagttacaaattcagtgccttctgcagtttccccagagctcctcaagaataacggaagggaggtatagtaatggttaagaaactttgcaaagaaagtgaataatgccagtactgtcaccttttggaacttgttggtatttcctgttgtctgtctttggaagattgcggaagcatgagaagattctgtaactgagaggcattcttcaagctgctggaaaatattacagaaggaacaccttccaaattttgcttcaagctctgaaaaaaggagcacacaggggaaccttagtcttgcttgtggatcgaagcaaatactatcacagcgaggaactgggactttgtgtgcagactcctggcttgatctttataggattgggtgtatgttgttggaactggcaggccaagaggccctgaaaccagcagg

SEQ ID NO: 171505 - DNA, 4661 bp, Homo sapiens
  Payload ID: 13729
  Gene Symbol: PTK2
  Gene Name: protein tyrosine kinase 2
  ENST ID: ENST00000517887
  CDS Start-End: 307-3597
taggaacacagagccatggggtcacattactaagctggtttcattctgttcagtagcttgatctagccaggatggtctgtgtttcagattgcggaagcatgagaagattctgtaactgagaggcattcttcaagctgctggaaaatattacagaaggaacaccttccaaattttgcttcaagctctgaaaaaaggagcacacaggggaaccttagtcttgcttgtggatcgaagcaaatactatcacagcgaggaactgggactttgtgtgcagactcctggcttgatctttataggattgggtgtatgttgttggaactggcaggccaagaggccctgaaaccagcaggtgccatctatatggagaaaagcggatgtagtccatttccagtgtgttgggctaaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 171506 - DNA, 4439 bp, Homo sapiens
  Payload ID: 13729
  Gene Symbol: PTK2
  Gene Name: protein tyrosine kinase 2
  ENST ID: ENST00000519419
  CDS Start-End: 313-3603
tctctgactgcaatggaaagaggaaagagaaattagaagtatttttttaaattgtcatttgatttcttcagagttattgtgggcttctgaactattgcggaagcatgagaagattctgtaactgagaggcattcttcaagctgctggaaaatattacagaaggaacaccttccaaattttgcttcaagctctgaaaaaaggagcacacaggggaaccttagtcttgcttgtggatcgaagcaaatactatcacagcgaggaactgggactttgtgtgcagactcctggcttgatctttataggattgggtgtatgttgttggaactggcaggccaagaggccctgaaaccagcaggtgccatctatatggagaaaagcggatgtagtccatttccagtgtgttgggctaaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactatt

SEQ ID NO: 171507 - DNA, 3279 bp, Homo sapiens
  Payload ID: 13729
  Gene Symbol: PTK2
  Gene Name: protein tyrosine kinase 2
  ENST ID: ENST00000519465
  CDS Start-End: 173-2215
agccctgtttgctctccgataaacaagtctgtgtattataacgtattggacaatgatgtcacttttatttccataaatgactcatgtgtgagcaaaatttgagtaatagtgttttaagaatatttcagcgtagtagaggatttaagcagatcgctttgcctactttaattatatgaaataccaggaggtcagatgtttaacctctttcaacatatctgtttcttttcctgcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 171508 - DNA, 630 bp, Homo sapiens
  Payload ID: 13729
  Gene Symbol: PTK2
  Gene Name: protein tyrosine kinase 2
  ENST ID: ENST00000521332
  CDS Start-End: 436-630
gagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggaggtatagtaatggttaagaaactttgcaaagaaagtgaataatgccagtactgtcaccttttggaacttgttggtatttcctgttgtctgtctttggaaggtatggaacctgtggtgacttaagagttgtataattgtgagagctaagcacagtccttgttattaaatgacagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcagg

SEQ ID NO: 171509 - DNA, 548 bp, Homo sapiens
  Payload ID: 13729
  Gene Symbol: PTK2
  Gene Name: protein tyrosine kinase 2
  ENST ID: ENST00000522950
  CDS Start-End: 274-477
aacatgatgtaatgcactgtcccactctgcagggcacgttccagggtcgtcggttgtctctgtagcacttttccgtcgcctgtgagagccagaccaggattacactttgcacgtggtgttgctttcttcagcctcctttcatctgaaacagctcctcagcctttttttatctttcatgacattgacatttttgacaaacataggctcagtgattttatagagtattcttaaagttggattgagggatatcctataaacatttgtttcttcctgatgagattgagattttgcatctccagtcaggaatacaacataaataatgctgaatccttctcagcatcatacccagagacatacgatgtccaggggatgttccagttgaccaactggacattgacttctgaaggacggttggacacaactcctgttggtgattcctttgctcaagccgtcctcccacgtcagcctcctgagtagcttggaatacagattgagatggcacagaagctattgaactctgacctgggtgagctcatcaacaagatgaa

SEQ ID NO: 171510 - DNA, 4405 bp, Homo sapiens
  Payload ID: 13729
  Gene Symbol: PTK2
  Gene Name: protein tyrosine kinase 2
  Uniprot ID: Q05397
  ENST ID: ENST00000521059
  CDS Start-End: 183-3341
gcgcggctgctgtcgcccagcgccgccccgtcgtcgtctgccttcgcttcacggcgccgagccgcggtccgaagtcttgctgtgtcacccaggctgccaggctggagtggagtggcatgatctcggctgactgcaacctctgcctcccagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 171511 - DNA, 750 bp, Homo sapiens
  Payload ID: 13729
  Gene Symbol: PTK2
  Gene Name: protein tyrosine kinase 2
  ENST ID: ENST00000523803
  CDS Start-End: 389-750
gggattacaggcacatgccaccacacccggctgatatttgtatttttagtagagacggggttttaccgtcttggccaggctggtcttgaactcctgacttcaggtgatccacccaccttggcctcccaaagtgttgggattacaggcctgagccaccgtgcccggcagtgcttggtcttattaaacgctttatgaaagttagcttggaaagttaacctaacttggaaagacacaatagcttgacactgttgctatttgttaaataaggcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaa

SEQ ID NO: 171512 - DNA, 581 bp, Homo sapiens
  Payload ID: 13729
  Gene Symbol: PTK2
  Gene Name: protein tyrosine kinase 2
  ENST ID: ENST00000523388
  CDS Start-End: 380-581
atttctcagaggaattctgttctgctcaagataaactttggcatgcaaacatttcatcttggcccatccttcattttctgcaacctctttttcttaccagctgtctttttcttacctatggctgtgctttaaatggacttgcccatttggaccaaggctattctagaatcatttcgtggagagttagaaacctgatccttctttcccctgtgtataggatcctttattgttatcatctactgttagccaactggtgttccttagataactcagggtggggtctagtgtgtgctaactctgggttgtcagctcccctaagacaatgtgttgtctctctagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctg

SEQ ID NO: 171513 - DNA, 488 bp, Homo sapiens
  Payload ID: 13729
  Gene Symbol: PTK2
  Gene Name: protein tyrosine kinase 2
  ENST ID: ENST00000523067
  CDS Start-End: 134-334
gtcgtcgtctgccttcgcttcacggcgccgagccgcggtccgaatccatggttggttgaatctggatgtggaacccgctgacgtggatggctgactgtattaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtcta

SEQ ID NO: 171514 - DNA, 540 bp, Homo sapiens
  Payload ID: 13729
  Gene Symbol: PTK2
  Gene Name: protein tyrosine kinase 2
  ENST ID: ENST00000521395
  CDS Start-End: 220-540
agccactggaggatcttgagcagaggcgtgacgtaaattttaagaaacttgttgggatggttgtgttctaaagttaaggaatcaaggatgatgtcaaggcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtg

SEQ ID NO: 171515 - DNA, 4955 bp, Homo sapiens
  Payload ID: 13729
  Gene Symbol: PTK2
  Gene Name: protein tyrosine kinase 2
  Uniprot ID: Q05397
  ENST ID: ENST00000522684
  CDS Start-End: 231-3389
gaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 171516 - DNA, 4129 bp, Homo sapiens
  Payload ID: 13729
  Gene Symbol: PTK2
  Gene Name: protein tyrosine kinase 2
  ENST ID: ENST00000519654
  CDS Start-End: 1-3052
atatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaa

SEQ ID NO: 171517 - DNA, 584 bp, Homo sapiens
  Payload ID: 13729
  Gene Symbol: PTK2
  Gene Name: protein tyrosine kinase 2
  ENST ID: ENST00000521029
  CDS Start-End: 3-242
atatgaaataccaggaggtcagatgtttaacctctttcaacatatctgtttcttttcctgcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatc

SEQ ID NO: 171518 - DNA, 475 bp, Homo sapiens
  Payload ID: 13729
  Gene Symbol: PTK2
  Gene Name: protein tyrosine kinase 2
  ENST ID: ENST00000524040
  CDS Start-End: 322-475
gagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaatccatggttggttgaatctggatgtggaacccgctgacgtggatggctgactgtattgcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacct

SEQ ID NO: 171519 - DNA, 602 bp, Homo sapiens
  Payload ID: 13729
  Gene Symbol: PTK2
  Gene Name: protein tyrosine kinase 2
  ENST ID: ENST00000520045
  CDS Start-End: 252-602
agcacggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaatccatggttggttgaatctggatgtggaacccgctgacgtggatggctgactgtattaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccacca

SEQ ID NO: 171520 - DNA, 863 bp, Homo sapiens
  Payload ID: 13729
  Gene Symbol: PTK2
  Gene Name: protein tyrosine kinase 2
  ENST ID: ENST00000519881
  CDS Start-End: 193-558
gcacggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaagtaagatacaaacctgctttggtgtgatgcacacttgatttcttttgctttttaaaaacatgcacaagataacaaatgtatatgtttaattttcacactgcttgtcattacaactctggtataaataaaattcgttagtaattattaacgaatgatctcttctagacctctagtctagcttttgggtattattaattatactttgagccatctgatttccgttttctgtgatggtcttttgctagctaatttctcatcagtgctactttgtttcaacctttgctcccaataaaactcaaatcatatata

SEQ ID NO: 171521 - DNA, 2393 bp, Homo sapiens
  Payload ID: 13729
  Gene Symbol: PTK2
  Gene Name: protein tyrosine kinase 2
  ENST ID: ENST00000521986
  CDS Start-End: 1-2262
gcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcaggagtcagtcactgccaacataaagttaagaaagctaggcgctttctccctttggtcttctgttcccatgatcctccttctacggatgaaattagtggggacgaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctg

SEQ ID NO: 171522 - DNA, 629 bp, Homo sapiens
  Payload ID: 13729
  Gene Symbol: PTK2
  Gene Name: protein tyrosine kinase 2
  ENST ID: ENST00000523435
  CDS Start-End: 270-629
tgatgtaatgcactgtcccactctgcagggcacgttccagggtcgtcggttgtctctgtagcacttttccgtcgcctgtgagagccagaccaggattacactttgcacgtggtgttgctttcttcagcctcctttcatctgaaacagctcctcagcctttttttatctttcatgacattgacatttttgacaaacataggctcagtgattttatagagtattcttaaagttggattgagggatatcctataaacatttgtttcttcctgatgagattgagattttgcatctccagtcaggaatacaacataaataatgctgaatccttctcagcatcatacccagagacatacgatgtccaggggatgttccagttgaccaactggacattgacttctgaaggacggttggacacaactcctgttggtgattcctttattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgctt

SEQ ID NO: 171523 - DNA, 3351 bp, Homo sapiens
  Payload ID: 13729
  Gene Symbol: PTK2
  Gene Name: protein tyrosine kinase 2
  ENST ID: ENST00000517712
  CDS Start-End: 1943-2290
aggctgggcctaatatctttaaactcagccccaagtcaggaatctttatgatagcattatggctagatgatgaagtggatctcaaggatattgaggggccgggctcaggaattgaggctgctgcagtttctcctgaatctatgagaattcagatgggcacttttcagtaattaaaaccatatgtcctcctcctcctttctttttgaagagctctcattctgttgaccttgcactgctgctggattgttcctcgggctttgcatgttccctgcatttgttttgtaactgagcatggtgcatggcagacctctctatgcagtatgctggggcagtgagcaggtggcacagtagccacaccctggcaacagtgagtgagagctggtgggcaggcttggaaactagctcctttttgttctgctcatgtgtttttatgggggatttgtcttatgcctttattaatattgtttttcttttttccctttctctgataaattcctttaacttttcctcaccttccgttcgacaatagccatggagggtaagcacatcgtgtctttgtgtgtctgtccagctctctctatcacacccggctctctgcatgtaactttggactggaaagcaggaagcccaagtgggagggcacttcggcctgctttgtcacctctcatgactgacagatgccaaaagcagtgtttatatatgcaaaagaatgagacatgtacatctttgcagtaaatgaattattcttgtgcttttctatctcatacccagacttttggaacaaccaagaattaatctgttccagattacttaggcaaaagcacccaagggttcagaaatgggaacttatatttagactgagcactggcatcaggttcatgattaaactatatgtactacaagttggtcttttttaaaaagtgtatatatatatatatatatatatatatatatatatatataccattttatgctggtgtaattctaaccagttggaatttttaaatactgctgaagatttcccaaaggccctcatgttattccaccatcagtactcaagttatcttagtaacatttgttgatgtctcttctgtgcccaggccctaggtagacattgttacatctttggcctcatcttccctgatcacagttgcccgggtgagagagctgaggctttataagcgtaggcccaggtgctttccagcagtcagcacagagctggctgaaaccggggtcttgagcagagaggctcctagcgacaccactgctgctttgacttcagtcacgacctgcaaacagatgctatccccttaaagtgcattcatatgtcagctttttataattgtacaaagaacatgtttccattaggcggctgagggcagctaagctgagccataccgttttcactgcagaattcaaactaagtggaaatccttatagtcttcatgtagaatgtttgactctttagccaaataggtaattttgtctaaaattcagtaaattcccagatggattattatcttgtggtaaatgattttggggtgaggggacattgaatcaggtctctgaaagaatctggggtttttagtataatatgtatgattccatctcatttcctttaactgagctcaaagttagaaagaaaatactgcctaatttgtcacttggaggaattactttactgtcattctcaatctgaactatatcccgcacacacaagaaaatcaatgaccttctgcaatctgctttgatctcttgtaaagaccctctctagcttgattgtggtgatctcacgccatctgctggagagcagaaaaatgactggcttctgtgttgtcagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagt

SEQ ID NO: 171524 - DNA, 571 bp, Homo sapiens
  Payload ID: 13729
  Gene Symbol: PTK2
  Gene Name: protein tyrosine kinase 2
  ENST ID: ENST00000517453
  CDS Start-End: 219-571
ataaccaactagctcctcgctgaaactggctcacaccgcggaagcccgggtcggtgtcggggcgagccttccctccttttcctggagcccgtctcaggcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccaga

SEQ ID NO: 171525 - DNA, 430 bp, Homo sapiens
  Payload ID: 13729
  Gene Symbol: PTK2
  Gene Name: protein tyrosine kinase 2
  ENST ID: ENST00000524257
  CDS Start-End: 407-430
gtcgtctgccttcgcttcacggcgccgagccgcggtccgaatccatggttggttgaatctggatgtggaacccgctgacgtggatggctgactgtattgcagaactggggctcccttgcatcttccagttacaaattcagtgccttctgcagtttccccagagctcctcaagaataacggaagggagattgcggaagcatgagaagattctgtaactgagaggcattcttcaagctgctggaaaatattacagaaggaacaccttccaaattttgcttcaagctctgaaaaaaggagcacacaggggaaccttagtcttgcttgtggatcgaagcaaatactatcacagcgaggaactgggactttgtgtgcagactcctggcttgatctttataggattgggtgtatgttgttggaactggcaggccaa

SEQ ID NO: 171526 - DNA, 678 bp, Homo sapiens
  Payload ID: 13729
  Gene Symbol: PTK2
  Gene Name: protein tyrosine kinase 2
  ENST ID: ENST00000521562
  CDS Start-End: 283-678
atgtgggacttcagatagcttctgagtagtcaagcagtgataaagcactggttaagctgaacgataggaagattgtattgagcaatttagggagattattggccagattgctaattgatcacgtaagtgctggcgtgatcacattaggtgtgaaaagaatctgtcctcagacatgtatatgcttgataaagtgctgcgtgggatttctcagaggaattctgttctgctcaagataaactttgcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagat

SEQ ID NO: 171527 - DNA, 4147 bp, Homo sapiens
  Payload ID: 13730
  Gene Symbol: PTK2B
  Gene Name: protein tyrosine kinase 2 beta
  Uniprot ID: Q14289
  ENST ID: ENST00000346049
  CDS Start-End: 241-3270
aaggaagtggggaggagagcagcaggggtgtggttaacaactcagaggaggagggagaatctaacctgtcagcccttttactcagccacagcctccggagccgttgcacacctacctgcccggccgacttacctgtacttgccgccgtcccggctcacctggcggtgcccgaggagtagtcgctggagtccgcgcctccctgggactgcaatgtgccgatcttagctgctgcctgagaggatgtctggggtgtccgagcccctgagtcgagtaaagttgggcacgttacgccggcctgaaggccctgcagagcccatggtggtggtaccagtagatgtggaaaaggaggacgtgcgtatcctcaaggtctgcttctatagcaacagcttcaatcctgggaaaaacttcaaactggtcaaatgcactgtccagacggagatccgggagatcatcacctccatcctgctgagcgggcggatcgggcccaacatccggttggctgagtgctatgggctgaggctgaagcacatgaagtccgatgagatccactggctgcacccacagatgacggtgggtgaggtgcaggacaagtatgagtgtctgcacgtggaagccgagtggaggtatgaccttcaaatccgctacttgccagaagacttcatggagagcctgaaggaggacaggaccacgctgctctatttttaccaacagctccggaacgactacatgcagcgctacgccagcaaggtcagcgagggcatggccctgcagctgggctgcctggagctcaggcggttcttcaaggatatgccccacaatgcacttgacaagaagtccaacttcgagctcctagaaaaggaagtggggctggacttgtttttcccaaagcagatgcaggagaacttaaagcccaaacagttccggaagatgatccagcagaccttccagcagtacgcctcgctcagggaggaggagtgcgtcatgaagttcttcaacactctcgccggcttcgccaacatcgaccaggagacctaccgctgtgaactcattcaaggatggaacattactgtggacctggtcattggccctaaagggatccgccagctgactagtcaggacgcaaagcccacctgcctggccgagttcaagcagatcaggtccatcaggtgcctcccgctggaggagggccaggcagtacttcagctgggcattgaaggtgccccccaggccttgtccatcaaaacctcatccctagcagaggctgagaacatggctgacctcatagacggctactgccggctgcagggtgagcaccaaggctctctcatcatccatcctaggaaagatggtgagaagcggaacagcctgccccagatccccatgctaaacctggaggcccggcggtcccacctctcagagagctgcagcatagagtcagacatctacgcagagattcccgacgaaaccctgcgaaggcccggaggtccacagtatggcattgcccgtgaagatgtggtcctgaatcgtattcttggggaaggcttttttggggaggtctatgaaggtgtctacacaaatcacaaaggggagaaaatcaatgtagctgtcaagacctgcaagaaagactgcactctggacaacaaggagaagttcatgagcgaggcagtgatcatgaagaacctcgaccacccgcacatcgtgaagctgatcggcatcattgaagaggagcccacctggatcatcatggaattgtatccctatggggagctgggccactacctggagcggaacaagaactccctgaaggtgctcaccctcgtgctgtactcactgcagatatgcaaagccatggcctacctggagagcatcaactgcgtgcacagggacattgctgtccggaacatcctggtggcctcccctgagtgtgtgaagctgggggactttggtctttcccggtacattgaggacgaggactattacaaagcctctgtgactcgtctccccatcaaatggatgtccccagagtccattaacttccgacgcttcacgacagccagtgacgtctggatgttcgccgtgtgcatgtgggagatcctgagctttgggaagcagcccttcttctggctggagaacaaggatgtcatcggggtgctggagaaaggagaccggctgcccaagcctgatctctgtccaccggtcctttataccctcatgacccgctgctgggactacgaccccagtgaccggccccgcttcaccgagctggtgtgcagcctcagtgacgtttatcagatggagaaggacattgccatggagcaagagaggaatgctcgctaccgaacccccaaaatcttggagcccacagccttccaggaacccccacccaagcccagccgacctaagtacagaccccctccgcaaaccaacctcctggctccaaagctgcagttccaggttcctgagggtctgtgtgccagctctcctacgctcaccagccctatggagtatccatctcccgttaactcactgcacaccccacctctccaccggcacaatgtcttcaaacgccacagcatgcgggaggaggacttcatccaacccagcagccgagaagaggcccagcagctgtgggaggctgaaaaggtcaaaatgcggcaaatcctggacaaacagcagaagcagatggtggaggactaccagtggctcaggcaggaggagaagtccctggaccccatggtttatatgaatgataagtccccattgacgccagagaaggaggtcggctacctggagttcacagggcccccacagaagcccccgaggctgggcgcacagtccatccagcccacagctaacctggaccggactgatgacctggtgtacctcaatgtcatggagctggtgcgggccgtgctggagctcaagaatgagctctgtcagctgccccccgagggctacgtggtggtggtgaagaatgtggggctgaccctgcggaagctcatcgggagcgtggatgatctcctgccttccttgccgtcatcttcacggacagagatcgagggcacccagaaactgctcaacaaagacctggcagagctcatcaacaagatgcggctggcacagcagaacgccgtgacctccctaagtgaggagtgcaagaggcagatgctgacggcttcacacaccctggctgtggacgccaagaacctgctcgacgctgtggaccaggccaaggttctggccaatctggcccacccacctgcagagtgacggagggtgggggccacctgcctgcgtcttccgcccctgcctgccatgtacctcccctgccttgctgttggtcatgtgggtcttccagggggaaggccaaggggagtcaccttcccttgccactttgcacgacgccctctccccacccctacccctggctgtactgctcaggctgcagctggacagaggggactctgggctatggacacagggtgacggtgacaaagatggctcagagggggactgctgctgcctggccactgctccctaagccagcctggtccatgcagggggctcctgggggtggggaggtgtcacatggtgcccctagctttatatatggacatggcaggccgatttgggaaccaagctattcctttcccttcctcttcggccctcagatgtcccttgatgcacagagaagctggggaggagctttgttttgggggtcaggcagccagtgagatgagggatgggcctggcattcttgtacagtgtatattgaaatttatttaatgtgagtttggtctggactgacagcatgtgccctcctgagggaggacctggggcacagtccaggaacaagctaattgggagtccaggcacaggatgctgtgttgtcaacaaaccaagcatcagggggaagaagcagagagatgcggccaagataggaccttgggccaaatccgctctcttcctgcccctctttctctttcttcctttactttcccttgcttttccctcttttcttactcctcctctttctctccccaacccccattctcatctgcacccttcttttctcatgtgtttgcataaacattcttttaacttctttctatttgacttgtggttgaattaaaattgtcccatttgc

SEQ ID NO: 171528 - DNA, 3161 bp, Homo sapiens
  Payload ID: 13730
  Gene Symbol: PTK2B
  Gene Name: protein tyrosine kinase 2 beta
  ENST ID: ENST00000397497
  CDS Start-End: 452-2242
ccagcagaccttccagcagtacgcctcgctcagggaggaggagtgcgtcatgaagttcttcaacactctcgccggcttcgccaacatcgaccaggagacctaccgctgtgaactcattgtaatggcgggctctcttgatcctctccctgacctggattccaggcctctcggaaaagggggccaggagggggcagggagaggctgcaatcgctgcagattctcactcaggcagcaggacctcgctgacctgccgtcggtggaagtcaaaagcatccccttgcctgaagcaggcactgaaatgttggcctccagctctgggaggtgggcaggacaggcaaggtgtcaggaggggaagatccatatggccagggtttcggtgagaaggagctggagacccaggaaacagtggcttgtgtctagcttagggagcttttcttcaagtttctgaagaatggggaggacagctctggaacaacagtccactctccttttattccagcaaggatggaacattactgtggacctggtcattggccctaaagggatccgccagctgactagtcaggacgcaaagcccacctgcctggccgagttcaagcagatcaggtccatcaggtgcctcccgctggaggagggccaggcagtacttcagctgggcattgaaggtgccccccaggccttgtccatcaaaacctcatccctagcagaggctgagaacatggctgacctcatagacggctactgccggctgcagggtgagcaccaaggctctctcatcatccatcctaggaaagatggtgagaagcggaacagcctgccccagatccccatgctaaacctggaggcccggcggtcccacctctcagagagctgcagcatagagtcagacatctacgcagagattcccgacgaaaccctgcgaaggcccggaggtccacagtatggcattgcccgtgaagatgtggtcctgaatcgtattcttggggaaggcttttttggggaggtctatgaaggtgtctacacaaatcacaaaggggagaaaatcaatgtagctgtcaagacctgcaagaaagactgcactctggacaacaaggagaagttcatgagcgaggcagtgatcatgaagaacctcgaccacccgcacatcgtgaagctgatcggcatcattgaagaggagcccacctggatcatcatggaattgtatccctatggggagctgggccactacctggagcggaacaagaactccctgaaggtgctcaccctcgtgctgtactcactgcagatatgcaaagccatggcctacctggagagcatcaactgcgtgcacagggacattgctgtccggaacatcctggtggcctcccctgagtgtgtgaagctgggggactttggtctttcccggtacattgaggacgaggactattacaaagcctctgtgactcgtctccccatcaaatggatgtccccagagtccattaacttccgacgcttcacgacagccagtgacgtctggatgttcgccgtgtgcatgtgggagatcctgagctttgggaagcagcccttcttctggctggagaacaaggatgtcatcggggtgctggagaaaggagaccggctgcccaagcctgatctctgtccaccggtcctttataccctcatgacccgctgctgggactacgaccccagtgaccggccccgcttcaccgagctggtgtgcagcctcagtgacgtttatcagatggagaaggacattgccatggagcaagagaggaatgctcgctaccgaacccccaaaatcttggagcccacagccttccaggaacccccacccaagcccagccgacctaagtacagaccccctccgcaaaccaacctcctggctccaaagctgcagttccaggaggaggacttcatccaacccagcagccgagaagaggcccagcagctgtgggaggctgaaaaggtcaaaatgcggcaaatcctggacaaacagcagaagcagatggtggaggactaccagtggctcaggcaggaggagaagtccctggaccccatggtttatatgaatgataagtccccattgacgccagagaaggaggtcggctaccgtgagtgttcccgcccttcttcggggggtttcctcttggcaccttgtgcagagccaccatccttgcccaccgcccagggcagggagcagcggagtctgtctgcattccctgcagcatcggccatgatttaattcagagcatgtggggcaggccagcttcccctccgctccctccaccccattcctctccctgcctagcaccctgcccttctctctctcagtggccacatccttaggcccctcctcagatcatccccctcctgcattagtttggaggagctggaaattctctcttcctcatttcctgctctgttggaagctcccgtgggaaaagttaagcagtgccacctgcctgtcccagttcagattcatcttctgtaggcctgagggacagaggagagaaagtgagaggggcagctgagccctcaggctctctccagaagaccctgttgcaggcagggagggaagagccagcagtaagcccggggcctggaggggtggcattgaggaggaggatgatgacagccatcacagagaactggacacaagtcaggcatgggcctgggaccatttattatcttctgaggcacagggtgattaggtaacttgtccaaattcacacagctaataattggcaaagttcagatttgaacccaagccttctgactttagggtcccttctgagctcaccctcttatcttacaaatgaaaattaaggctcggaatgtgagctgcctagagtggtcacagagctctttggcggcagaggtgagaatagaaggccaggtgtggtggctcacacctgtaatcccagcactttgggaggctgaggtgggagggtcacttgatcccaggagtttgagactggcttgggcaacatagcaagaccccatctctacaaaagattaagaaaattaggcctggtgatgcatgcctgcaagcccagcggctcaggaggccgaggcaggaggattgcctgagcctagaaggtgaggctacagtgagctgtgatcacgccactgtgctccagcctcggtgcaagccctgcctc

SEQ ID NO: 171529 - DNA, 4719 bp, Homo sapiens
  Payload ID: 13730
  Gene Symbol: PTK2B
  Gene Name: protein tyrosine kinase 2 beta
  Uniprot ID: Q14289
  ENST ID: ENST00000397501
  CDS Start-End: 809-3838
gcagttcccgcctcctcaggtccgggcgggtccctggccggggtagcacggaagggtctcccaggcggcgtagtagggcttccgtgttactggaaacctacttccggctgcaaatgggaaaaggagcctctaccttaaccaatccccgggaacctcaggcccgcggatgggagaaaccagagatgccaacttcctgcttccgaagtagtggctgggtcttaaagcaccgatgtttctgcattgaatagccctggaagacagaattcttgtctctccaaagatctggcagacttattcccaattataagagatccttgcaaaggaggtgtcttgcttcaccttcaccttccactgtgattgtaagttttctgaggcctcgccagccatgcggaactgaataggactagcaacttcatagacggttgtgaagacaagctagacggcagatgaaagttcttggcacagagtgaacacttgataaactatatggcagggagggctggaacggggcttgtttgaagagcaatatgagccagggttatagacctgagtttggggtaagagtggaacatccaaatggaagagtccagcagctgaaaggacatttgttcaaaggcctttttcattacagttttctccttcttctgatccagccacagcctccggagccgttgcacacctacctgcccggccgacttacctgtacttgccgccgtcccggctcacctggcggtgcccgaggagtagtcgctggagtccgcgcctccctgggactgcaatgtgccgatcttagctgctgcctgagaggatgtctggggtgtccgagcccctgagtcgagtaaagttgggcacgttacgccggcctgaaggccctgcagagcccatggtggtggtaccagtagatgtggaaaaggaggacgtgcgtatcctcaaggtctgcttctatagcaacagcttcaatcctgggaaaaacttcaaactggtcaaatgcactgtccagacggagatccgggagatcatcacctccatcctgctgagcgggcggatcgggcccaacatccggttggctgagtgctatgggctgaggctgaagcacatgaagtccgatgagatccactggctgcacccacagatgacggtgggtgaggtgcaggacaagtatgagtgtctgcacgtggaagccgagtggaggtatgaccttcaaatccgctacttgccagaagacttcatggagagcctgaaggaggacaggaccacgctgctctatttttaccaacagctccggaacgactacatgcagcgctacgccagcaaggtcagcgagggcatggccctgcagctgggctgcctggagctcaggcggttcttcaaggatatgccccacaatgcacttgacaagaagtccaacttcgagctcctagaaaaggaagtggggctggacttgtttttcccaaagcagatgcaggagaacttaaagcccaaacagttccggaagatgatccagcagaccttccagcagtacgcctcgctcagggaggaggagtgcgtcatgaagttcttcaacactctcgccggcttcgccaacatcgaccaggagacctaccgctgtgaactcattcaaggatggaacattactgtggacctggtcattggccctaaagggatccgccagctgactagtcaggacgcaaagcccacctgcctggccgagttcaagcagatcaggtccatcaggtgcctcccgctggaggagggccaggcagtacttcagctgggcattgaaggtgccccccaggccttgtccatcaaaacctcatccctagcagaggctgagaacatggctgacctcatagacggctactgccggctgcagggtgagcaccaaggctctctcatcatccatcctaggaaagatggtgagaagcggaacagcctgccccagatccccatgctaaacctggaggcccggcggtcccacctctcagagagctgcagcatagagtcagacatctacgcagagattcccgacgaaaccctgcgaaggcccggaggtccacagtatggcattgcccgtgaagatgtggtcctgaatcgtattcttggggaaggcttttttggggaggtctatgaaggtgtctacacaaatcacaaaggggagaaaatcaatgtagctgtcaagacctgcaagaaagactgcactctggacaacaaggagaagttcatgagcgaggcagtgatcatgaagaacctcgaccacccgcacatcgtgaagctgatcggcatcattgaagaggagcccacctggatcatcatggaattgtatccctatggggagctgggccactacctggagcggaacaagaactccctgaaggtgctcaccctcgtgctgtactcactgcagatatgcaaagccatggcctacctggagagcatcaactgcgtgcacagggacattgctgtccggaacatcctggtggcctcccctgagtgtgtgaagctgggggactttggtctttcccggtacattgaggacgaggactattacaaagcctctgtgactcgtctccccatcaaatggatgtccccagagtccattaacttccgacgcttcacgacagccagtgacgtctggatgttcgccgtgtgcatgtgggagatcctgagctttgggaagcagcccttcttctggctggagaacaaggatgtcatcggggtgctggagaaaggagaccggctgcccaagcctgatctctgtccaccggtcctttataccctcatgacccgctgctgggactacgaccccagtgaccggccccgcttcaccgagctggtgtgcagcctcagtgacgtttatcagatggagaaggacattgccatggagcaagagaggaatgctcgctaccgaacccccaaaatcttggagcccacagccttccaggaacccccacccaagcccagccgacctaagtacagaccccctccgcaaaccaacctcctggctccaaagctgcagttccaggttcctgagggtctgtgtgccagctctcctacgctcaccagccctatggagtatccatctcccgttaactcactgcacaccccacctctccaccggcacaatgtcttcaaacgccacagcatgcgggaggaggacttcatccaacccagcagccgagaagaggcccagcagctgtgggaggctgaaaaggtcaaaatgcggcaaatcctggacaaacagcagaagcagatggtggaggactaccagtggctcaggcaggaggagaagtccctggaccccatggtttatatgaatgataagtccccattgacgccagagaaggaggtcggctacctggagttcacagggcccccacagaagcccccgaggctgggcgcacagtccatccagcccacagctaacctggaccggactgatgacctggtgtacctcaatgtcatggagctggtgcgggccgtgctggagctcaagaatgagctctgtcagctgccccccgagggctacgtggtggtggtgaagaatgtggggctgaccctgcggaagctcatcgggagcgtggatgatctcctgccttccttgccgtcatcttcacggacagagatcgagggcacccagaaactgctcaacaaagacctggcagagctcatcaacaagatgcggctggcacagcagaacgccgtgacctccctaagtgaggagtgcaagaggcagatgctgacggcttcacacaccctggctgtggacgccaagaacctgctcgacgctgtggaccaggccaaggttctggccaatctggcccacccacctgcagagtgacggagggtgggggccacctgcctgcgtcttccgcccctgcctgccatgtacctcccctgccttgctgttggtcatgtgggtcttccagggggaaggccaaggggagtcaccttcccttgccactttgcacgacgccctctccccacccctacccctggctgtactgctcaggctgcagctggacagaggggactctgggctatggacacagggtgacggtgacaaagatggctcagagggggactgctgctgcctggccactgctccctaagccagcctggtccatgcagggggctcctgggggtggggaggtgtcacatggtgcccctagctttatatatggacatggcaggccgatttgggaaccaagctattcctttcccttcctcttcggccctcagatgtcccttgatgcacagagaagctggggaggagctttgttttgggggtcaggcagccagtgagatgagggatgggcctggcattcttgtacagtgtatattgaaatttatttaatgtgagtttggtctggactgacagcatgtgccctcctgagggaggacctggggcacagtccaggaacaagctaattgggagtccaggcacaggatgctgtgttgtcaacaaaccaagcatcagggggaagaagcagagagatgcggccaagataggaccttgggccaaatccgctctcttcctgcccctctttctctttcttcctttactttcccttgcttttccctcttttcttactcctcctctttctctccccaacccccattctcatctgcacccttcttttctcatgtgtttgcataaacattcttttaacttctttctatttgacttgtggttgaattaaaattgtcccatttgctttg

SEQ ID NO: 171530 - DNA, 3941 bp, Homo sapiens
  Payload ID: 13730
  Gene Symbol: PTK2B
  Gene Name: protein tyrosine kinase 2 beta
  Uniprot ID: Q14289
  ENST ID: ENST00000420218
  CDS Start-End: 156-3059
ccacagcctccggagccgttgcacacctacctgcccggccgacttacctgtacttgccgccgtcccggctcacctggcggtgcccgaggagtagtcgctggagtccgcgcctccctgggactgcaatgtgccgatcttagctgctgcctgagaggatgtctggggtgtccgagcccctgagtcgagtaaagttgggcacgttacgccggcctgaaggccctgcagagcccatggtggtggtaccagtagatgtggaaaaggaggacgtgcgtatcctcaaggtctgcttctatagcaacagcttcaatcctgggaaaaacttcaaactggtcaaatgcactgtccagacggagatccgggagatcatcacctccatcctgctgagcgggcggatcgggcccaacatccggttggctgagtgctatgggctgaggctgaagcacatgaagtccgatgagatccactggctgcacccacagatgacggtgggtgaggtgcaggacaagtatgagtgtctgcacgtggaagccgagtggaggtatgaccttcaaatccgctacttgccagaagacttcatggagagcctgaaggaggacaggaccacgctgctctatttttaccaacagctccggaacgactacatgcagcgctacgccagcaaggtcagcgagggcatggccctgcagctgggctgcctggagctcaggcggttcttcaaggatatgccccacaatgcacttgacaagaagtccaacttcgagctcctagaaaaggaagtggggctggacttgtttttcccaaagcagatgcaggagaacttaaagcccaaacagttccggaagatgatccagcagaccttccagcagtacgcctcgctcagggaggaggagtgcgtcatgaagttcttcaacactctcgccggcttcgccaacatcgaccaggagacctaccgctgtgaactcattcaaggatggaacattactgtggacctggtcattggccctaaagggatccgccagctgactagtcaggacgcaaagcccacctgcctggccgagttcaagcagatcaggtccatcaggtgcctcccgctggaggagggccaggcagtacttcagctgggcattgaaggtgccccccaggccttgtccatcaaaacctcatccctagcagaggctgagaacatggctgacctcatagacggctactgccggctgcagggtgagcaccaaggctctctcatcatccatcctaggaaagatggtgagaagcggaacagcctgccccagatccccatgctaaacctggaggcccggcggtcccacctctcagagagctgcagcatagagtcagacatctacgcagagattcccgacgaaaccctgcgaaggcccggaggtccacagtatggcattgcccgtgaagatgtggtcctgaatcgtattcttggggaaggcttttttggggaggtctatgaaggtgtctacacaaatcacaaaggggagaaaatcaatgtagctgtcaagacctgcaagaaagactgcactctggacaacaaggagaagttcatgagcgaggcagtgatcatgaagaacctcgaccacccgcacatcgtgaagctgatcggcatcattgaagaggagcccacctggatcatcatggaattgtatccctatggggagctgggccactacctggagcggaacaagaactccctgaaggtgctcaccctcgtgctgtactcactgcagatatgcaaagccatggcctacctggagagcatcaactgcgtgcacagggacattgctgtccggaacatcctggtggcctcccctgagtgtgtgaagctgggggactttggtctttcccggtacattgaggacgaggactattacaaagcctctgtgactcgtctccccatcaaatggatgtccccagagtccattaacttccgacgcttcacgacagccagtgacgtctggatgttcgccgtgtgcatgtgggagatcctgagctttgggaagcagcccttcttctggctggagaacaaggatgtcatcggggtgctggagaaaggagaccggctgcccaagcctgatctctgtccaccggtcctttataccctcatgacccgctgctgggactacgaccccagtgaccggccccgcttcaccgagctggtgtgcagcctcagtgacgtttatcagatggagaaggacattgccatggagcaagagaggaatgctcgctaccgaacccccaaaatcttggagcccacagccttccaggaacccccacccaagcccagccgacctaagtacagaccccctccgcaaaccaacctcctggctccaaagctgcagttccaggaggaggacttcatccaacccagcagccgagaagaggcccagcagctgtgggaggctgaaaaggtcaaaatgcggcaaatcctggacaaacagcagaagcagatggtggaggactaccagtggctcaggcaggaggagaagtccctggaccccatggtttatatgaatgataagtccccattgacgccagagaaggaggtcggctacctggagttcacagggcccccacagaagcccccgaggctgggcgcacagtccatccagcccacagctaacctggaccggactgatgacctggtgtacctcaatgtcatggagctggtgcgggccgtgctggagctcaagaatgagctctgtcagctgccccccgagggctacgtggtggtggtgaagaatgtggggctgaccctgcggaagctcatcgggagcgtggatgatctcctgccttccttgccgtcatcttcacggacagagatcgagggcacccagaaactgctcaacaaagacctggcagagctcatcaacaagatgcggctggcacagcagaacgccgtgacctccctaagtgaggagtgcaagaggcagatgctgacggcttcacacaccctggctgtggacgccaagaacctgctcgacgctgtggaccaggccaaggttctggccaatctggcccacccacctgcagagtgacggagggtgggggccacctgcctgcgtcttccgcccctgcctgccatgtacctcccctgccttgctgttggtcatgtgggtcttccagggggaaggccaaggggagtcaccttcccttgccactttgcacgacgccctctccccacccctacccctggctgtactgctcaggctgcagctggacagaggggactctgggctatggacacagggtgacggtgacaaagatggctcagagggggactgctgctgcctggccactgctccctaagccagcctggtccatgcagggggctcctgggggtggggaggtgtcacatggtgcccctagctttatatatggacatggcaggccgatttgggaaccaagctattcctttcccttcctcttcggccctcagatgtcccttgatgcacagagaagctggggaggagctttgttttgggggtcaggcagccagtgagatgagggatgggcctggcattcttgtacagtgtatattgaaatttatttaatgtgagtttggtctggactgacagcatgtgccctcctgagggaggacctggggcacagtccaggaacaagctaattgggagtccaggcacaggatgctgtgttgtcaacaaaccaagcatcagggggaagaagcagagagatgcggccaagataggaccttgggccaaatccgctctcttcctgcccctctttctctttcttcctttactttcccttgcttttccctcttttcttactcctcctctttctctccccaacccccattctcatctgcacccttcttttctcatgtgtttgcataaacattcttttaacttctttctatttgacttgtggttgaattaaaattgtcccatttgctttgc

SEQ ID NO: 171531 - DNA, 818 bp, Homo sapiens
  Payload ID: 13730
  Gene Symbol: PTK2B
  Gene Name: protein tyrosine kinase 2 beta
  ENST ID: ENST00000412793
  CDS Start-End: 180-818
ccaggaagggcctgcctttgagacttgtcactccctgagatccatcgtggcaccaaatgtttgccgagctccgccctgggagggaggcctgcagcctgggaactgggagacctgggtcccagtggagaggcctcaccatgtagactgcaatgtgccgatcttagctgctgcctgagaggatgtctggggtgtccgagcccctgagtcgagtaaagttgggcacgttacgccggcctgaaggccctgcagagcccatggtggtggtaccagtagatgtggaaaaggaggacgtgcgtatcctcaaggtctgcttctatagcaacagcttcaatcctgggaaaaacttcaaactggtcaaatgcactgtccagacggagatccgggagatcatcacctccatcctgctgagcgggcggatcgggcccaacatccggttggctgagtgctatgggctgaggctgaagcacatgaagtccgatgagatccactggctgcacccacagatgacggtgggtgaggtgcaggacaagtatgagtgtctgcacgtggaagccgagtggaggtatgaccttcaaatccgctacttgccagaagacttcatggagagcctgaaggaggacaggaccacgctgctctatttttaccaacagctccggaacgactacatgcagcgctacgccagcaaggtcagcgagggcatggccctgcagctgggctgcctggagctcaggcggttcttcaaggatatgccccacaatgcacttgacaagaagtccaacttcgagctcctagaaaaggaagtggggctggacttgttt

SEQ ID NO: 171532 - DNA, 3914 bp, Homo sapiens
  Payload ID: 13730
  Gene Symbol: PTK2B
  Gene Name: protein tyrosine kinase 2 beta
  Uniprot ID: Q14289
  ENST ID: ENST00000517339
  CDS Start-End: 134-3037
tctgtcttggagctcggtgggtgctgtccctggggccatgaggtatgtgggcctgtgtggggctctttcagggctgaccctctgctgtctctgcaggactgcaatgtgccgatcttagctgctgcctgagaggatgtctggggtgtccgagcccctgagtcgagtaaagttgggcacgttacgccggcctgaaggccctgcagagcccatggtggtggtaccagtagatgtggaaaaggaggacgtgcgtatcctcaaggtctgcttctatagcaacagcttcaatcctgggaaaaacttcaaactggtcaaatgcactgtccagacggagatccgggagatcatcacctccatcctgctgagcgggcggatcgggcccaacatccggttggctgagtgctatgggctgaggctgaagcacatgaagtccgatgagatccactggctgcacccacagatgacggtgggtgaggtgcaggacaagtatgagtgtctgcacgtggaagccgagtggaggtatgaccttcaaatccgctacttgccagaagacttcatggagagcctgaaggaggacaggaccacgctgctctatttttaccaacagctccggaacgactacatgcagcgctacgccagcaaggtcagcgagggcatggccctgcagctgggctgcctggagctcaggcggttcttcaaggatatgccccacaatgcacttgacaagaagtccaacttcgagctcctagaaaaggaagtggggctggacttgtttttcccaaagcagatgcaggagaacttaaagcccaaacagttccggaagatgatccagcagaccttccagcagtacgcctcgctcagggaggaggagtgcgtcatgaagttcttcaacactctcgccggcttcgccaacatcgaccaggagacctaccgctgtgaactcattcaaggatggaacattactgtggacctggtcattggccctaaagggatccgccagctgactagtcaggacgcaaagcccacctgcctggccgagttcaagcagatcaggtccatcaggtgcctcccgctggaggagggccaggcagtacttcagctgggcattgaaggtgccccccaggccttgtccatcaaaacctcatccctagcagaggctgagaacatggctgacctcatagacggctactgccggctgcagggtgagcaccaaggctctctcatcatccatcctaggaaagatggtgagaagcggaacagcctgccccagatccccatgctaaacctggaggcccggcggtcccacctctcagagagctgcagcatagagtcagacatctacgcagagattcccgacgaaaccctgcgaaggcccggaggtccacagtatggcattgcccgtgaagatgtggtcctgaatcgtattcttggggaaggcttttttggggaggtctatgaaggtgtctacacaaatcacaaaggggagaaaatcaatgtagctgtcaagacctgcaagaaagactgcactctggacaacaaggagaagttcatgagcgaggcagtgatcatgaagaacctcgaccacccgcacatcgtgaagctgatcggcatcattgaagaggagcccacctggatcatcatggaattgtatccctatggggagctgggccactacctggagcggaacaagaactccctgaaggtgctcaccctcgtgctgtactcactgcagatatgcaaagccatggcctacctggagagcatcaactgcgtgcacagggacattgctgtccggaacatcctggtggcctcccctgagtgtgtgaagctgggggactttggtctttcccggtacattgaggacgaggactattacaaagcctctgtgactcgtctccccatcaaatggatgtccccagagtccattaacttccgacgcttcacgacagccagtgacgtctggatgttcgccgtgtgcatgtgggagatcctgagctttgggaagcagcccttcttctggctggagaacaaggatgtcatcggggtgctggagaaaggagaccggctgcccaagcctgatctctgtccaccggtcctttataccctcatgacccgctgctgggactacgaccccagtgaccggccccgcttcaccgagctggtgtgcagcctcagtgacgtttatcagatggagaaggacattgccatggagcaagagaggaatgctcgctaccgaacccccaaaatcttggagcccacagccttccaggaacccccacccaagcccagccgacctaagtacagaccccctccgcaaaccaacctcctggctccaaagctgcagttccaggaggaggacttcatccaacccagcagccgagaagaggcccagcagctgtgggaggctgaaaaggtcaaaatgcggcaaatcctggacaaacagcagaagcagatggtggaggactaccagtggctcaggcaggaggagaagtccctggaccccatggtttatatgaatgataagtccccattgacgccagagaaggaggtcggctacctggagttcacagggcccccacagaagcccccgaggctgggcgcacagtccatccagcccacagctaacctggaccggactgatgacctggtgtacctcaatgtcatggagctggtgcgggccgtgctggagctcaagaatgagctctgtcagctgccccccgagggctacgtggtggtggtgaagaatgtggggctgaccctgcggaagctcatcgggagcgtggatgatctcctgccttccttgccgtcatcttcacggacagagatcgagggcacccagaaactgctcaacaaagacctggcagagctcatcaacaagatgcggctggcacagcagaacgccgtgacctccctaagtgaggagtgcaagaggcagatgctgacggcttcacacaccctggctgtggacgccaagaacctgctcgacgctgtggaccaggccaaggttctggccaatctggcccacccacctgcagagtgacggagggtgggggccacctgcctgcgtcttccgcccctgcctgccatgtacctcccctgccttgctgttggtcatgtgggtcttccagggggaaggccaaggggagtcaccttcccttgccactttgcacgacgccctctccccacccctacccctggctgtactgctcaggctgcagctggacagaggggactctgggctatggacacagggtgacggtgacaaagatggctcagagggggactgctgctgcctggccactgctccctaagccagcctggtccatgcagggggctcctgggggtggggaggtgtcacatggtgcccctagctttatatatggacatggcaggccgatttgggaaccaagctattcctttcccttcctcttcggccctcagatgtcccttgatgcacagagaagctggggaggagctttgttttgggggtcaggcagccagtgagatgagggatgggcctggcattcttgtacagtgtatattgaaatttatttaatgtgagtttggtctggactgacagcatgtgccctcctgagggaggacctggggcacagtccaggaacaagctaattgggagtccaggcacaggatgctgtgttgtcaacaaaccaagcatcagggggaagaagcagagagatgcggccaagataggaccttgggccaaatccgctctcttcctgcccctctttctctttcttcctttactttcccttgcttttccctcttttcttactcctcctctttctctccccaacccccattctcatctgcacccttcttttctcatgtgtttgcataaacattcttttaacttctttctatttgacttgtggttgaattaaaattgtcccatttgc

SEQ ID NO: 171533 - DNA, 651 bp, Homo sapiens
  Payload ID: 13730
  Gene Symbol: PTK2B
  Gene Name: protein tyrosine kinase 2 beta
  ENST ID: ENST00000522517
  CDS Start-End: 99-651
tccattcaggaggcactcactggcttcccacctgcggccaggtgcaaggtgtggggacaaggactgcaatgtgccgatcttagctgctgcctgagaggatgtctggggtgtccgagcccctgagtcgagtaaagttgggcacgttacgccggcctgaaggccctgcagagcccatggtggtggtaccagtagatgtggaaaaggaggacgtgcgtatcctcaaggtctgcttctatagcaacagcttcaatcctgggaaaaacttcaaactggtcaaatgcactgtccagacggagatccgggagatcatcacctccatcctgctgagcgggcggatcgggcccaacatccggttggctgagtgctatgggctgaggctgaagcacatgaagtccgatgagatccactggctgcacccacagatgacggtgggtgaggtgcaggacaagtatgagtgtctgcacgtggaagccgagtggaggtatgaccttcaaatccgctacttgccagaagacttcatggagagcctgaaggaggacaggaccacgctgctctatttttaccaacagctccggaacgactacatgcagcgctacgccagcaaggtcagcgagggcatggccctgcagctgggctgcctggagctcaggt

SEQ ID NO: 171534 - DNA, 582 bp, Homo sapiens
  Payload ID: 13730
  Gene Symbol: PTK2B
  Gene Name: protein tyrosine kinase 2 beta
  ENST ID: ENST00000519512
  CDS Start-End: 1-582
ccggaagatgatccagcagaccttccagcagtacgcctcgctcagggaggaggagtgcgtcatgaagttcttcaacactctcgccggcttcgccaacatcgaccaggagacctaccgctgtgaactcattcaaggatggaacattactgtggacctggtcattggccctaaagggatccgccagctgactagtcaggacgcaaagcccacctgcctggccgagttcaagcagatcaggtccatcaggtgcctcccgctggaggagggccaggcagtacttcagctgggcattgaaggtgccccccaggccttgtccatcaaaacctcatccctagcagaggctgagaacatggctgacctcatagacggctactgccggctgcaggatggtgagaagcggaacagcctgccccagatccccatgctaaacctggaggcccggcggtcccacctctcagagagctgcagcatagagtcagacatctacgcagagattcccgacgaaaccctgcgaaggcccggaggtccacagtatggcattgcccgtgaagatgtggtcctgaatcgtattcttggggaagg

SEQ ID NO: 171535 - DNA, 539 bp, Homo sapiens
  Payload ID: 13730
  Gene Symbol: PTK2B
  Gene Name: protein tyrosine kinase 2 beta
  ENST ID: ENST00000522338
  CDS Start-End: 335-539
gggaacctcaggcccgcggatgggagaaaccagagatgccaacttcctgcttccgaagtagtggctgggtcttaaagcaccgaataggactagcaacttcatagacggttgtgaagacaagctagacggcagatgaaagttcttggcacagagtgaacacttgataaactatatggcagccacagcctccggagccgttgcacacctacctgcccggccgacttacctgtacttgccgccgtcccggctcacctggcggtgcccgaggagtagtcgctggagtccgcgcctccctgggactgcaatgtgccgatcttagctgctgcctgagaggatgtctggggtgtccgagcccctgagtcgagtaaagttgggcacgttacgccggcctgaaggccctgcagagcccatggtggtggtaccagtagatgtggaaaaggaggacgtgcgtatcctcaaggtctgcttctatagcaacagcttcaatcctgggaaaaacttcaaactggtcaaatgcactgtccagacggagatccggg

SEQ ID NO: 171536 - DNA, 554 bp, Homo sapiens
  Payload ID: 13730
  Gene Symbol: PTK2B
  Gene Name: protein tyrosine kinase 2 beta
  ENST ID: ENST00000521164
  CDS Start-End: 244-554
atttgcggccgggggaatggcagagatcgccccccaggtctgcccggcgctcagggaattggtggcagcgtctatttcagagtttatgccacagcctccggagccgttgcacacctacctgcccggccgacttacctgtacttgccgccgtcccggctcacctggcggtgcccgaggagtagtcgctggagtccgcgcctccctgggactgcaatgtgccgatcttagctgctgcctgagaggatgtctggggtgtccgagcccctgagtcgagtaaagttgggcacgttacgccggcctgaaggccctgcagagcccatggtggtggtaccagtagatgtggaaaaggaggacgtgcgtatcctcaaggtctgcttctatagcaacagcttcaatcctgggaaaaacttcaaactggtcaaatgcactgtccagacggagatccgggagatcatcacctccatcctgctgagcgggcggatcgggcccaacatccggttggctgagtgctatgggctgaggctgaagcacatgaagtccgatgagatccactg

SEQ ID NO: 171537 - DNA, 2401 bp, Homo sapiens
  Payload ID: 13731
  Gene Symbol: PTK6
  Gene Name: protein tyrosine kinase 6
  Uniprot ID: Q13882
  ENST ID: ENST00000217185
  CDS Start-End: 57-461
agctctgggtgctccagctgggccacagcctggtcctgccgctgcgcccgcccgccatggtgtcccgggaccaggctcacctgggccccaagtatgtgggcctctgggacttcaagtcccggacggacgaggagctgagcttccgcgcgggggacgtcttccacgtggccaggaaggaggagcagtggtggtgggccacgctgctggacgaggcgggtggggccgtggcccagggctatgtgccccacaactacctggccgagagggagacggtggagtcggaacctgcgggacacgcaggctgtgcggcactacaagatctggcggcgtgccgggggccggctgcacctgaacgaggcggtgtccttcctcagcctgcccgagcttgtgaactaccacagggcccagagcctgtcccacggcctgcggctggccgcgccctgccggaagcacgagcctgagcccctgccccattgggatgactgggagaggccgagggaggagttcacgctctgcaggaagctggggtccggctactttggggaggtcttcgaggggctctggaaagaccgggtccaggtggccattaaggtgatttctcgagacaacctcctgcaccagcagatgctgcagtcggagatccaggccatgaagaagctgcggcacaaacacatcctggcgctgtacgccgtggtgtccgtgggggaccccgtgtacatcatcacggagctcatggccaagggcagcctgctggagctgctccgcgactctgatgagaaagtcctgcccgtttcggagctgctggacatcgcctggcaggtggctgagggcatgtgttacctggagtcgcagaattacatccaccgggacctggccgccaggaacatcctcgtcggggaaaacaccctctgcaaagttggggacttcgggttagccaggcttatcaaggaggacgtctacctctcccatgaccacaatatcccctacaagtggacggcccctgaagcgctctcccgaggccattactccaccaaatccgacgtctggtcctttgggattctcctgcatgagatgttcagcaggggtcaggtgccctacccaggcatgtccaaccatgaggccttcctgagggtggacgccggctaccgcatgccctgccctctggagtgcccgcccagcgtgcacaagctgatgctgacatgctggtgcagggaccccgagcagagaccctgcttcaaggccctgcgggagaggctctccagcttcaccagctacgagaacccgacctgagctgctgtggagcgggcatggccgggccctgctgaggaggggcctgggcagagggcctggacctgggatcaaggcccacgcgcttccctggggtttactgaggtgatgggtgcaggaaaggttcacaaatgtggagtgtctgcgtccaatacacgcgtgtgctcctctccttactccatcgtgtgtgccttgggtctcagctgctgacacgcagcctgctctggagcctgcagatgagatccgggagactgacacgaagccagcagaggtcagaggggactctgaccacagcccgctctctggctgtctgtctgcagtgcccggctgagggtgggaggcaaacacgccttgttcctgctcttcccagttcagcttggtgggagaaagtcattcgcgtggctcgggacgctcatgtaaatttggttttggtgctcaagggttctttcctcccaggggcaggtgtttctttcctgtttgtcttgtgtcttgagagcttggccttatgaccagtgagaactctctccctggtctctgccagcccaagcatcactgcccgaggcgccagctcagtttcaccgtccacgtccacaaggggcttttcccaccttcacctttgtcgctgggtcagtgctggaaagcgcccctcactcctgcgctgacaagggcccttctctactgtctgtggggtggttccgggctgggggggctgcctcctttgcacctgattttgaaggtgtctctttcatccatggttaagtcataaaaagcttattggttttggttttgactcacctgaaagtttttttggtttaaaagaagaataggcggggcacggtggctcatgcctgtaatcccagcactttgggaggctgaggcaggtggatcacgaggtcaggagatcgacaccatcctggctaacacggtgaaaccccgtctctactaaaaaatacaaaaaattagctgggtgtggtggtgggggtgggcgcctgtagtcccagctacgtgggaggctgaggcagcagactggtgtgaacccgggaggtggagcttgcagtgagccgagatcgcgccactgcactccagcctgggcgacagagcgagactccatctc

SEQ ID NO: 171538 - DNA, 2931 bp, Homo sapiens
  Payload ID: 13731
  Gene Symbol: PTK6
  Gene Name: protein tyrosine kinase 6
  Uniprot ID: Q13882
  ENST ID: ENST00000542869
  CDS Start-End: 41-1396
gctgggccacagcctggtcctgccgctgcgcccgcccgccatggtgtcccgggaccaggctcacctgggccccaagtatgtgggcctctgggacttcaagtcccggacggacgaggagctgagcttccgcgcgggggacgtcttccacgtggccaggaaggaggagcagtggtggtgggccacgctgctggacgaggcgggtggggccgtggcccagggctatgtgccccacaactacctggccgagagggagacggtggagtcggaaccgtggttctttggctgcatctcccgctcggaagctgtgcgtcggctgcaggccgagggcaacgccacgggcgccttcctgatcagggtcagcgagaagccgagtgccgactacgtcctgtcggtgcgggacacgcaggctgtgcggcactacaagatctggcggcgtgccgggggccggctgcacctgaacgaggcggtgtccttcctcagcctgcccgagcttgtgaactaccacagggcccagagcctgtcccacggcctgcggctggccgcgccctgccggaagcacgagcctgagcccctgccccattgggatgactgggagaggccgagggaggagttcacgctctgcaggaagctggggtccggctactttggggaggtcttcgaggggctctggaaagaccgggtccaggtggccattaaggtgatttctcgagacaacctcctgcaccagcagatgctgcagtcggagatccaggccatgaagaagctgcggcacaaacacatcctggcgctgtacgccgtggtgtccgtgggggaccccgtgtacatcatcacggagctcatggccaagggcagcctgctggagctgctccgcgactctgatgagaaagtcctgcccgtttcggagctgctggacatcgcctggcaggtggctgagggcatgtgttacctggagtcgcagaattacatccaccgggacctggccgccaggaacatcctcgtcggggaaaacaccctctgcaaagttggggacttcgggttagccaggcttatcaaggaggacgtctacctctcccatgaccacaatatcccctacaagtggacggcccctgaagcgctctcccgaggccattactccaccaaatccgacgtctggtcctttgggattctcctgcatgagatgttcagcaggggtcaggtgccctacccaggcatgtccaaccatgaggccttcctgagggtggacgccggctaccgcatgccctgccctctggagtgcccgcccagcgtgcacaagctgatgctgacatgctggtgcagggaccccgagcagagaccctgcttcaaggccctgcgggagaggctctccagcttcaccagctacgagaacccgacctgagctgctgtggagcgggcatggccgggccctgctgaggaggggcctgggcagagggcctggacctgggatcaaggcccacgcgcttccctggggtttactgaggtgatgggtgcaggaaaggttcacaaatgtggagtgtctgcgtccaatacacgcgtgtgctcctctccttactccatcgtgtgtgccttgggtctcagctgctgacacgcagcctgctctggagcctgcagatgagatccgggagactgacacgaagccagcagaggtcagaggggactctgaccacagcccgctctctggctgtctgtctgcagtgcccggctgagggtgggaggcaaacacgccttgttcctgctcttcccagttcagcttggtgggagaaagtcattcgcgtggctcgggacgctcatgtaaatttggttttggtgctcaagggttctttcctcccaggggcaggtgtttctttcctgtttgtcttgtgtcttgagagcttggccttatgaccagtgagaactctctccctggtctctgccagcccaagcatcactgcccgaggcgccagctcagtttcaccgtccacgtccacaaggggcttttcccaccttcacctttgtcgctgggtcagtgctggaaagcgcccctcactcctgcgctgacaagggcccttctctactgtctgtggggtggttccgggctgggggggctgcctcctttgcacctgattttgaaggtgtctctttcatccatggttaagtcataaaaagcttattggttttggttttgactcacctgaaagtttttttggtttaaaagaagaataggcggggcacggtggctcatgcctgtaatcccagcactttgggaggctgaggcaggtggatcacgaggtcaggagatcgacaccatcctggctaacacggtgaaaccccgtctctactaaaaaatacaaaaaattagctgggtgtggtggtgggggtgggcgcctgtagtcccagctacgtgggaggctgaggcagcagactggtgtgaacccgggaggtggagcttgcagtgagccgagatcgcgccactgcactccagcctgggcgacagagcgagactccatctcaaaaaaaaaaaaaaaaaaaagaaagaaagaaaaataattttgggagtttctggaaaggtactaggatttctcaaaaggatttgtcttctgccttgtgaaagacagatgtcagactaatcaggcttatccgatgtgctacatgagatggaaagcgtgtgaaatagtaagtcacactaagtcttctggaggttctatttacgggtttggttttgatatgaatgttgcagaaactctataaaattcctagaaatctgatacgttatcctatgatatatatcctatctcacatgctattcctagaaatctggtgcaatgttatcagtcataattttggttattacattaaaatgctgcatgccacagaaataaccaagtttccttgccaaccgtgtcacgaatataataaactctcatcagatcctga

SEQ ID NO: 171539 - DNA, 3958 bp, Homo sapiens
  Payload ID: 13732
  Gene Symbol: PTK7
  Gene Name: protein tyrosine kinase 7 (inactive)
  Uniprot ID: Q13308
  ENST ID: ENST00000230418
  CDS Start-End: 148-2598
cgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagcctttttta

SEQ ID NO: 171540 - DNA, 4272 bp, Homo sapiens
  Payload ID: 13732
  Gene Symbol: PTK7
  Gene Name: protein tyrosine kinase 7 (inactive)
  Uniprot ID: Q13308
  ENST ID: ENST00000230419
  CDS Start-End: 222-3434
ggcggggcttggcggcggcggcggcggcgcgcggggactcggaggtactgggcgcgcgcggctccggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttacaacctg

SEQ ID NO: 171541 - DNA, 3801 bp, Homo sapiens
  Payload ID: 13732
  Gene Symbol: PTK7
  Gene Name: protein tyrosine kinase 7 (inactive)
  Uniprot ID: Q13308
  ENST ID: ENST00000349241
  CDS Start-End: 148-2970
cgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccaatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagcctttttta

SEQ ID NO: 171542 - DNA, 4071 bp, Homo sapiens
  Payload ID: 13732
  Gene Symbol: PTK7
  Gene Name: protein tyrosine kinase 7 (inactive)
  Uniprot ID: Q13308
  ENST ID: ENST00000345201
  CDS Start-End: 148-3240
cgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagcctttttta

SEQ ID NO: 171543 - DNA, 4023 bp, Homo sapiens
  Payload ID: 13732
  Gene Symbol: PTK7
  Gene Name: protein tyrosine kinase 7 (inactive)
  Uniprot ID: Q13308
  ENST ID: ENST00000352931
  CDS Start-End: 148-3192
cgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaagacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagcctttttta

SEQ ID NO: 171544 - DNA, 902 bp, Homo sapiens
  Payload ID: 13732
  Gene Symbol: PTK7
  Gene Name: protein tyrosine kinase 7 (inactive)
  ENST ID: ENST00000476760
  CDS Start-End: 183-602
cggaggtactgggcgcgcgcggctccggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatgtgagagccaggggggctgtgcccagtccccctgtcagaccctcaatgactgaggcctgggggatccctcccttacctcagcttctcccatttccagttaaacgggccaggcagaatgcatttatcatcagctttttttgctcatgtggataagaggaaattaaaagttatattttttccaaaattttttccttcaagtctgggacccatttatctgctgcatgcttgtgcaaatggaaagggcggccgagcccttggccaagtgtcagacttgacctgccagggaccaggcaggcacttagtatctggtaactgtagccccagcctcagcctccagggcttccttgtgtctg

SEQ ID NO: 171545 - DNA, 1035 bp, Homo sapiens
  Payload ID: 13732
  Gene Symbol: PTK7
  Gene Name: protein tyrosine kinase 7 (inactive)
  ENST ID: ENST00000461389
  CDS Start-End: 97-351
ttatttcatcatttgggcttgccctttcatgtggagcactgtgattggacccaagttggcaagagtggaagaccaggggacagaacagaaatccccatggtggccagagtgtcaggtctcatcgtgacgctcttgtcctcctccttcccaggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcct

SEQ ID NO: 171546 - DNA, 713 bp, Homo sapiens
  Payload ID: 13732
  Gene Symbol: PTK7
  Gene Name: protein tyrosine kinase 7 (inactive)
  ENST ID: ENST00000497957
  CDS Start-End: 1-76
agaacatggcacagaagccatttttgtggcagcggtggggattcggccgtctcaccatgctgctgcacagtcttagagtccttgctcagagccgggctgtcgtttatttaacatccaacgacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctg

SEQ ID NO: 171547 - DNA, 546 bp, Homo sapiens
  Payload ID: 13732
  Gene Symbol: PTK7
  Gene Name: protein tyrosine kinase 7 (inactive)
  ENST ID: ENST00000461100
  CDS Start-End: 1-78
acagaacatggcacagaagccatttttgtggcagcggtggggattcggccgtctcaccatgctgctgcacagtcttagagtccttgctcagagccgggctgtcgtttatttaacatccaacggtcgacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtgg

SEQ ID NO: 171548 - DNA, 3436 bp, Homo sapiens
  Payload ID: 13732
  Gene Symbol: PTK7
  Gene Name: protein tyrosine kinase 7 (inactive)
  Uniprot ID: Q13308
  ENST ID: ENST00000481273
  CDS Start-End: 71-3307
cctgagtttttctggtctgagccgagagtttgctcgagaactgccgagagttgctggctctcgggcccagatggggagtttcttgtcgggggagaaaagaccatccgcacccaccgtggggagcgcgatggagaaaaaggaattccccaccccacccggcagggtcggcccaggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctga

SEQ ID NO: 171549 - DNA, 2412 bp, Homo sapiens
  Payload ID: 13732
  Gene Symbol: PTK7
  Gene Name: protein tyrosine kinase 7 (inactive)
  ENST ID: ENST00000471863
  CDS Start-End: 151-1530
ggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccagtgagcacctttgccctgaaggtcaaggagaggtggaggggaacacaggtctgggtgtgatggacagaggcttccctggtactcacctgaggtcctctcagttctgggccctgcaggcttgggaatcagttcactactgggagtcggtgtagacagtagagagccaggcacaggggttagggtgggtgctccagaggaaatagtgacagccctcacagaaaaatggtcctctgggtacagaggaaagagcaatagactaggaatctagagacctgggtcccactatgctcccaatgcacagagtgacgatggtagcaaatcacccaccttactggggttcagtctcctcatccataaaatggagccagtaatctactacctaccccacaaggtggttggaaaggtcaaatgaagtagatgaaaatgatttttctttttttcttttttgggaggtaatagtggacaaaattataggtgatttttaatttgttttagtttgttatgctttccaaatttctttactaaacatattacttatgaaaaaaaagagggggagaaaagcaagacatatgactgaaagtacacatgataaaccctttatatcaggctgggcgcggtggctcatgcctgtaatcccagcactttgggaggccgagccgggcggatcacaaggtcaggagttggagaccagcctgaccaacatggtgaaaccccatctctactaaaaatacaaaaattagctgggcgtggtggggcacacctgtaatcccagctactcaggaggctgagggaggaaaattgcttgaacccaggaggcagaggttgcaatgagctgagatcgcaccgttgctcttcagcccgggcaacagagtgagactccatctcaaaacaaaacaaaacaaaccttatatcctcactacaggcatagggatttatttgtttacttatttctttataccatgccttgttccaaaccttttgtggtagtttaaaaggatacacaataaaaattacaatatgcacacagagacaca

SEQ ID NO: 171550 - DNA, 576 bp, Homo sapiens
  Payload ID: 13732
  Gene Symbol: PTK7
  Gene Name: protein tyrosine kinase 7 (inactive)
  ENST ID: ENST00000494146
  CDS Start-End: 1-78
acagaacatggcacagaagccatttttgtggcagcggtggggattcggccgtctcaccatgctgctgcacagtcttagagtccttgctcagagccgggctgtcgtttatttaacatccaacgcccctgcccagacccatctgtgtgtctctcagacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggca

SEQ ID NO: 171551 - DNA, 807 bp, Homo sapiens
  Payload ID: 13732
  Gene Symbol: PTK7
  Gene Name: protein tyrosine kinase 7 (inactive)
  ENST ID: ENST00000481946
  CDS Start-End: 1-807
ttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccagtgagcacctttgccctgaaggtcaaggagaggtggaggggaacacaggtctgggtgtgatggacagaggcttccctgctgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatc

SEQ ID NO: 171552 - DNA, 870 bp, Homo sapiens
  Payload ID: 13732
  Gene Symbol: PTK7
  Gene Name: protein tyrosine kinase 7 (inactive)
  ENST ID: ENST00000473339
  CDS Start-End: 98-870
attatttcatcatttgggcttgccctttcatgtggagcactgtgattggacccaagttggcaagagtggaagaccaggggacagaacagaaatccccatggtggccagagtgtcaggtctcatcgtgacgctcttgtcctcctccttcccaggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctg

SEQ ID NO: 171553 - DNA, 4016 bp, Homo sapiens
  Payload ID: 13732
  Gene Symbol: PTK7
  Gene Name: protein tyrosine kinase 7 (inactive)
  ENST ID: ENST00000470019
  CDS Start-End: 157-630
ggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttacaacctg

SEQ ID NO: 171554 - DNA, 1935 bp, Homo sapiens
  Payload ID: 13732
  Gene Symbol: PTK7
  Gene Name: protein tyrosine kinase 7 (inactive)
  ENST ID: ENST00000489707
  CDS Start-End: 1-1097
gggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttacaacctg

SEQ ID NO: 171555 - DNA, 4398 bp, Homo sapiens
  Payload ID: 13733
  Gene Symbol: PTPDC1
  Gene Name: protein tyrosine phosphatase domain containing 1
  Uniprot ID: A2A3K4
  ENST ID: ENST00000288976
  CDS Start-End: 68-2488
agtgaaagttcctcactgagtgagtggggctgactcttcctgcctccggctcttgcctcccagtgccatgcaggtgcaggatgcaaccaggcggccctcagccgtgcgcttcctcagctcctttctccagggccgccggcactccacctcagacccagtactgcggctgcagcaggcccggcggggctctggcttgggctccggctctgccacgaagctgctgtcctcgtcctctctccaggtgatggtggctgtttcctcagtcagccatgcagagggaaacccaactttccccgaaagaaaaagaaatttagaacgtccaacaccaaagtacacaaaagtaggggagcgtttacggcatgtcattcctggacacatggcatgttccatggcgtgtggcggtagagcttgcaagtatgagaacccagcccgctggagtgagcaggagcaagccattaagggggtttactcatcctgggtcactgataatatactggccatggcccgcccatcctctgagctcctggagaagtaccacatcattgatcagttcctcagccatggcataaaaacaataatcaacctccagcgccctggtgagcatgctagctgtgggaaccctctggaacaagaaagtggcttcacataccttcctgaggctttcatggaggctggcatttacttctacaatttcggatggaaggattatggtgtagcgtctcttactactatcctagatatggtgaaggtgatgacatttgccttacaggaaggaaaagtagctatccattgtcatgcagggcttggtcgaacaggtgttttaatagcctgttacttagtttttgcaacgagaatgactgctgaccaagcaattatatttgtgcgggcaaagcgacccaattccatacaaaccagaggacagctcctctgtgtaagggaatttactcagtttctaactcctctccgcaatatattctcttgctgtgatcccaaagcacatgctgtcaccttacctcaatatctaattcgccagcgtcatctgcttcatggttatgaggcacgacttctgaaacacgtgccaaaaattatccacctagtttgcaaattgctgctggacttagcggagaacaggccagtgatgatgaaggatgtgtccgaaggacctggtctctctgctgaaatagaaaagacaatgtctgagatggtcaccatgcagctggataaagagttactgaggcatgacagtgatgtgtccaacccgcctaaccccactgcagtggcagcagattttgacaatcgaggcatgattttctccaatgagcaacagtttgaccctctttggaaaaggcggaatgttgagtgccttcaacccctgactcatctgaaaaggcggctcagctacagtgactcagatttaaagagggccgagaacctcctggagcaaggggagactccacagacagtgcctgcccagatcttggttggccacaagcccaggcagcagaagctcataagccattgttacatcccacagtctccagaaccagacttacacaaggaagccttggttcgcagcacactttctttctggagtcagtcaaagtttggaggcctggaaggactcaaagataatgggtcaccaattttccatggaaggatcattccaaaggaagcacagcagagtggagctttctctgcagatgtttcaggctcacacagccctggggagccagtttcacccagctttgcaaatgtccataaggatccaaaccctgctcaccagcaagtgtctcactgtcagtgtaaaactcatggtgttgggagccctggctctgtcaggcagaacagcaggacaccccgaagccctctggactgtggctccagtcccaaagcacagttcttggttgaacatgaaacccaggacagtaaagatctgtctgaagcagcttcacactctgcattacagtctgaattgagtgctgaggcaagaagaatactggcggccaaagccctagcaaatttaaatgaatctgtagaaaaggaggaactaaaaaggaaggtagaaatgtggcagaaagagcttaattcccgagatggagcttgggaaagaatatgtggcgagagggaccctttcatcctatgcagcttgatgtggtcttgggtggagcaactgaaggagcctgtaatcaccaaagaggatgtggacatgttggttgacaggcgagcagatgccgcagaagcactttttttattagagaagggacagcaccagactattctctgcgtgttgcactgcatagtgaacctgcagacaattcccgtggatgtggaggaagctttccttgcccatgccattaaggcattcactaaggttaattttgattctgaaaatggaccaacagtttacaacaccctgaagaaaatatttaagcacacgctggaagaaaaaagaaaaatgacaaaagatggccctaagcctggcctctagctttcactcgtggtgaatatttcagacctaaagatccagatagtatctctgttcatatgtgaataagttgaagattgtggggctactttttctcatagcactttattttgaatgttgttagtttgtgctgagaatggtcgtccgtatttgaaccaattatttattttaaaatatatttaagctacatttttgttttgaaaaattgccataaatttggtgccactttcttttatttatttgactgagttaatattattgtattaacattttaagtatatggtgtttacattcttatttcttttgacattttggaaataatcataacttgtctttccaaaataaccattttcttgatggaactcttcctagagtttttaccaaatagctaactttagtagtaaaacctcattgtgtatccattcccccacagatgaactaagaaagtcaccaagtgtcttaagctgttttatatttgttacgaagaaggctattgctacaatatttttaaaggtttcttttttaactttgaaattttttgtttttccttttctttttataaatgtaacagagggtttcaaagcatattatttttcagagagatttagttttactttaatggagtgactgtgaagtggttgggattttttgcttgtagaaagtagacttgctctttgtcagatttccaaacaaccttgccagccttggctgtcaaaaggaggcaggagcagttctcaacacaccaagccttattcccactcccttgggttgctgctgagccaaatagcatctttacagaggaagtgggatcagaggcaggaagtgtggaaagttgctaagaagcagggcttgcctctgtcctcccggggactccacagggatattcgtgcagggcaggggctctgtgccagccctgctctctcagatgccacagccactctgcagaggtgactcttggagctggaggaagtcaaaactgggccactgtttgtactgatggtgtattagcatgagcagcgtggccctggccccacactcccaaatctgccactccatagacccacttgcctcaaggctttatatttggctgctttcttacaatgagaattaagatttttaaactgaagttgaccatacaggttgcattagccctaactggcttcatgtaagaagggtgactgcctaaactagttccttgtaagctgaaccatcaattatcagttgaagccatacttttatttaaattaatatacgtagataccagaggccaagccacagagaggataatagttcttcccaataaaggtgatattaatcagactaatttcgaactaaagaagttactgcttaaagacggaatttcaggggaagcaagactcatttagaacaaatgaaatttctccagtcctacatttctgaattgacttctagcacatcaaaaatatttcagtcattatcagtctcattaactgaaatgccaaatgctaaatgcagtgttctttcacactgttttaattttcttgggaaattgagtccagtggatgttaatggagtgggttgcccatccctgaaatgtcttattttcaagtgcctggcctgggaaagaaggggaagaaacaattgcattatatccaaagatacactataaaaatagagtttttaccaaaaaaagatgtttgttctcatctcagtaggcctcatttgggcaagtgacccacaggtcttttggcgagtttgctatttgcctgttgaaatacttgtttcaacttagagaacagttatgatgtgaccatagcatggcacaactaaaaatctaagcctgaaacctgaaaaaagagatatgacaagggaaattaatcaggctatacataagtattgtatttatttgaataaaaataaaaagagcaacccat

SEQ ID NO: 171556 - DNA, 4517 bp, Homo sapiens
  Payload ID: 13733
  Gene Symbol: PTPDC1
  Gene Name: protein tyrosine phosphatase domain containing 1
  Uniprot ID: A2A3K4
  ENST ID: ENST00000375360
  CDS Start-End: 341-2605
gggcgggcgcgctgagggcagcgccggggacgcggcctcagcaggggcgccccgccacggggagcagcccaggcgctcgccccaggacgttgtccggcgggctgggctgggacccctctgcctccagggcgcgtcgggagcagcagggatcggtgccgcgccgtgagggtgcgcagaggctgccctcgggcccgctacccacagaccctccgcggggcagcgtctccgggccggccgcgccctggtccgccgaccgcagacgacttgtgacacggacggcgcgtcctgctgaccccagccggcgccgagggcttggaatctcgagcgggaaaagactaccatggctgcaggagtcttgcctcagaatgaacaaccatattctaccttggtgaataacagcgagtgtgttgcaaacatgaaaggaaatttagaacgtccaacaccaaagtacacaaaagtaggggagcgtttacggcatgtcattcctggacacatggcatgttccatggcgtgtggcggtagagcttgcaagtatgagaacccagcccgctggagtgagcaggagcaagccattaagggggtttactcatcctgggtcactgataatatactggccatggcccgcccatcctctgagctcctggagaagtaccacatcattgatcagttcctcagccatggcataaaaacaataatcaacctccagcgccctggtgagcatgctagctgtgggaaccctctggaacaagaaagtggcttcacataccttcctgaggctttcatggaggctggcatttacttctacaatttcggatggaaggattatggtgtagcgtctcttactactatcctagatatggtgaaggtgatgacatttgccttacaggaaggaaaagtagctatccattgtcatgcagggcttggtcgaacaggtgttttaatagcctgttacttagtttttgcaacgagaatgactgctgaccaagcaattatatttgtgcgggcaaagcgacccaattccatacaaaccagaggacagctcctctgtgtaagggaatttactcagtttctaactcctctccgcaatatattctcttgctgtgatcccaaagcacatgctgtcaccttacctcaatatctaattcgccagcgtcatctgcttcatggttatgaggcacgacttctgaaacacgtgccaaaaattatccacctagtttgcaaattgctgctggacttagcggagaacaggccagtgatgatgaaggatgtgtccgaaggacctggtctctctgctgaaatagaaaagacaatgtctgagatggtcaccatgcagctggataaagagttactgaggcatgacagtgatgtgtccaacccgcctaaccccactgcagtggcagcagattttgacaatcgaggcatgattttctccaatgagcaacagtttgaccctctttggaaaaggcggaatgttgagtgccttcaacccctgactcatctgaaaaggcggctcagctacagtgactcagatttaaagagggccgagaacctcctggagcaaggggagactccacagacagtgcctgcccagatcttggttggccacaagcccaggcagcagaagctcataagccattgttacatcccacagtctccagaaccagacttacacaaggaagccttggttcgcagcacactttctttctggagtcagtcaaagtttggaggcctggaaggactcaaagataatgggtcaccaattttccatggaaggatcattccaaaggaagcacagcagagtggagctttctctgcagatgtttcaggctcacacagccctggggagccagtttcacccagctttgcaaatgtccataaggatccaaaccctgctcaccagcaagtgtctcactgtcagtgtaaaactcatggtgttgggagccctggctctgtcaggcagaacagcaggacaccccgaagccctctggactgtggctccagtcccaaagcacagttcttggttgaacatgaaacccaggacagtaaagatctgtctgaagcagcttcacactctgcattacagtctgaattgagtgctgaggcaagaagaatactggcggccaaagccctagcaaatttaaatgaatctgtagaaaaggaggaactaaaaaggaaggtagaaatgtggcagaaagagcttaattcccgagatggagcttgggaaagaatatgtggcgagagggaccctttcatcctatgcagcttgatgtggtcttgggtggagcaactgaaggagcctgtaatcaccaaagaggatgtggacatgttggttgacaggcgagcagatgccgcagaagcactttttttattagagaagggacagcaccagactattctctgcgtgttgcactgcatagtgaacctgcagacaattcccgtggatgtggaggaagctttccttgcccatgccattaaggcattcactaaggttaattttgattctgaaaatggaccaacagtttacaacaccctgaagaaaatatttaagcacacgctggaagaaaaaagaaaaatgacaaaagatggccctaagcctggcctctagctttcactcgtggtgaatatttcagacctaaagatccagatagtatctctgttcatatgtgaataagttgaagattgtggggctactttttctcatagcactttattttgaatgttgttagtttgtgctgagaatggtcgtccgtatttgaaccaattatttattttaaaatatatttaagctacatttttgttttgaaaaattgccataaatttggtgccactttcttttatttatttgactgagttaatattattgtattaacattttaagtatatggtgtttacattcttatttcttttgacattttggaaataatcataacttgtctttccaaaataaccattttcttgatggaactcttcctagagtttttaccaaatagctaactttagtagtaaaacctcattgtgtatccattcccccacagatgaactaagaaagtcaccaagtgtcttaagctgttttatatttgttacgaagaaggctattgctacaatatttttaaaggtttcttttttaactttgaaattttttgtttttccttttctttttataaatgtaacagagggtttcaaagcatattatttttcagagagatttagttttactttaatggagtgactgtgaagtggttgggattttttgcttgtagaaagtagacttgctctttgtcagatttccaaacaaccttgccagccttggctgtcaaaaggaggcaggagcagttctcaacacaccaagccttattcccactcccttgggttgctgctgagccaaatagcatctttacagaggaagtgggatcagaggcaggaagtgtggaaagttgctaagaagcagggcttgcctctgtcctcccggggactccacagggatattcgtgcagggcaggggctctgtgccagccctgctctctcagatgccacagccactctgcagaggtgactcttggagctggaggaagtcaaaactgggccactgtttgtactgatggtgtattagcatgagcagcgtggccctggccccacactcccaaatctgccactccatagacccacttgcctcaaggctttatatttggctgctttcttacaatgagaattaagatttttaaactgaagttgaccatacaggttgcattagccctaactggcttcatgtaagaagggtgactgcctaaactagttccttgtaagctgaaccatcaattatcagttgaagccatacttttatttaaattaatatacgtagataccagaggccaagccacagagaggataatagttcttcccaataaaggtgatattaatcagactaatttcgaactaaagaagttactgcttaaagacggaatttcaggggaagcaagactcatttagaacaaatgaaatttctccagtcctacatttctgaattgacttctagcacatcaaaaatatttcagtcattatcagtctcattaactgaaatgccaaatgctaaatgcagtgttctttcacactgttttaattttcttgggaaattgagtccagtggatgttaatggagtgggttgcccatccctgaaatgtcttattttcaagtgcctggcctgggaaagaaggggaagaaacaattgcattatatccaaagatacactataaaaatagagtttttaccaaaaaaagatgtttgttctcatctcagtaggcctcatttgggcaagtgacccacaggtcttttggcgagtttgctatttgcctgttgaaatacttgtttcaacttagagaacagttatgatgtgaccatagcatggcacaactaaaaatctaagcctgaaacctgaaaaaagagatatgacaagggaaattaatcaggctatacataagtattgtatttatttgaataaaaataaaaagagcaacccataa

SEQ ID NO: 171557 - DNA, 4437 bp, Homo sapiens
  Payload ID: 13733
  Gene Symbol: PTPDC1
  Gene Name: protein tyrosine phosphatase domain containing 1
  ENST ID: ENST00000620992
  CDS Start-End: 103-2529
agatcatacagaacgatgcaatgctccctgctctcagtgaaagttcctcactgagtgagtggggctgactcttcctgcctccggctcttgcctcccagtgccatgcaggtgcaggatgcaaccaggcggccctcagccgtgcgcttcctcagctcctttctccagggccgccggcactccacctcagacccagtactgcggctgcagcaggcccggcggggctctggcttgggctccggctctgccacgaagctgctgtcctcgtcctctctccaggtgatggtggctgtttcctcagtcagccatgcagagggaaacccaactttccccgaaagaaaaagtaaaggaaatttagaacgtccaacaccaaagtacacaaaagtaggggagcgtttacggcatgtcattcctggacacatggcatgttccatggcgtgtggcggtagagcttgcaagtatgagaacccagcccgctggagtgagcaggagcaagccattaagggggtttactcatcctgggtcactgataatatactggccatggcccgcccatcctctgagctcctggagaagtaccacatcattgatcagttcctcagccatggcataaaaacaataatcaacctccagcgccctggtgagcatgctagctgtgggaaccctctggaacaagaaagtggcttcacataccttcctgaggctttcatggaggctggcatttacttctacaatttcggatggaaggattatggtgtagcgtctcttactactatcctagatatggtgaaggtgatgacatttgccttacaggaaggaaaagtagctatccattgtcatgcagggcttggtcgaacaggtgttttaatagcctgttacttagtttttgcaacgagaatgactgctgaccaagcaattatatttgtgcgggcaaagcgacccaattccatacaaaccagaggacagctcctctgtgtaagggaatttactcagtttctaactcctctccgcaatatattctcttgctgtgatcccaaagcacatgctgtcaccttacctcaatatctaattcgccagcgtcatctgcttcatggttatgaggcacgacttctgaaacacgtgccaaaaattatccacctagtttgcaaattgctgctggacttagcggagaacaggccagtgatgatgaaggatgtgtccgaaggacctggtctctctgctgaaatagaaaagacaatgtctgagatggtcaccatgcagctggataaagagttactgaggcatgacagtgatgtgtccaacccgcctaaccccactgcagtggcagcagattttgacaatcgaggcatgattttctccaatgagcaacagtttgaccctctttggaaaaggcggaatgttgagtgccttcaacccctgactcatctgaaaaggcggctcagctacagtgactcagatttaaagagggccgagaacctcctggagcaaggggagactccacagacagtgcctgcccagatcttggttggccacaagcccaggcagcagaagctcataagccattgttacatcccacagtctccagaaccagacttacacaaggaagccttggttcgcagcacactttctttctggagtcagtcaaagtttggaggcctggaaggactcaaagataatgggtcaccaattttccatggaaggatcattccaaaggaagcacagcagagtggagctttctctgcagatgtttcaggctcacacagccctggggagccagtttcacccagctttgcaaatgtccataaggatccaaaccctgctcaccagcaagtgtctcactgtcagtgtaaaactcatggtgttgggagccctggctctgtcaggcagaacagcaggacaccccgaagccctctggactgtggctccagtcccaaagcacagttcttggttgaacatgaaacccaggacagtaaagatctgtctgaagcagcttcacactctgcattacagtctgaattgagtgctgaggcaagaagaatactggcggccaaagccctagcaaatttaaatgaatctgtagaaaaggaggaactaaaaaggaaggtagaaatgtggcagaaagagcttaattcccgagatggagcttgggaaagaatatgtggcgagagggaccctttcatcctatgcagcttgatgtggtcttgggtggagcaactgaaggagcctgtaatcaccaaagaggatgtggacatgttggttgacaggcgagcagatgccgcagaagcactttttttattagagaagggacagcaccagactattctctgcgtgttgcactgcatagtgaacctgcagacaattcccgtggatgtggaggaagctttccttgcccatgccattaaggcattcactaaggttaattttgattctgaaaatggaccaacagtttacaacaccctgaagaaaatatttaagcacacgctggaagaaaaaagaaaaatgacaaaagatggccctaagcctggcctctagctttcactcgtggtgaatatttcagacctaaagatccagatagtatctctgttcatatgtgaataagttgaagattgtggggctactttttctcatagcactttattttgaatgttgttagtttgtgctgagaatggtcgtccgtatttgaaccaattatttattttaaaatatatttaagctacatttttgttttgaaaaattgccataaatttggtgccactttcttttatttatttgactgagttaatattattgtattaacattttaagtatatggtgtttacattcttatttcttttgacattttggaaataatcataacttgtctttccaaaataaccattttcttgatggaactcttcctagagtttttaccaaatagctaactttagtagtaaaacctcattgtgtatccattcccccacagatgaactaagaaagtcaccaagtgtcttaagctgttttatatttgttacgaagaaggctattgctacaatatttttaaaggtttcttttttaactttgaaattttttgtttttccttttctttttataaatgtaacagagggtttcaaagcatattatttttcagagagatttagttttactttaatggagtgactgtgaagtggttgggattttttgcttgtagaaagtagacttgctctttgtcagatttccaaacaaccttgccagccttggctgtcaaaaggaggcaggagcagttctcaacacaccaagccttattcccactcccttgggttgctgctgagccaaatagcatctttacagaggaagtgggatcagaggcaggaagtgtggaaagttgctaagaagcagggcttgcctctgtcctcccggggactccacagggatattcgtgcagggcaggggctctgtgccagccctgctctctcagatgccacagccactctgcagaggtgactcttggagctggaggaagtcaaaactgggccactgtttgtactgatggtgtattagcatgagcagcgtggccctggccccacactcccaaatctgccactccatagacccacttgcctcaaggctttatatttggctgctttcttacaatgagaattaagatttttaaactgaagttgaccatacaggttgcattagccctaactggcttcatgtaagaagggtgactgcctaaactagttccttgtaagctgaaccatcaattatcagttgaagccatacttttatttaaattaatatacgtagataccagaggccaagccacagagaggataatagttcttcccaataaaggtgatattaatcagactaatttcgaactaaagaagttactgcttaaagacggaatttcaggggaagcaagactcatttagaacaaatgaaatttctccagtcctacatttctgaattgacttctagcacatcaaaaatatttcagtcattatcagtctcattaactgaaatgccaaatgctaaatgcagtgttctttcacactgttttaattttcttgggaaattgagtccagtggatgttaatggagtgggttgcccatccctgaaatgtcttattttcaagtgcctggcctgggaaagaaggggaagaaacaattgcattatatccaaagatacactataaaaatagagtttttaccaaaaaaagatgtttgttctcatctcagtaggcctcatttgggcaagtgacccacaggtcttttggcgagtttgctatttgcctgttgaaatacttgtttcaacttagagaacagttatgatgtgaccatagcatggcacaactaaaaatctaagcctgaaacctgaaaaaagagatatgacaagggaaattaatcaggctatacataagtattgtatttatttgaataaaaataaaaagagcaaccc

SEQ ID NO: 171558 - DNA, 5088 bp, Homo sapiens
  Payload ID: 13734
  Gene Symbol: PTP4A1
  Gene Name: protein tyrosine phosphatase type IVA, member 1
  Uniprot ID: Q93096
  ENST ID: ENST00000370651
  CDS Start-End: 1154-1675
aaagatgaccgtggttaaggcagtagaaagcaggctcgacactgagacgcggttccagccctagaaggattgcattttacgattcaggcaaacttcgagtctcctcatgtgacatgtgtgcactcctggaccgttttaattatgagaaacgtggtttgcagcatgattccttccagtcgataaatcggaatctctctcgctcccaccccttcttaacttcaggcttcctgcatcccggagcactcccggcagccccttccctcccccgccccggggatgctccgactcggcgcttagccattcatcaaccggttcacaccggcggcggccgccgcggagtgacgtccggagggggcgggcctccgcccccgcctgtcggctcctggcccgcggttccaggccgcgattggtggctggagggttgcacgtcgcgccggctataaaggggagggcttgtgacgcaagggcgcctcggcgcgtgtattggctccttcggctgcgggccggctcggctacgcgctctgctccgagccgctcactgcatggtagagtctggtgcccccgccgccgcctgcatcgccgccaccgccgctccgccacgaccaccgccgcctcctgccctgcagccaccgccaccgcctgtgtcgccgccgcctcgggaccggctgtatgattaggccacaatcttcaatgagtaaacatattcctcaattctgtggtgttcttggtcacacatttatggagtttctgaagggcagtggagattactgccaggcacagcacgacctctatgcagacaagtgaactgtagaaactgattactgctccaccaagaagcccccataagagtggttatcctggacacagaagtgttgaattgaaatccacagagcattttacaagagttctgacctggatggggtaaacctcagtgcacttcttttctgttggcctcagtattactggattgaagaattgctgcttcttgttaggaggttcatttcacttatcattacttacaacttcatactcaaagcactgagaatttcaagtggagtatattgaagtagacttcagtttctttgcatcatttctgtattcaatttttttaattatttcataaccctattgagtgttttttaactaaattaacatggctcgaatgaaccgcccagctcctgtggaagtcacatacaagaacatgagatttcttattacacacaatccaaccaatgcgaccttaaacaaatttatagaggaacttaagaagtatggagttaccacaatagtaagagtatgtgaagcaacttatgacactactcttgtggagaaagaaggtatccatgttcttgattggccttttgatgatggtgcaccaccatccaaccagattgttgatgactggttaagtcttgtgaaaattaagtttcgtgaagaacctggttgttgtattgctgttcattgcgttgcaggccttgggagagctccagtacttgttgccctagcattaattgaaggtggaatgaaatacgaagatgcagtacaattcataagacaaaagcggcgtggagcttttaacagcaagcaacttctgtatttggagaagtatcgtcctaaaatgcggctgcgtttcaaagattccaacggtcatagaaacaactgttgcattcaataaaattggggtgcctaatgctactggaagtggaacttgagatagggcctaatttgttatacatattagccaacatgttggcttagtaagtctaatgaagcttccataggagtattgaaaggcagttttaccaggcctcaagctagacagatttggcaacctctgtatttgggttacagtcaacctatttggatacttggcaaaagattcttgctgtcagcatataaaatgtgcttgtcatttgtatcaattgacctttccccaaatcatgcagtattgagttatgacttgttaaatctattcccatgccagaatcttatcaatacataagaaatttaggaagattaggtgccaaaatacccagcacaatacttgtatatttttagtaccatacagaagtaaaatcccaggaactatgaacactagaccttatgtggtttattccttcaatcatttcaaacattgaaagtagggcctacatggttatttgcctgctcactttatgtttacatctcccacattcataccaatatacgtcaggtttgcttaaccattgatttttttttttttttaccaagtcttacagtgattattttacgtgtttccatgtatctcactttgtgctgtattaaaaaaacctccattttgaaaatctacgttgtacagaagcacatgtctttaatgtcttcagacaaaaaagccttacattaatttaatgtttgcactctgaggtgcaacttaacagggagggcctgagaaaagaatgggagggggctattaattatttttagcaaaatgttgcctttgtcttgtgcaaacatgtagaatatgctctttaatttagtaaaatatttttttaaaaggtagagatgctttgttattgtaatcataaacttcctgaaattcttgtaatttttttcccatacttatcagaagtgtgtttaccaacttatttttgtttgaaagtgtgattttttttttccttcccaacctctcttgcaaaaaaagaaatgggtttctgctaatgaattgagcagacatctaatattttatatgccttttgagctgtgtaacttaatatttggatacttgacaatttgttttattatgtaattgataaaatggtgatgtgtattaatgttagttcaaccatatatttatactgtctggggatgtgtggttatagttctgtgggagaaataattttgtcagtgttcaccagcttgtaaaaacttagtgcgagagctgaaacatctaaataaataatgacatgcatttatcatcattgagattggtttgcttaaaattaacttattttgtagaagacaaaatgaattgcacttcacttaatgtgtgtcctcatctttttacaaataaatgaaggattataaatgatgtcagcattttagtaaacttttagacaaaatttgttagggtcattcatgaaaactttaatactaaaagcactttccattatatactttttaaaggtctagataattttgaaccaatttattattgtgtactgaggagaaataatgtatagtagaggacagccttggtttgtaaagctcagttccactagttcatggttttgtgcaacttctgagcctcagttttctcctttgcaaattaataattacatacctttatagattttgaaattaatttaaatattagtatttggtacatgaaggcttaatgttaagtttcctttaatgatccacaataatccctttgatcacgttaatctaaatctagatgtctttgtctaattttttttgaatagcagttataaatgtaaaggactcaaagtttaagtaaaaagtgatactccaccttgtgtttcaaagaatttagttccacctcttcataccagtttaacacttaatatatttcattggattttagacagggcaaaaggaagaacaggggcctctggaggcccttggttatttaaatcttggattatttgtgatagtaatcacaaatttttggctaatttttaacctgaggttttgttttttttttaaaggaaatgcagcctagtcttgagaacataattttatataatcaattactaaatgttaaactattaccacacagcccataaaacagcatttgcgtttattgagagagaggatgtgccatcatgattaatgaaaactatcttttgagtttgaaaagaaattaatttgcagtgtttggattgtatatatggtgctaaaaataaattaatttactttataaaccttatctgtacattatacgatgtgatgaaatttgctttttatccaaatattttgtatcttgtaaatatggctaattataggaatgcctataatacatcttagattccttatatctaataagagttcaaagagttatgagttgaagtcttgaatgcaggaaactatctgatagtgttctaaaatttggttacttgggtttggatacccttagtgggatgatgtaaatagaggctagctacctaggcttgtctatagcaaccataatgttgatgtaagtaatgcggttactgaatcataagaaaatgccatctctttttagttgaaggaaaactctggaagtaggtgccattggtcattctgcagtgcactgcaaccattgtttcccctagtgccctcttttccctagggcattgctctcctattcccacgccttaacacagctctatacctagaagcagccagcccaggcatgcagtcacatttaatcacatcccccttctagagtgcttcaaaatgatgtagtccctcaacttggctaaagaatctcaatctcttgaaatttatttttttaatgtcatattcatctggtaaatatctactgtttgccaggcatttaagaatatggcaaagaacataaaagatggtgtcaccagattttggtcaccaatgagtacccgacccgttgccatgattaagagagaatgctttctattggagtttcaggaaatataatttgagaatactttaaagggaagtggaagtataagtgaatgatatttttcttttacatgtaaacaatgaagttatttcaaagttaagttttaaacaaaatacatgaagtagtgtctgccatacatgttaatattctacattcttgcttccttaaattaatatgtttgtgtgtatatatgtgcctcacacctgaattgaaaattaaagactggtttaaaagtggtttaaaagtgacatttaatgtttctccattacgtttggggtaaccagcctaagtggaatcttggaaggaaagtaagggaaaaacttgtatttgccttcaatgaattaaaccagtgatatgtgttaacgtatgaatgaaaggattgatggtgattttataattatatatattgccgcagtaaccagttaataaattgatagctaccattt

SEQ ID NO: 171559 - DNA, 135 bp, Homo sapiens
  Payload ID: 13734
  Gene Symbol: PTP4A1
  Gene Name: protein tyrosine phosphatase type IVA, member 1
  ENST ID: ENST00000578299
  CDS Start-End: 1-135
atgattaggccacaatcttcaatgagtaaacatattcctcaattctgtggtgttcttggtcacacatttatggagtttctgaagggcagtggagattactgccaggcacagcacgacctctatgcagacaagtga

SEQ ID NO: 171560 - DNA, 2203 bp, Homo sapiens
  Payload ID: 13734
  Gene Symbol: PTP4A1
  Gene Name: protein tyrosine phosphatase type IVA, member 1
  Uniprot ID: Q93096
  ENST ID: ENST00000626021
  CDS Start-End: 394-915
gagattactgccaggcacagcacgacctctatgcagacaagtgaactgtagaaactgattactgctccaccaagaagcccccataagagtggttatcctggacacagaagtgttgaattgaaatccacagagcattttacaagagttctgacctggatggggtaaacctcagtgcacttcttttctgttggcctcagtattactggattgaagaattgctgcttcttgttaggaggttcatttcacttatcattacttacaacttcatactcaaagcactgagaatttcaagtggagtatattgaagtagacttcagtttctttgcatcatttctgtattcaatttttttaattatttcataaccctattgagtgttttttaactaaattaacatggctcgaatgaaccgcccagctcctgtggaagtcacatacaagaacatgagatttcttattacacacaatccaaccaatgcgaccttaaacaaatttatagaggaacttaagaagtatggagttaccacaatagtaagagtatgtgaagcaacttatgacactactcttgtggagaaagaaggtatccatgttcttgattggccttttgatgatggtgcaccaccatccaaccagattgttgatgactggttaagtcttgtgaaaattaagtttcgtgaagaacctggttgttgtattgctgttcattgcgttgcaggccttgggagagctccagtacttgttgccctagcattaattgaaggtggaatgaaatacgaagatgcagtacaattcataagacaaaagcggcgtggagcttttaacagcaagcaacttctgtatttggagaagtatcgtcctaaaatgcggctgcgtttcaaagattccaacggtcatagaaacaactgttgcattcaataaaattggggtgcctaatgctactggaagtggaacttgagatagggcctaatttgttatacatattagccaacatgttggcttagtaagtctaatgaagcttccataggagtattgaaaggcagttttaccaggcctcaagctagacagatttggcaacctctgtatttgggttacagtcaacctatttggatacttggcaaaagattcttgctgtcagcatataaaatgtgcttgtcatttgtatcaattgacctttccccaaatcatgcagtattgagttatgacttgttaaatctattcccatgccagaatcttatcaatacataagaaatttaggaagattaggtgccaaaatacccagcacaatacttgtatatttttagtaccatacagaagtaaaatcccaggaactatgaacactagaccttatgtggtttattccttcaatcatttcaaacattgaaagtagggcctacatggttatttgcctgctcactttatgtttacatctcccacattcataccaatatacgtcaggtttgcttaaccattgatttttttttttttttaccaagtcttacagtgattattttacgtgtttccatgtatctcactttgtgctgtattaaaaaaacctccattttgaaaatctacgttgtacagaagcacatgtctttaatgtcttcagacaaaaaagccttacattaatttaatgtttgcactctgaggtgcaacttaacagggagggcctgagaaaagaatgggagggggctattaattatttttagcaaaatgttgcctttgtcttgtgcaaacatgtagaatatgctctttaatttagtaaaatatttttttaaaaggtagagatgctttgttattgtaatcataaacttcctgaaattcttgtaatttttttcccatacttatcagaagtgtgtttaccaacttatttttgtttgaaagtgtgattttttttttccttcccaacctctcttgcaaaaaaagaaatgggtttctgctaatgaattgagcagacatctaatattttatatgccttttgagctgtgtaacttaatatttggatacttgacaatttgttttattatgtaattgataaaatggtgatgtgtattaatgttagttcaaccatatatttatactgtctggggatgtgtggttatagttctgtgggagaaataattttgtcagtgttcaccagcttgtaaaaacttagtgcgagagctgaaacatctaaataaataatgacatgcatttatcatcattgaga

SEQ ID NO: 171561 - DNA, 447 bp, Homo sapiens
  Payload ID: 13734
  Gene Symbol: PTP4A1
  Gene Name: protein tyrosine phosphatase type IVA, member 1
  ENST ID: ENST00000627002
  CDS Start-End: 1-447
atggctcgaatgaaccgcccagctcctgtggaagtcacatacaagaacatgagatttcttattacacacaatccaaccaatgcgaccttaaacaaatttatagaggaacttaagaagtatggagttaccacaatagtaagagtatgtgaagcaacttatgacactactcttgtggagaaagaaggtatccatgttcttgattggccttttgatgatggtgcaccaccatccaaccagattgttgatgactggttaagtcttgtgaaaattaagtttcgtgaagaacctggttgttgtattgctgttcattgcgttgcaggccttgggagaaagcggcgtggagcttttaacagcaagcaacttctgtatttggagaagtatcgtcctaaaatgcggctgcgtttcaaagattccaacggtcatagaaacaactgttgcattcaataa

SEQ ID NO: 171562 - DNA, 3929 bp, Homo sapiens
  Payload ID: 13735
  Gene Symbol: PTP4A2
  Gene Name: protein tyrosine phosphatase type IVA, member 2
  Uniprot ID: Q12974
  ENST ID: ENST00000344035
  CDS Start-End: 995-1498
gcggcggcgggagctggttccggctgcgcgcgcagcggtggtggtggcggcgcgatcggccgggctgtaaccgtcgtctgtccgggagcggctggagcggcagcggcggccgggcacggcgcgaggtgacgccacagggcagcggcggcagcggaggcagcggcggcagcaggagacgcagcggcggccgcagcagcagcagcaagacggactcgtggagacgcgccgccgccgccgccgccgggccgggccgggtgtcgcgcgccgaggctgggggggagtcgtcgccgccgccgccaccgctaccgccgccgccgccgccgccgaggtgactgaggagagaggcgcctcctcgctcccgccaccgccggacttcaatgcccagtccccagctcgccagcgtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgtgggggagggttggtggtatatttttcccctcttttttccttcctctcctacatctcccttttcccccgatccaagttgtagatggaatagaagcccttgttgctgtagatgtgcgtgcagtctggcagccttaagcccacctgggcacttttagataaaaaaaaaaaaaaaacaaaaaacaacaccaaaaaaacagcagtgatatatatatatatatatatatatatatatatatatatatatatatatatatatatatatatatataatataatatatatatatatatatatattttccaggtggtttttagtctttactgatgaaagggtgttcatgttagtttcttcaaaaccctatctaatactaggcaaagtagccaagagccttttgttttgtttttattttgataaattagtggagaaatggcattttaagaggagtctcttctcaacttacctgagagtcgaattcttctcttccctaaccaatgaagctaagtggttatcccagaaacttgtcttctaaaagggaggactccaggccatcaataaagatgtccaggcagtgagcgtactttttacaccctgtagaattgtgggctgtagcgttactctgattttctgtctagtatcagagaatgctggtagcttaaaatttttattttaggacttgtactctgaattttcaggaaccgtcaaaggagcagcagcaaattcacatattttcgacttgagaaatgcttgtggtatgtgttttccaaactgccccctatatgtaaagttcagtttaaccactgattgccttgttattactaggttttttgagattaaaaaaaaaaaatccctggtttaaaaccaacaatgatgcctagtgagtatgtgtccacaggccataacagggtagaagagagacatcgtgcaacccaatgagtagtgaagggactgtgttgcttgtgaagcggtgtagtagcatttttgcagattcttggctgggtttagtgtactgatctagaaaagctgtttttctgctcctttgtggaaggcagttatgatcaggctgcatggacaaagcaggtagaggggcaccatcaggggctcttgcactattttcacctctaaatattacgtactcagtagtgccctgcttctagggctctgaatacgggcttaaagtcatcttgtcctgctggaatttgctgtgcagagccataagcctcccattttgttagcgtcagctaggccaataggaacagaccgggaccttgtctcacactgatgatacctcacatgttgaccggctatgtgaactgcctatttcctatgctggagttttgatttttaactaaacgcaaatctgtagattctctcctctcccatcccagaaaacaaaacaaaataatgcttttcgaaattgtttctaggactttaaaacataatggtatatccaaaattctttatttcagaatgcaacaatagattccattaatatagactcaagatcaaaacagcatacctgctaagctaagatagatggtgttgattccactgggttttgatcaatacaataacaaacctttttcctttgacatactctgaattttgttgtttggggggagggggtgtgtgtgtgtgtgtgtgtgtgtgtgtgtgtatgtgtgtgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcctgatttaaaaccaaaccctgaacccttttaaagaacaataaaacatattttacacgctc

SEQ ID NO: 171563 - DNA, 1032 bp, Homo sapiens
  Payload ID: 13735
  Gene Symbol: PTP4A2
  Gene Name: protein tyrosine phosphatase type IVA, member 2
  Uniprot ID: Q12974
  ENST ID: ENST00000457805
  CDS Start-End: 304-714
gtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaata

SEQ ID NO: 171564 - DNA, 911 bp, Homo sapiens
  Payload ID: 13735
  Gene Symbol: PTP4A2
  Gene Name: protein tyrosine phosphatase type IVA, member 2
  ENST ID: ENST00000532001
  CDS Start-End: 295-495
gctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctaatggcagagtgagaaaatgactggattgaccatagtctgtttgagtcagtaatgttggtgcattttagggagtattagaggaagtaagctcttgactaaggattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtagaaggaaatgtaaa

SEQ ID NO: 171565 - DNA, 900 bp, Homo sapiens
  Payload ID: 13735
  Gene Symbol: PTP4A2
  Gene Name: protein tyrosine phosphatase type IVA, member 2
  ENST ID: ENST00000534796
  CDS Start-End: 835-900
gggggagagtgagttggtgaagggagggcgtgagcttgatcctggatagtgtttgtatgatgtgcacacgtctctgcaaatgcttgtttgaagattggctgtgctgcattttggtataattgggaggtgacatattgtcccttatctcagtaaacatttggaggaagaggacgagaaagattgaattttgcattctttaattgggaagaaaaggaaggtgaatccatgttgagctgagctagtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccct

SEQ ID NO: 171566 - DNA, 806 bp, Homo sapiens
  Payload ID: 13735
  Gene Symbol: PTP4A2
  Gene Name: protein tyrosine phosphatase type IVA, member 2
  ENST ID: ENST00000528253
  CDS Start-End: 400-609
aagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagtgcattttagggagtattagaggaagtaagctcttgactaaggattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatga

SEQ ID NO: 171567 - DNA, 575 bp, Homo sapiens
  Payload ID: 13735
  Gene Symbol: PTP4A2
  Gene Name: protein tyrosine phosphatase type IVA, member 2
  ENST ID: ENST00000470404
  CDS Start-End: 59-280
ttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctaggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaac

SEQ ID NO: 171568 - DNA, 830 bp, Homo sapiens
  Payload ID: 13735
  Gene Symbol: PTP4A2
  Gene Name: protein tyrosine phosphatase type IVA, member 2
  ENST ID: ENST00000468531
  CDS Start-End: 642-830
agtaaaaccatgttacagccttctgtgggaagccatttggatgtcggggtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttcta

SEQ ID NO: 171569 - DNA, 3353 bp, Homo sapiens
  Payload ID: 13735
  Gene Symbol: PTP4A2
  Gene Name: protein tyrosine phosphatase type IVA, member 2
  Uniprot ID: Q12974
  ENST ID: ENST00000602725
  CDS Start-End: 419-922
tttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgtgggggagggttggtggtatatttttcccctcttttttccttcctctcctacatctcccttttcccccgatccaagttgtagatggaatagaagcccttgttgctgtagatgtgcgtgcagtctggcagccttaagcccacctgggcacttttagataaaaaaaaaaaaaaaacaaaaaacaacaccaaaaaaacagcagtgatatatatatatatatatatatatatatatatatatatatatatatatatatatatatatatatataatataatatatatatatatatatatattttccaggtggtttttagtctttactgatgaaagggtgttcatgttagtttcttcaaaaccctatctaatactaggcaaagtagccaagagccttttgttttgtttttattttgataaattagtggagaaatggcattttaagaggagtctcttctcaacttacctgagagtcgaattcttctcttccctaaccaatgaagctaagtggttatcccagaaacttgtcttctaaaagggaggactccaggccatcaataaagatgtccaggcagtgagcgtactttttacaccctgtagaattgtgggctgtagcgttactctgattttctgtctagtatcagagaatgctggtagcttaaaatttttattttaggacttgtactctgaattttcaggaaccgtcaaaggagcagcagcaaattcacatattttcgacttgagaaatgcttgtggtatgtgttttccaaactgccccctatatgtaaagttcagtttaaccactgattgccttgttattactaggttttttgagattaaaaaaaaaaaatccctggtttaaaaccaacaatgatgcctagtgagtatgtgtccacaggccataacagggtagaagagagacatcgtgcaacccaatgagtagtgaagggactgtgttgcttgtgaagcggtgtagtagcatttttgcagattcttggctgggtttagtgtactgatctagaaaagctgtttttctgctcctttgtggaaggcagttatgatcaggctgcatggacaaagcaggtagaggggcaccatcaggggctcttgcactattttcacctctaaatattacgtactcagtagtgccctgcttctagggctctgaatacgggcttaaagtcatcttgtcctgctggaatttgctgtgcagagccataagcctcccattttgttagcgtcagctaggccaataggaacagaccgggaccttgtctcacactgatgatacctcacatgttgaccggctatgtgaactgcctatttcctatgctggagttttgatttttaactaaacgcaaatctgtagattctctcctctcccatcccagaaaacaaaacaaaataatgcttttcgaaattgtttctaggactttaaaacataatggtatatccaaaattctttatttcagaatgcaacaatagattccattaatatagactcaagatcaaaacagcatacctgctaagctaagatagatggtgttgattccactgggttttgatcaatacaataacaaacctttttcctttgacatactctgaattttgttgtttggggggagggggtgtgtgtgtgtgtgtgtgtgtgtgtgtgtgtatgtgtgtgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcctgatttaaaaccaaaccctgaacccttttaaagaacaataaaacatattttacacgctc

SEQ ID NO: 171570 - DNA, 667 bp, Homo sapiens
  Payload ID: 13735
  Gene Symbol: PTP4A2
  Gene Name: protein tyrosine phosphatase type IVA, member 2
  Uniprot ID: Q12974
  ENST ID: ENST00000602683
  CDS Start-End: 45-473
ccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaag

SEQ ID NO: 171571 - DNA, 615 bp, Homo sapiens
  Payload ID: 13735
  Gene Symbol: PTP4A2
  Gene Name: protein tyrosine phosphatase type IVA, member 2
  ENST ID: ENST00000627328
  CDS Start-End: 406-615
aattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagtgcattttagggagtattag

SEQ ID NO: 171572 - DNA, 606 bp, Homo sapiens
  Payload ID: 13735
  Gene Symbol: PTP4A2
  Gene Name: protein tyrosine phosphatase type IVA, member 2
  ENST ID: ENST00000626355
  CDS Start-End: 406-606
aattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctaatggcagagtga

SEQ ID NO: 171573 - DNA, 2710 bp, Homo sapiens
  Payload ID: 13736
  Gene Symbol: PTP4A3
  Gene Name: protein tyrosine phosphatase type IVA, member 3
  Uniprot ID: O75365
  ENST ID: ENST00000349124
  CDS Start-End: 854-1300
atgctgtgtgctgtggacccacctggggttcatggagtgggccacggggcccagccctaagcactgctgcgcccagggtcgccgcgcctcctgctgaggggtccccgtgccactggctctcaccattgccctcgcctgccgatggcctctgctgcccagcctggggccagctctaccgcctgagccccctgccccactccaggactcaccgtaccccgatggggtaacgtgacacaggccccacacgtcagaggccgctgtccccacggccactgcccgtgacccctggcccaaggcagctggagttggttcagttcaagttcattcttcctctggcccttgggggcttggggcccacctctgagtgaagggggctgtctgcccatccaccaatgtggagagggcgcccccggtgtggggtccagctctggacactgcttggcggccgggttcactttgagtttttaagttttctttgctgagcttttttggttgttctttttattttttgcctctttatgactatccagctctgagagacgggagtttggagttgcccgctttactttggttgggttggggggggcggcgggctgttttgttccttttcttttttaagagttgggttttcttttttaattatccaaacagtgggcagcttcctcccccacacccaagtatttgcacaatatttgtgcggggtatgggggtgggtttttaaatctcgtttctcttggacaagcacagggatctcgttctcctcattttttgggggtgtgtggggacttctcaggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgaggacctgaagaagtacggggctaccactgtggtgcgtgtgtgtgaagtgacctatgacaaaacgccgctggagaaggatggcatcaccgttgtggactggccgtttgacgatggggcgcccccgcccggcaaggtagtggaagactggctgagcctggtgaaggccaagttctgtgaggcccccggcagctgcgtggctgtgcactgcgtggcgggcctgggccggaagcgccgcggagccatcaacagcaagcagctcacctacctggagaaataccggcccaaacagaggctgcggttcaaagacccacacacgcacaagacccggtgctgcgttatgtagctcaggaccttggctgggcctggtcgtcatgtaggtcaggaccttggctggacctggaggccctgcccagccctgctctgcccagcccagcaggggctccaggccttggctggccccacatcgccttttcctccccgacacctccgtgcacttgtgtccgaggagcgaggagcccctcgggccctgggtggcctctgggccctttctcctgtctccgccactccctctggcggcgctggccgtggctctgtctctctgaggtgggtcgggcgccctctgcccgccccctcccacaccagccaggctggtctcctctagcctgtttgttgtggggtgggggtatattttgtaaccactgggcccccagcccctcttttgcgaccccttgtcctgacctgttctcggcaccttaaattattagaccccggggcagtcaggtgctccggacacccgaaggcaataaaacaggagccgtggccgtgtgtgtggagtgggctacagcgtcaggcggggcgggctggtggcctgggggccccagaggctgctgtctggatcctgggctggtgcccaggatggggctcccgcgtgctcttgcgctgccctctggtggccgctctgggtccttgcaccccgacccaggggccagcctgccctgtcctgtcctgataccgaggtgggagccctgccttggccagggtggccgtgttgacggttcttgggactgtgacattggaaggcgaggcaggtcaccagcactgtcctctgcaggatgggctgggattcatttggcagcttctcagggcctgtgtccggctggttggtccctgtgctgcccaaaccaggtgtccacatttccggctccgaggcgcagagaagggggcaggtggtggcttgggtggaggaagtcaccatccatcagcccagggagggagggtgccacctgggcacctggggctggatgtgagaggcctggaccagggcccgccggagggcgtggaccagatgctcatgtgttcctgggtgcagtgtctgtgttgggggctggccccaccctgggccggggtgcatggagggcatggccccagcggggaggaaggtgggcctagggctggctccagggtgtggagagcctgggagtggtctccgtcctggggccccaggaggttcccgcaaggagcgactggggcaggtgctggaggaggtcagtggacaagatggggagatgtggaaaccccaaaagccccttctcaggcagccctgcccccaagaccgacagatggctaagggggccgcagacctggctcccccagctcctgtgtggagaaagggcaacagctgtcccggatggttattctctcctttcctcaaacacatttggaactcaagtaaatccaatgcatgttgggtgaa

SEQ ID NO: 171574 - DNA, 2785 bp, Homo sapiens
  Payload ID: 13736
  Gene Symbol: PTP4A3
  Gene Name: protein tyrosine phosphatase type IVA, member 3
  Uniprot ID: O75365
  ENST ID: ENST00000329397
  CDS Start-End: 854-1375
atgctgtgtgctgtggacccacctggggttcatggagtgggccacggggcccagccctaagcactgctgcgcccagggtcgccgcgcctcctgctgaggggtccccgtgccactggctctcaccattgccctcgcctgccgatggcctctgctgcccagcctggggccagctctaccgcctgagccccctgccccactccaggactcaccgtaccccgatggggtaacgtgacacaggccccacacgtcagaggccgctgtccccacggccactgcccgtgacccctggcccaaggcagctggagttggttcagttcaagttcattcttcctctggcccttgggggcttggggcccacctctgagtgaagggggctgtctgcccatccaccaatgtggagagggcgcccccggtgtggggtccagctctggacactgcttggcggccgggttcactttgagtttttaagttttctttgctgagcttttttggttgttctttttattttttgcctctttatgactatccagctctgagagacgggagtttggagttgcccgctttactttggttgggttggggggggcggcgggctgttttgttccttttcttttttaagagttgggttttcttttttaattatccaaacagtgggcagcttcctcccccacacccaagtatttgcacaatatttgtgcggggtatgggggtgggtttttaaatctcgtttctcttggacaagcacagggatctcgttctcctcattttttgggggtgtgtggggacttctcaggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgaggacctgaagaagtacggggctaccactgtggtgcgtgtgtgtgaagtgacctatgacaaaacgccgctggagaaggatggcatcaccgttgtggactggccgtttgacgatggggcgcccccgcccggcaaggtagtggaagactggctgagcctggtgaaggccaagttctgtgaggcccccggcagctgcgtggctgtgcactgcgtggcgggcctgggccgggctccagtccttgtggcgctggcccttattgagagcgggatgaagtacgaggacgccatccagttcatccgccagaagcgccgcggagccatcaacagcaagcagctcacctacctggagaaataccggcccaaacagaggctgcggttcaaagacccacacacgcacaagacccggtgctgcgttatgtagctcaggaccttggctgggcctggtcgtcatgtaggtcaggaccttggctggacctggaggccctgcccagccctgctctgcccagcccagcaggggctccaggccttggctggccccacatcgccttttcctccccgacacctccgtgcacttgtgtccgaggagcgaggagcccctcgggccctgggtggcctctgggccctttctcctgtctccgccactccctctggcggcgctggccgtggctctgtctctctgaggtgggtcgggcgccctctgcccgccccctcccacaccagccaggctggtctcctctagcctgtttgttgtggggtgggggtatattttgtaaccactgggcccccagcccctcttttgcgaccccttgtcctgacctgttctcggcaccttaaattattagaccccggggcagtcaggtgctccggacacccgaaggcaataaaacaggagccgtggccgtgtgtgtggagtgggctacagcgtcaggcggggcgggctggtggcctgggggccccagaggctgctgtctggatcctgggctggtgcccaggatggggctcccgcgtgctcttgcgctgccctctggtggccgctctgggtccttgcaccccgacccaggggccagcctgccctgtcctgtcctgataccgaggtgggagccctgccttggccagggtggccgtgttgacggttcttgggactgtgacattggaaggcgaggcaggtcaccagcactgtcctctgcaggatgggctgggattcatttggcagcttctcagggcctgtgtccggctggttggtccctgtgctgcccaaaccaggtgtccacatttccggctccgaggcgcagagaagggggcaggtggtggcttgggtggaggaagtcaccatccatcagcccagggagggagggtgccacctgggcacctggggctggatgtgagaggcctggaccagggcccgccggagggcgtggaccagatgctcatgtgttcctgggtgcagtgtctgtgttgggggctggccccaccctgggccggggtgcatggagggcatggccccagcggggaggaaggtgggcctagggctggctccagggtgtggagagcctgggagtggtctccgtcctggggccccaggaggttcccgcaaggagcgactggggcaggtgctggaggaggtcagtggacaagatggggagatgtggaaaccccaaaagccccttctcaggcagccctgcccccaagaccgacagatggctaagggggccgcagacctggctcccccagctcctgtgtggagaaagggcaacagctgtcccggatggttattctctcctttcctcaaacacatttggaactcaagtaaatccaatgcatgttgggtgaa

SEQ ID NO: 171575 - DNA, 558 bp, Homo sapiens
  Payload ID: 13736
  Gene Symbol: PTP4A3
  Gene Name: protein tyrosine phosphatase type IVA, member 3
  ENST ID: ENST00000523147
  CDS Start-End: 348-558
gtgcgcgagggcgcgcgcgtcccgagccctccacccgtcgtgccggcgccgcccggaccgccagatgctgtgtgctgtggacccacctggggttcatggagtgggccacggggcccagccctaagcactgctgcgcccagggtcgccgcgcctcctgctgaggggtccccgtgccactggctctcaccattgccctcgcctgccgatggcctctgctgcccagcctggggccagctctaccgcctgagccccctgccccactccaggactcaccgtaccccgatggggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgaggacctgaagaagtacggggctaccactgtggtgcgtgtgtgtgaagtgacctatgacaaaacgccgctggagaaggatggcatcaccgttgtggactggccgtttg

SEQ ID NO: 171576 - DNA, 1866 bp, Homo sapiens
  Payload ID: 13736
  Gene Symbol: PTP4A3
  Gene Name: protein tyrosine phosphatase type IVA, member 3
  Uniprot ID: O75365
  ENST ID: ENST00000520105
  CDS Start-End: 944-1390
aagccggtggagccgcggccgcgcctgtgcgcgagggcgcgcgcgtcccgagccctccacccgtcgtgccggcgccgcccggaccgccagatgctgtgtgctgtggacccacctggggttcatggagtgggccacggggcccagccctaagcactgctgcgcccagggtcgccgcgcctcctgctgaggggtccccgtgccactggctctcaccattgccctcgcctgccgatggcctctgctgcccagcctggggccagctctaccgcctgagccccctgccccactccaggactcaccgtaccccgatggggtaacgtgacacaggccccacacgtcagaggccgctgtccccacggccactgcccgtgacccctggcccaaggcagctggagttggttcagttcaagttcattcttcctctggcccttgggggcttggggcccacctctgagtgaagggggctgtctgcccatccaccaatgtggagagggcgcccccggtgtggggtccagctctggacactgcttggcggccgggttcactttgagtttttaagttttctttgctgagcttttttggttgttctttttattttttgcctctttatgactatccagctctgagagacgggagtttggagttgcccgctttactttggttgggttggggggggcggcgggctgttttgttccttttcttttttaagagttgggttttcttttttaattatccaaacagtgggcagcttcctcccccacacccaagtatttgcacaatatttgtgcggggtatgggggtgggtttttaaatctcgtttctcttggacaagcacagggatctcgttctcctcattttttgggggtgtgtggggacttctcaggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgaggacctgaagaagtacggggctaccactgtggtgcgtgtgtgtgaagtgacctatgacaaaacgccgctggagaaggatggcatcaccgttgtggactggccgtttgacgatggggcgcccccgcccggcaaggtagtggaagactggctgagcctggtgaaggccaagttctgtgaggcccccggcagctgcgtggctgtgcactgcgtggcgggcctgggccggaagcgccgcggagccatcaacagcaagcagctcacctacctggagaaataccggcccaaacagaggctgcggttcaaagacccacacacgcacaagacccggtgctgcgttatgtagctcaggaccttggctgggcctggtcgtcatgtaggtcaggaccttggctggacctggaggccctgcccagccctgctctgcccagcccagcaggggctccaggccttggctggccccacatcgccttttcctccccgacacctccgtgcacttgtgtccgaggagcgaggagcccctcgggccctgggtggcctctgggccctttctcctgtctccgccactccctctggcggcgctggccgtggctctgtctctctgaggtgggtcgggcgccctctgcccgccccctcccacaccagccaggctggtctcctctagcctgtttgttgtggggtgggggtatattttgtaaccactgggcccccagcccctcttttgcgaccccttgtcctgacctgttctcggcaccttaaattattagaccccggggcagtcaggtgctccggacacccgaaggcaataaaacaggagccgtg

SEQ ID NO: 171577 - DNA, 1717 bp, Homo sapiens
  Payload ID: 13736
  Gene Symbol: PTP4A3
  Gene Name: protein tyrosine phosphatase type IVA, member 3
  Uniprot ID: O75365
  ENST ID: ENST00000521578
  CDS Start-End: 946-1467
ctaagccggtggagccgcggccgcgcctgtgcgcgagggcgcgcgcgtcccgagccctccacccgtcgtgccggcgccgcccggaccgccagatgctgtgtgctgtggacccacctggggttcatggagtgggccacggggcccagccctaagcactgctgcgcccagggtcgccgcgcctcctgctgaggggtccccgtgccactggctctcaccattgccctcgcctgccgatggcctctgctgcccagcctggggccagctctaccgcctgagccccctgccccactccaggactcaccgtaccccgatggggtaacgtgacacaggccccacacgtcagaggccgctgtccccacggccactgcccgtgacccctggcccaaggcagctggagttggttcagttcaagttcattcttcctctggcccttgggggcttggggcccacctctgagtgaagggggctgtctgcccatccaccaatgtggagagggcgcccccggtgtggggtccagctctggacactgcttggcggccgggttcactttgagtttttaagttttctttgctgagcttttttggttgttctttttattttttgcctctttatgactatccagctctgagagacgggagtttggagttgcccgctttactttggttgggttggggggggcggcgggctgttttgttccttttcttttttaagagttgggttttcttttttaattatccaaacagtgggcagcttcctcccccacacccaagtatttgcacaatatttgtgcggggtatgggggtgggtttttaaatctcgtttctcttggacaagcacagggatctcgttctcctcattttttgggggtgtgtggggacttctcaggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgaggacctgaagaagtacggggctaccactgtggtgcgtgtgtgtgaagtgacctatgacaaaacgccgctggagaaggatggcatcaccgttgtggactggccgtttgacgatggggcgcccccgcccggcaaggtagtggaagactggctgagcctggtgaaggccaagttctgtgaggcccccggcagctgcgtggctgtgcactgcgtggcgggcctgggccgggctccagtccttgtggcgctggcccttattgagagcgggatgaagtacgaggacgccatccagttcatccgccagaagcgccgcggagccatcaacagcaagcagctcacctacctggagaaataccggcccaaacagaggctgcggttcaaagacccacacacgcacaagacccggtgctgcgttatgtagctcaggaccttggctgggcctggtcgtcatgtaggtcaggaccttggctggacctggaggccctgcccagccctgctctgcccagcccagcaggggctccaggccttggctggccccacatcgccttttcctccccgacacctccgtgcacttgtgtccgaggagcgaggagcccctcgggccctgggtggcctctgggccctttctcctgtctccgccactccctctggcggcgctggccgtggctctg

SEQ ID NO: 171578 - DNA, 963 bp, Homo sapiens
  Payload ID: 13736
  Gene Symbol: PTP4A3
  Gene Name: protein tyrosine phosphatase type IVA, member 3
  ENST ID: ENST00000524028
  CDS Start-End: 224-487
cttttttaattatccaaacagtgggcagcttcctcccccacacccaagtatttgcacaatatttgtgcggggtatgggggtgggtttttaaatctcgtttctcttggacaagcacagggatctcgttctcctcattttttgggggtgtgtggggacttctcaggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgagagcgggatgaagtacgaggacgccatccagttcatccgccagaagcgccgcggagccatcaacagcaagcagctcacctacctggagaaataccggcccaaacagaggctgcggttcaaagacccacacacgcacaagacccggtgctgcgttatgtagctcaggaccttggctgggcctggtcgtcatgtaggtcaggaccttggctggacctggaggccctgcccagccctgctctgcccagcccagcaggggctccaggccttggctggccccacatcgccttttcctccccgacacctccgtgcacttgtgtccgaggagcgaggagcccctcgggccctgggtggcctctgggccctttctcctgtctccgccactccctctggcggcgctggccgtggctctgtctctctgaggtgggtcgggcgccctctgcccgccccctcccacaccagccaggctggtctcctctagcctgtttgttgtggggtgggggtatattttgtaaccactgggcccccagcccctcttttgcgaccccttgtcctgacctgttctcggcaccttaaattattagaccccggggcagtcaggtgctccggacacccgaaggcaataaaacaggagccgtg

SEQ ID NO: 171579 - DNA, 2710 bp, Homo sapiens; identical to SEQ ID NO: 171573
  Payload ID: 13736
  Gene Symbol: PTP4A3
  Gene Name: protein tyrosine phosphatase type IVA, member 3
  Uniprot ID: O75365
  ENST ID: ENST00000614325
  CDS Start-End: 854-1300

SEQ ID NO: 171580 - DNA, 2785 bp, Homo sapiens; identical to SEQ ID NO: 171574
  Payload ID: 13736
  Gene Symbol: PTP4A3
  Gene Name: protein tyrosine phosphatase type IVA, member 3
  Uniprot ID: O75365
  ENST ID: ENST00000622569
  CDS Start-End: 854-1375

SEQ ID NO: 171581 - DNA, 1717 bp, Homo sapiens; identical to SEQ ID NO: 171577
  Payload ID: 13736
  Gene Symbol: PTP4A3
  Gene Name: protein tyrosine phosphatase type IVA, member 3
  Uniprot ID: O75365
  ENST ID: ENST00000633518
  CDS Start-End: 946-1467

SEQ ID NO: 171582 - DNA, 1866 bp, Homo sapiens; identical to SEQ ID NO: 171576
  Payload ID: 13736
  Gene Symbol: PTP4A3
  Gene Name: protein tyrosine phosphatase type IVA, member 3
  Uniprot ID: O75365
  ENST ID: ENST00000633621
  CDS Start-End: 944-1390

SEQ ID NO: 171583 - DNA, 558 bp, Homo sapiens; identical to SEQ ID NO: 171575
  Payload ID: 13736
  Gene Symbol: PTP4A3
  Gene Name: protein tyrosine phosphatase type IVA, member 3
  ENST ID: ENST00000633262
  CDS Start-End: 348-558

SEQ ID NO: 171584 - DNA, 928 bp, Homo sapiens
  Payload ID: 13737
  Gene Symbol: PTPMT1
  Gene Name: protein tyrosine phosphatase, mitochondrial 1
  Uniprot ID: Q8WUK0
  ENST ID: ENST00000326656
  CDS Start-End: 25-438
gggtcgccgctgcgccgggccgggatggcggccaccgcgctgctggaggccggcctggcgcgggtgctcttctacccgacgctgctctacaccctgttccgcgggaaggtgccgggtcgggcgcaccgggactggtaccaccgcatcgaccccaccgtgctgctgggcgcgctgccgttgcggagcttgacgcgccagctggtacaggacgagaacgtgcgcggggtgatcaccatgaacgaggagtacgagacgaggttcctgtgcaactcttcacaggtgcacaaatggagtccagaggaggctgtaagagccatcgccaagatccggtcatacatccacatcaggcctggccagctggatgttcttaaagagttccacaagcagattactgcacgggcaacaaaggatgggacttttgtcatttcaaagacatgatgtatggggattagaaagaactcaagacactcctgcttgatacagaacaaaaagagcttaacaggaccaacagggcttaagcccagacttgacgtaacagaaatgtgccaataggtaataggtaatttttctttctctgacttgttttgttttcttgaaataacactgttgtgtggctagaaaggaaaagatttagtgtggcttgtattcatgggatacaggacagggatggggctatcatcttttcttgaatagggctaaagaagtattttaacaaaaatctattatgtacctaatattgtgcctaataatatttagcaccacaactcaaaaaacatttagcacttgaaaaaaggagactcacctctggctctttgccactgtcagaatctgaatctcactggccctgtggagtagggatcctatctggagaagtgggagcatgggctgcagtcaggactgctgcagactgagccatgtgatggtacgt

SEQ ID NO: 171585 - DNA, 768 bp, Homo sapiens
  Payload ID: 13737
  Gene Symbol: PTPMT1
  Gene Name: protein tyrosine phosphatase, mitochondrial 1
  Uniprot ID: Q8WUK0
  ENST ID: ENST00000326674
  CDS Start-End: 23-628
gtcgccgctgcgccgggccgggatggcggccaccgcgctgctggaggccggcctggcgcgggtgctcttctacccgacgctgctctacaccctgttccgcgggaaggtgccgggtcgggcgcaccgggactggtaccaccgcatcgaccccaccgtgctgctgggcgcgctgccgttgcggagcttgacgcgccagctggtacaggacgagaacgtgcgcggggtgatcaccatgaacgaggagtacgagacgaggttcctgtgcaactcttcacaggagtggaagagactaggagtcgagcagctgcggctcagcacagtagacatgactgggatccccaccttggacaacctccagaagggagtccaatttgctctcaagtaccagtcgctgggccagtgtgtttacgtgcattgtaaggctgggcgctccaggagtgccactatggtggcagcatacctgattcaggtgcacaaatggagtccagaggaggctgtaagagccatcgccaagatccggtcatacatccacatcaggcctggccagctggatgttcttaaagagttccacaagcagattactgcacgggcaacaaaggatgggacttttgtcatttcaaagacatgatgtatggggattagaaagaactcaagacactcctgcttgatacagaacaaaaagagcttaacaggaccaacagggcttaagcccagacttgacgtaacagaaatgtgccaataggtaataggtaatttttctttctctga

SEQ ID NO: 171586 - DNA, 1014 bp, Homo sapiens
  Payload ID: 13737
  Gene Symbol: PTPMT1
  Gene Name: protein tyrosine phosphatase, mitochondrial 1
  Uniprot ID: Q8WUK0
  ENST ID: ENST00000426530
  CDS Start-End: 194-649
ctccgaggccgccgggccctcctccagagtcccgccagtcccccagagtccaggccagtccccgccgtcacccggtgcgagcccgcgagaggcctagtgcagctggcagccccgccccggcacccgcctgctcttctcgcgggtccggaccgcgagcgcgggggccgacgggtcgccgctgcgccgggccgggatggcggccaccgcgctgctggaggccggcctggcgcgggtgctcttctacccgacgctgctctacaccctgttccgcgggaaggtgccgggtcgggcgcaccgggactggtaccaccgcatcgaccccaccgtgctgctgggcgcgctgccgttgcggagcttgacgcgccaggtgagccgggccggggagcccgggcccctgccccgtccccgccgctccgtccctgtcgggccgctggggtctccaccgtctttgctgagccacctctttgcctcggcagctggtacaggacgagaacgtgcgcggggtgatcaccatgaacgaggagtacgagacgaggttcctgtgcaactcttcacaggtgcacaaatggagtccagaggaggctgtaagagccatcgccaagatccggtcatacatccacatcaggcctggccagctggatgttcttaaagagttccacaagcagattactgcacgggcaacaaaggatgggacttttgtcatttcaaagacatgatgtatggggattagaaagaactcaagacactcctgcttgatacagaacaaaaagagcttaacaggaccaacagggcttaagcccagacttgacgtaacagaaatgtgccaataggtaataggtaatttttctttctctgacttgttttgttttcttgaaataacactgttgtgtggctagaaaggaaaagatttagtgtggcttgtattcatgggatacaggacagggatggggctatcatcttttcttgaatagggctaaagaagtattttaacaaaaatctattatgtacctaata

SEQ ID NO: 171587 - DNA, 1611 bp, Homo sapiens
  Payload ID: 13737
  Gene Symbol: PTPMT1
  Gene Name: protein tyrosine phosphatase, mitochondrial 1
  ENST ID: ENST00000534775
  CDS Start-End: 166-672
gtcccgccagtcccccagagtccaggccagtccccgccgtcacccggtgcgagcccgcgagaggcctagtgcagctggcagccccgccccggcacccgcctgctcttctcgcgggtccggaccgcgagcgcgggggccgacgggtcgccgctgcgccgggccgggatggcggccaccgcgctgctggaggccggcctggcgcgggtgctcttctacccgacgctgctctacaccctgttccgcgggaaggtgccgggtcgggcgcaccgggactggtaccaccgcatcgaccccaccgtgctgctgggcgcgctgccgttgcggagcttgacgcgccaggtgagccgggccggggagcccgggcccctgccccgtccccgccgctccgtccctgtcgggccgctggggtctccaccgtctttgctgagccacctctttgcctcggcagctggtacaggacgagaacgtgcgcggggtgatcaccatgaacgaggagtacgagacgaggttcctgtgcaactcttcacaggagtggaagagactaggagtcgagcagctgcggctcagcacagtagacatgactgggatccccaccttggacaacctccagaagggagtccaatttgctctcaagtaccagtcgctgggccagtgtgtttacgtgcattgtaaggctgggcgctccaggagtgccactatggtggcagcatacctgattcaggtgcacaaatggagtccagaggaggctgtaagagccatcgccaagatccggtcatacatccacatcaggcctggccagctggatgttcttaaagagttccacaagcagattactgcacgggcaacaaaggatgggacttttgtcatttcaaagacatgatgtatggggattagaaagaactcaagacactcctgcttgatacagaacaaaaagagcttaacaggaccaacagggcttaagcccagacttgacgtaacagaaatgtgccaataggtaataggtaatttttctttctctgacttgttttgttttcttgaaataacactgttgtgtggctagaaaggaaaagatttagtgtggcttgtattcatgggatacaggacagggatggggctatcatcttttcttgaatagggctaaagaagtattttaacaaaaatctattatgtacctaatattgtgcctaataatatttagcaccacaactcaaaaaacatttagcacttgaaaaaaggagactcacctctggctctttgccactgtcagaatctgaatctcactggccctgtggagtagggatcctatctggagaagtgggagcatgggctgcagtcaggactgctgcagactgagccatgtgatggtacgtaatgagttcccctgagggaatgaaacaccctcaccccttcaaagtcacccctttggaattcaacacagacacacatatcccttcaaaaacttttatttgtatcaacagttcctagctcttgacttagcttagagcttttaaaagagcagacaccttatatatttgagattgaaaaagtttctgctattaatcagaaataatcatttctattttctggcttaccccttggaataagccaaaa

SEQ ID NO: 171588 - DNA, 4008 bp, Homo sapiens
  Payload ID: 13738
  Gene Symbol: PTPN1
  Gene Name: protein tyrosine phosphatase, non-receptor type 1
  Uniprot ID: P18031
  ENST ID: ENST00000371621
  CDS Start-End: 175-1482
gtgatgcgtagttccggctgccggttgacatgaagaagcagcagcggctagggcggcggtagctgcaggggtcggggattgcagcgggcctcggggctaagagcgcgacgcggcctagagcggcagacggcgcagtgggccgagaaggaggcgcagcagccgccctggcccgtcatggagatggaaaaggagttcgagcagatcgacaagtccgggagctgggcggccatttaccaggatatccgacatgaagccagtgacttcccatgtagagtggccaagcttcctaagaacaaaaaccgaaataggtacagagacgtcagtccctttgaccatagtcggattaaactacatcaagaagataatgactatatcaacgctagtttgataaaaatggaagaagcccaaaggagttacattcttacccagggccctttgcctaacacatgcggtcacttttgggagatggtgtgggagcagaaaagcaggggtgtcgtcatgctcaacagagtgatggagaaaggttcgttaaaatgcgcacaatactggccacaaaaagaagaaaaagagatgatctttgaagacacaaatttgaaattaacattgatctctgaagatatcaagtcatattatacagtgcgacagctagaattggaaaaccttacaacccaagaaactcgagagatcttacatttccactataccacatggcctgactttggagtccctgaatcaccagcctcattcttgaactttcttttcaaagtccgagagtcagggtcactcagcccggagcacgggcccgttgtggtgcactgcagtgcaggcatcggcaggtctggaaccttctgtctggctgatacctgcctcttgctgatggacaagaggaaagacccttcttccgttgatatcaagaaagtgctgttagaaatgaggaagtttcggatggggctgatccagacagccgaccagctgcgcttctcctacctggctgtgatcgaaggtgccaaattcatcatgggggactcttccgtgcaggatcagtggaaggagctttcccacgaggacctggagcccccacccgagcatatccccccacctccccggccacccaaacgaatcctggagccacacaatgggaaatgcagggagttcttcccaaatcaccagtgggtgaaggaagagacccaggaggataaagactgccccatcaaggaagaaaaaggaagccccttaaatgccgcaccctacggcatcgaaagcatgagtcaagacactgaagttagaagtcgggtcgtggggggaagtcttcgaggtgcccaggctgcctccccagccaaaggggagccgtcactgcccgagaaggacgaggaccatgcactgagttactggaagcccttcctggtcaacatgtgcgtggctacggtcctcacggccggcgcttacctctgctacaggttcctgttcaacagcaacacatagcctgaccctcctccactccacctccacccactgtccgcctctgcccgcagagcccacgcccgactagcaggcatgccgcggtaggtaagggccgccggaccgcgtagagagccgggccccggacggacgttggttctgcactaaaacccatcttccccggatgtgtgtctcacccctcatccttttactttttgccccttccactttgagtaccaaatccacaagccattttttgaggagagtgaaagagagtaccatgctggcggcgcagagggaaggggcctacacccgtcttggggctcgccccacccagggctccctcctggagcatcccaggcgggcggcacgccaacagccccccccttgaatctgcagggagcaactctccactccatatttatttaaacaattttttccccaaaggcatccatagtgcactagcattttcttgaaccaataatgtattaaaattttttgatgtcagccttgcatcaagggctttatcaaaaagtacaataataaatcctcaggtagtactgggaatggaaggctttgccatgggcctgctgcgtcagaccagtactgggaaggaggacggttgtaagcagttgttatttagtgatattgtgggtaacgtgagaagatagaacaatgctataatatataatgaacacgtgggtatttaataagaaacatgatgtgagattactttgtcccgcttattctcctccctgttatctgctagatctagttctcaatcactgctcccccgtgtgtattagaatgcatgtaaggtcttcttgtgtcctgatgaaaaatatgtgcttgaaatgagaaactttgatctctgcttactaatgtgccccatgtccaagtccaacctgcctgtgcatgacctgatcattacatggctgtggttcctaagcctgttgctgaagtcattgtcgctcagcaatagggtgcagttttccaggaataggcatttgcctaattcctggcatgacactctagtgacttcctggtgaggcccagcctgtcctggtacagcagggtcttgctgtaactcagacattccaagggtatgggaagccatattcacacctcacgctctggacatgatttagggaagcagggacaccccccgccccccacctttgggatcagcctccgccattccaagtcaacactcttcttgagcagaccgtgatttggaagagaggcacctgctggaaaccacacttcttgaaacagcctgggtgacggtcctttaggcagcctgccgccgtctctgtcccggttcaccttgccgagagaggcgcgtctgccccaccctcaaaccctgtggggcctgatggtgctcacgactcttcctgcaaagggaactgaagacctccacattaagtggctttttaacatgaaaaacacggcagctgtagctcccgagctactctcttgccagcattttcacattttgcctttctcgtggtagaagccagtacagagaaattctgtggtgggaacattcgaggtgtcaccctgcagagctatggtgaggtgtggataaggcttaggtgccaggctgtaagcattctgagctgggcttgttgtttttaagtcctgtatatgtatgtagtagtttgggtgtgtatatatagtagcatttcaaaatggacgtactggtttaacctcctatccttggagagcagctggctctccaccttgttacacattatgttagagaggtagcgagctgctctgctatatgccttaagccaatatttactcatcaggtcattattttttacaatggccatggaataaaccatttttacaaaaataaaaacaaaaaaagcaaggtgttttggtataataccttttcaggtgtgtgtggatacgtggctgcatgaccgggtgggtgggggggagtgtctcagggtcttctgtgacctcacagaactgtcagactgtacagttttccaacttgccatattcatgatgggtttgcattttagctgcaacaataaaatttttttctaaagaacatgaatttggggtgcttcccatttttttctttgcttaatagagctaaaccaggatgagtaactcctgtttctttctatccctgctgatgtgaaacagatgttgtcaatcagctggggttagagttttccacttctaagaattaacctcagcatccctgcattgccagcaccctcaggctggagcgctttccttgactgtgagcttgttgaacaccttaggcctcagcccatttccttcccaaattgacgctttgcctgtgtagggccctcagataacttaacaaacttaccagtgttgtttgaagaacagtgttttgagttgtaatctcaaaaccatatcccttacccaattacctgtaagacacaatggttaccacatctcagtacgtaaagtccacttgatatagaattgacttagaaataagacagattagtatagtttttcatttgtgtacaaaattaaacaatgtaaattccccccaaa

SEQ ID NO: 171589 - DNA, 3469 bp, Homo sapiens
  Payload ID: 13738
  Gene Symbol: PTPN1
  Gene Name: protein tyrosine phosphatase, non-receptor type 1
  ENST ID: ENST00000541713
  CDS Start-End: 336-1424
ccttctgcttcaggggcggagcccctggcaggcgtgatgcgtagttccggctgccggttgacatgaagaagcagcagcggctagggcggcggtagctgcaggggtcggggattgcagcgggcctcggggctaagagcgcgacgcggcctagagcggcagacggcgcagtgggccgagaaggaggcgcagcagccgccctggcccgtcatggagatggaaaaggagttcgagcagatcgacaagtccgggagctgggcggccatttaccagttgaccatagtcggattaaactacatcaagaagataatgactatatcaacgctagtttgataaaaatggaagaagcccaaaggagttacattcttacccagggccctttgcctaacacatgcggtcacttttgggagatggtgtgggagcagaaaagcaggggtgtcgtcatgctcaacagagtgatggagaaaggttcgttaaaatgcgcacaatactggccacaaaaagaagaaaaagagatgatctttgaagacacaaatttgaaattaacattgatctctgaagatatcaagtcatattatacagtgcgacagctagaattggaaaaccttacaacccaagaaactcgagagatcttacatttccactataccacatggcctgactttggagtccctgaatcaccagcctcattcttgaactttcttttcaaagtccgagagtcagggtcactcagcccggagcacgggcccgttgtggtgcactgcagtgcaggcatcggcaggtctggaaccttctgtctggctgatacctgcctcttgctgatggacaagaggaaagacccttcttccgttgatatcaagaaagtgctgttagaaatgaggaagtttcggatggggctgatccagacagccgaccagctgcgcttctcctacctggctgtgatcgaaggtgccaaattcatcatgggggactcttccgtgcaggatcagtggaaggagctttcccacgaggacctggagcccccacccgagcatatccccccacctccccggccacccaaacgaatcctggagccacacaatgggaaatgcagggagttcttcccaaatcaccagtgggtgaaggaagagacccaggaggataaagactgccccatcaaggaagaaaaaggaagccccttaaatgccgcaccctacggcatcgaaagcatgagtcaagacactgaagttagaagtcgggtcgtggggggaagtcttcgaggtgcccaggctgcctccccagccaaaggggagccgtcactgcccgagaaggacgaggaccatgcactgagttactggaagcccttcctggtcaacatgtgcgtggctacggtcctcacggccggcgcttacctctgctacaggttcctgttcaacagcaacacatagcctgaccctcctccactccacctccacccactgtccgcctctgcccgcagagcccacgcccgactagcaggcatgccgcggtaggtaagggccgccggaccgcgtagagagccgggccccggacggacgttggttctgcactaaaacccatcttccccggatgtgtgtctcacccctcatccttttactttttgccccttccactttgagtaccaaatccacaagccattttttgaggagagtgaaagagagtaccatgctggcggcgcagagggaaggggcctacacccgtcttggggctcgccccacccagggctccctcctggagcatcccaggcgggcggcacgccaacagccccccccttgaatctgcagggagcaactctccactccatatttatttaaacaattttttccccaaaggcatccatagtgcactagcattttcttgaaccaataatgtattaaaattttttgatgtcagccttgcatcaagggctttatcaaaaagtacaataataaatcctcaggtagtactgggaatggaaggctttgccatgggcctgctgcgtcagaccagtactgggaaggaggacggttgtaagcagttgttatttagtgatattgtgggtaacgtgagaagatagaacaatgctataatatataatgaacacgtgggtatttaataagaaacatgatgtgagattactttgtcccgcttattctcctccctgttatctgctagatctagttctcaatcactgctcccccgtgtgtattagaatgcatgtaaggtcttcttgtgtcctgatgaaaaatatgtgcttgaaatgagaaactttgatctctgcttactaatgtgccccatgtccaagtccaacctgcctgtgcatgacctgatcattacatggctgtggttcctaagcctgttgctgaagtcattgtcgctcagcaatagggtgcagttttccaggaataggcatttgcctaattcctggcatgacactctagtgacttcctggtgaggcccagcctgtcctggtacagcagggtcttgctgtaactcagacattccaagggtatgggaagccatattcacacctcacgctctggacatgatttagggaagcagggacaccccccgccccccacctttgggatcagcctccgccattccaagtcaacactcttcttgagcagaccgtgatttggaagagaggcacctgctggaaaccacacttcttgaaacagcctgggtgacggtcctttaggcagcctgccgccgtctctgtcccggttcaccttgccgagagaggcgcgtctgccccaccctcaaaccctgtggggcctgatggtgctcacgactcttcctgcaaagggaactgaagacctccacattaagtggctttttaacatgaaaaacacggcagctgtagctcccgagctactctcttgccagcattttcacattttgcctttctcgtggtagaagccagtacagagaaattctgtggtgggaacattcgaggtgtcaccctgcagagctatggtgaggtgtggataaggcttaggtgccaggctgtaagcattctgagctgggcttgttgtttttaagtcctgtatatgtatgtagtagtttgggtgtgtatatatagtagcatttcaaaatggacgtactggtttaacctcctatccttggagagcagctggctctccaccttgttacacattatgttagagaggtagcgagctgctctgctatatgccttaagccaatatttactcatcaggtcattattttttacaatggccatggaataaaccatttttacaaaaataaaaacaaaaaaagcaaggtgttttggtataataccttttcaggtgtgtgtggatacgtggctgcatgaccgggtgggtgggggggagtgtctcagggtcttctgtgacctcacagaactgtcagactgtacagttttccaacttgccatattcatgatgggtttgcattttagctgcaacaataaaatttttttctaaagaacatg

SEQ ID NO: 171590 - DNA, 6101 bp, Homo sapiens
  Payload ID: 13739
  Gene Symbol: PTPN11
  Gene Name: protein tyrosine phosphatase, non-receptor type 11
  Uniprot ID: Q06124
  ENST ID: ENST00000351677
  CDS Start-End: 199-1980
ggaggagcgagccgggccggggggcagctgcacagtctccgggatccccaggcctggaggggggtctgtgcgcggccggctggctctgccccgcgtccggtcccgagcgggcctccctcgggccagcccgatgtgaccgagcccagcggagcctgagcaaggagcgggtccgtcgcggagccggagggcgggaggaacatgacatcgcggagatggtttcacccaaatatcactggtgtggaggcagaaaacctactgttgacaagaggagttgatggcagttttttggcaaggcctagtaaaagtaaccctggagacttcacactttccgttagaagaaatggagctgtcacccacatcaagattcagaacactggtgattactatgacctgtatggaggggagaaatttgccactttggctgagttggtccagtattacatggaacatcacgggcaattaaaagagaagaatggagatgtcattgagcttaaatatcctctgaactgtgcagatcctacctctgaaaggtggtttcatggacatctctctgggaaagaagcagagaaattattaactgaaaaaggaaaacatggtagttttcttgtacgagagagccagagccaccctggagattttgttctttctgtgcgcactggtgatgacaaaggggagagcaatgacggcaagtctaaagtgacccatgttatgattcgctgtcaggaactgaaatacgacgttggtggaggagaacggtttgattctttgacagatcttgtggaacattataagaagaatcctatggtggaaacattgggtacagtactacaactcaagcagccccttaacacgactcgtataaatgctgctgaaatagaaagcagagttcgagaactaagcaaattagctgagaccacagataaagtcaaacaaggcttttgggaagaatttgagacactacaacaacaggagtgcaaacttctctacagccgaaaagagggtcaaaggcaagaaaacaaaaacaaaaatagatataaaaacatcctgccctttgatcataccagggttgtcctacacgatggtgatcccaatgagcctgtttcagattacatcaatgcaaatatcatcatgcctgaatttgaaaccaagtgcaacaattcaaagcccaaaaagagttacattgccacacaaggctgcctgcaaaacacggtgaatgacttttggcggatggtgttccaagaaaactcccgagtgattgtcatgacaacgaaagaagtggagagaggaaagagtaaatgtgtcaaatactggcctgatgagtatgctctaaaagaatatggcgtcatgcgtgttaggaacgtcaaagaaagcgccgctcatgactatacgctaagagaacttaaactttcaaaggttggacaagggaatacggagagaacggtctggcaataccactttcggacctggccggaccacggcgtgcccagcgaccctgggggcgtgctggacttcctggaggaggtgcaccataagcaggagagcatcatggatgcagggccggtcgtggtgcactgcagtgctggaattggccggacagggacgttcattgtgattgatattcttattgacatcatcagagagaaaggtgttgactgcgatattgacgttcccaaaaccatccagatggtgcggtctcagaggtcagggatggtccagacagaagcacagtaccgatttatctatatggcggtccagcattatattgaaacactacagcgcaggattgaagaagagcagaaaagcaagaggaaagggcacgaatatacaaatattaagtattctctagcggaccagacgagtggagatcagagccctctcccgccttgtactccaacgccaccctgtgcagaaatgagagaagacagtgctagagtctatgaaaacgtgggcctgatgcaacagcagaaaagtttcagatgagaaaacctgccaaaacttcagcacagaaatagatgtggactttcaccctctccctaaaaagatcaagaacagacgcaagaaagtttatgtgaagacagaatttggatttggaaggcttgcaatgtggttgactaccttttgataagcaaaatttgaaaccatttaaagaccactgtattttaactcaacaatacctgcttcccaattactcatttcctcagataagaagaaatcatctctacaatgtagacaacattatattttatagaatttgtttgaaattgaggaagcagttaaattgtgcgctgtattttgcagattatggggattcaaattctagtaataggcttttttatttttatttttatacccttaaccagtttaattttttttttcctcattgttggggatgatgagaagaaatgatttgggaaaattaagtaacaacgacctagaaaagtgagaacaatctcatttaccatcatgtatccagtagtggataattcattttgatggcttctatttttggccaaatgagaattaagccagtgcctgagactgtcagaagttgacctttgcactggcattaaagagtcatagaaaaagaatcatggatatttatgaattaaggtaagaggtgtggcttttttttttttcttttttccagccgttgaccaattatagttcggctgttgactgagaagtttgtggtgggaaaacgtttgccatattttctttgcatttgaataattgtcttgtacttagaaaaaaggcgtctatgaatgaccagtgtttttggtcgccaaatgttgctgacaaacttatcccaaaactttagtggcttaaaaaaacctgcccccaactgttagtcaatctgagctgggctcagctgggctgttcttctgccagcctgcaggtggccactcatgtggtcagcaggtcggcggagagactgggatggctgggcttctctctctgcctgcagtcctgagtctctccttcttcgtgtagtctctttcagtggcctggctggcagggtagctagacctctcacatgcagctcagagctcccaagagctcaaaagcagaaatggccaggccttctgaaaacttaagtccagaattgtcacagtgtcccttctacttccctctattgatgatgatgatgatgatgatgatgatgatgatgatgatgatgatggttttttctaatcagaagaaagctggggtatgccctctacttactaaacaagtcacaagcccagctcagattcaagaaaagggtgtgaagtagaggtgcagttaagtggggggccactagtctaacagacggtcacaaccagtgccatggaaaaccaaggatattagcaaaagcagaagttgctagtgaccttgggaagccgaagctgcttacagtagctgggacaagctgaaagtcagactaagaaataaagagagggccttcaagaagcttcctgaatgatttctgctagccctgagcctatttttggaaccagcacttggggaaactgatcttgtgaggatggatgtgtttagggacacagggcttttgagagcagcaccaccccactggggcatccccagacttgggaaacgtgactctttcttaatgccactgggttttagtcaggccacagtgagaaggaacagccctaacaggcctccagccaggttgaatgagctcatttttgttgtagccaaccagtaagatttgctaatgttctacattaagtgccttctccaaagacatccctctttgcctcatatgttgaatcatccagtgcggatatttcaatgaaaatatcattggttgacttttgtgatggtaataatgctatggcatctttgccatgaagttgtggcctccttggattcttctgactttggcttctgaaaggaaggcctagatccagccctggtggtagttcctttctgaggtctctcagtcccttgagactttggggtagtttggctgccattctcactgacaaaatgtatatcagcccccacctccaccccccaatattccttgaactttgaattgcttcagaacacaggtgtggcctgaaggtattcccttattagggaagtgtcactgctgtcttctagtcaaacttgtaaagaaaaagattccagttcagtatttgcagcaagaagcttgaatgctgttctttttatcgcattgttacatcgactcattctccattttgctttggttttgtcttgacttgacttgactttgggggtaaagtctttcaccagcacacaagagtttgattgtacaaatatatcttctgcattaacatctctgcctgttgcttaagatcagttgcttttatactcagaatggaaatacctgatcttggctagttttgttataagatattgatttcatttagatttccctccacgaggtcagcaaactatcatgttcttatgtaaacttaggccaaggccagagttatcatagtccctaggttgctacggcttatcatgtgcttggtaaaaggtgatcgcaggttctcagacgagtttactttacatgagatggaatcaggcagagaggctgggatgatggagaaagctcgaggtgaagttttaaaaaaaaagttgtggaaaggaaagttccaaagaggtggtttctgaggaagtcagagcgcccagggccagagcagtcagtaatgggtgaatgaggttgtttggaaagtcggtgtgacagacacatggatgccatctacttctaggttgctggtgggtattaaatatgcacaatattccatagctcactgaggattttaaaattataagcataggattttatattttggggtgaaagaattatctggcacattaggtattggagtttaaaaaaaaagccaaatttcacagtcttaataactttttttaaaaaaaactaaaaggcgcttcatgtccagtgtgtggcccttctgaaacttatggtcatctctcccactgaaaccaaggtcttttcaaatgtggctaaatggggatgaggagacacgggtaggactttcttggtgtgtgtgcattctttaaagagccaagttgcttcggggaaacagccaggaaaatggtcaagattatttttagaggttattttattggggattttaagaactaataacatcttgagttatttttaattcagggggatgtggaaaggtttgcaattgtcaagtgttttgttgtagcttagtatccataagggaaacttagactatagacataactacaaagccagtgcagcttttgttttctgtatgttgttgggggatcaactttcacacatagcaagcacatggcctccctgatgtcaggatgcctttgttaggatctgtatttgcccttaattttgttgaaatcttttttccttcttcctcttgaaaagttccaaaatatagtttattgtatctttcatcactaaaaatttgttcctttttcactatgggcagttcacacaaggcaaaaactattgaacagttggttttagtgtgttgtataactttgctgtatatcaaactaattttgacaagttttcatcctaagcctcaaatcatgtaattaataatttgcctgtttatttatgacctaattgtgattcttttattaataaaagctaatgggaaaaggatccctgattaagctgatgactagacctacaattaattttcctgcagtatatgaagtattgtaccagagtattaaaagatatgtaatattttattgataaatctatcctttaaaaggaatacgttttaggatgtcatcattttgatgtgaatcatgtaaatgttgataatatgctgtttattatacatttagtgtttcaagagattcacttaattgcctttttgcccacgtatattatgtagtctatttgcaactgttcttaaaaaaatgacattaaaagaatagtttatgtagagaaacattagtggatgttaattgtctccccacctatatttatgggtgttagcgcaactgctttgctagttgcaaagctgtattatcagagtaaaagtgtatttgtaaactgtatgggaactaaaaattaggaataaaaccattttcttatatga

SEQ ID NO: 171591 - DNA, 1876 bp, Homo sapiens
  Payload ID: 13739
  Gene Symbol: PTPN11
  Gene Name: protein tyrosine phosphatase, non-receptor type 11
  Uniprot ID: Q06124
  ENST ID: ENST00000392597
  CDS Start-End: 204-1586
gcggaggaggagcgagccgggccggggggcagctgcacagtctccgggatccccaggcctggaggggggtctgtgcgcggccggctggctctgccccgcgtccggtcccgagcgggcctccctcgggccagcccgatgtgaccgagcccagcggagcctgagcaaggagcgggtccgtcgcggagccggagggcgggaggaacatgacatcgcggagatggtttcacccaaatatcactggtgtggaggcagaaaacctactgttgacaagaggagttgatggcagttttttggcaaggcctagtaaaagtaaccctggagacttcacactttccgttagaagaaatggagctgtcacccacatcaagattcagaacactggtgattactatgacctgtatggaggggagaaatttgccactttggctgagttggtccagtattacatggaacatcacgggcaattaaaagagaagaatggagatgtcattgagcttaaatatcctctgaactgtgcagatcctacctctgaaaggtggtttcatggacatctctctgggaaagaagcagagaaattattaactgaaaaaggaaaacatggtagttttcttgtacgagagagccagagccaccctggagattttgttctttctgtgcgcactggtgatgacaaaggggagagcaatgacggcaagtctaaagtgacccatgttatgattcgctgtcaggaactgaaatacgacgttggtggaggagaacggtttgattctttgacagatcttgtggaacattataagaagaatcctatggtggaaacattgggtacagtactacaactcaagcagccccttaacacgactcgtataaatgctgctgaaatagaaagcagagttcgagaactaagcaaattagctgagaccacagataaagtcaaacaaggcttttgggaagaatttgagacactacaacaacaggagtgcaaacttctctacagccgaaaagagggtcaaaggcaagaaaacaaaaacaaaaatagatataaaaacatcctgccctttgatcataccagggttgtcctacacgatggtgatcccaatgagcctgtttcagattacatcaatgcaaatatcatcatgcctgaatttgaaaccaagtgcaacaattcaaagcccaaaaagagttacattgccacacaaggctgcctgcaaaacacggtgaatgacttttggcggatggtgttccaagaaaactcccgagtgattgtcatgacaacgaaagaagtggagagaggaaagagtaaatgtgtcaaatactggcctgatgagtatgctctaaaagaatatggcgtcatgcgtgttaggaacgtcaaagaaagcgccgctcatgactatacgctaagagaacttaaactttcaaaggttggacaagggaatacggagagaacggtctggcaataccactttcggacctggccggaccacggcgtgcccagcgaccctgggggcgtgctggacttcctggaggaggtgcaccataagcaggagagcatcatggatgcagggccggtcgtggtgcactgcaggtgacagctcctgctgcccctctaggccacagcctgtccctgtctcctagcgcccagggcttgcttttacctacccactcctagctctttaactgtaggaagaatttaatatctgtttgaggcatagagcaactgcattgagggacattttgatcccaaggcatatttctcctagaccctacagcactgccattggccatggccatggcaacatgctcagttaaaacagcaaagactaagtcagcattatctctgagtccaccagaagttgtgcattaaacaacttcatcctgg

SEQ ID NO: 171592 - DNA, 486 bp, Homo sapiens
  Payload ID: 13739
  Gene Symbol: PTPN11
  Gene Name: protein tyrosine phosphatase, non-receptor type 11
  ENST ID: ENST00000530818
  CDS Start-End: 1-326
acaaaggggagagcaatgacggcaagtctaaagtgacccatgttatgattcgctgtcaggaactgaaatacgacgttggtggaggagaacggtttgattctttgacagatcttgtggaacattataagaagaatcctatggtggaaacattgggtacagtactacaactcaagcagccccttaacacgactcgtataaatgctgctgaaatagaaagcagagttcgagaactaagcaaattagctgagaccacagataaagtcaaacaaggcttttgggaagaatttgagtttgctgagaatgatggtttccagcttcatccatgaccctgcaaaggacatgaactcattctttttttatggctgcatagtattccatggtgtgtatgtgccacattttctttatccggtctatcattgatgggcatttgggttggttccaagtctttgctattgtaaatagtgctgcaataaacatatgtgtgca

SEQ ID NO: 171593 - DNA, 588 bp, Homo sapiens
  Payload ID: 13739
  Gene Symbol: PTPN11
  Gene Name: protein tyrosine phosphatase, non-receptor type 11
  ENST ID: ENST00000635652
  CDS Start-End: 1-588
acggtgaatgacttttggcggatggtgttccaagaaaactcccgagtgattgtcatgacaacgaaagaagtggagagaggaaagagtaaatgtgtcaaatactggcctgatgagtatgctctaaaagaatatggcgtcatgcgtgttaggaacgtcaaagaaagcgccgctcatgactatacgctaagagaacttaaactttcaaaggttggacaatttttcttggctctactccaggggaatacggagagaacggtctggcaataccactttcggacctggccggaccacggcgtgcccagcgaccctgggggcgtgctggacttcctggaggaggtgcaccataagcaggagagcatcatggatgcagggccggtcgtggtgcactgcagtgctggaattggccggacagggacgttcattgtgattgatattcttattgacatcatcagagagaaaggtgttgactgcgatattgacgttcccaaaaccatccagatggtgcggtctcagaggtcagggatggtccagacagaagcacagtaccgatttatctatatggcggtccagcattatattgaaacacta

SEQ ID NO: 171594 - DNA, 1794 bp, Homo sapiens
  Payload ID: 13739
  Gene Symbol: PTPN11
  Gene Name: protein tyrosine phosphatase, non-receptor type 11
  ENST ID: ENST00000635625
  CDS Start-End: 1-1794
atgacatcgcggagatggtttcacccaaatatcactggtgtggaggcagaaaacctactgttgacaagaggagttgatggcagttttttggcaaggcctagtaaaagtaaccctggagacttcacactttccgttagaagaaatggagctgtcacccacatcaagattcagaacactggtgattactatgacctgtatggaggggagaaatttgccactttggctgagttggtccagtattacatggaacatcacgggcaattaaaagagaagaatggagatgtcattgagcttaaatatcctctgaactgtgcagatcctacctctgaaaggtggtttcatggacatctctctgggaaagaagcagagaaattattaactgaaaaaggaaaacatggtagttttcttgtacgagagagccagagccaccctggagattttgttctttctgtgcgcactggtgatgacaaaggggagagcaatgacggcaagtctaaagtgacccatgttatgattcgctgtcaggaactgaaatacgacgttggtggaggagaacggtttgattctttgacagatcttgtggaacattataagaagaatcctatggtggaaacattgggtacagtactacaactcaagcagccccttaacacgactcgtataaatgctgctgaaatagaaagcagagttcgagaactaagcaaattagctgagaccacagataaagtcaaacaaggcttttgggaagaatttgagacactacaacaacaggagtgcaaacttctctacagccgaaaagagggtcaaaggcaagaaaacaaaaacaaaaatagatataaaaacatcctgccctttgatcataccagggttgtcctacacgatggtgatcccaatgagcctgtttcagattacatcaatgcaaatatcatcatgcctgaatttgaaaccaagtgcaacaattcaaagcccaaaaagagttacattgccacacaaggctgcctgcaaaacacggtgaatgacttttggcggatggtgttccaagaaaactcccgagtgattgtcatgacaacgaaagaagtggagagaggaaagagtaaatgtgtcaaatactggcctgatgagtatgctctaaaagaatatggcgtcatgcgtgttaggaacgtcaaagaaagcgccgctcatgactatacgctaagagaacttaaactttcaaaggttggacaagctctactccaggggaatacggagagaacggtctggcaataccactttcggacctggccggaccacggcgtgcccagcgaccctgggggcgtgctggacttcctggaggaggtgcaccataagcaggagagcatcatggatgcagggccggtcgtggtgcactgcagtgctggaattggccggacagggacgttcattgtgattgatattcttattgacatcatcagagagaaaggtgttgactgcgatattgacgttcccaaaaccatccagatggtgcggtctcagaggtcagggatggtccagacagaagcacagtaccgatttatctatatggcggtccagcattatattgaaacactacagcgcaggattgaagaagagcagaaaagcaagaggaaagggcacgaatatacaaatattaagtattctctagcggaccagacgagtggagatcagagccctctcccgccttgtactccaacgccaccctgtgcagaaatgagagaagacagtgctagagtctatgaaaacgtgggcctgatgcaacagcagaaaagtttcagatga

SEQ ID NO: 171595 - DNA, 3406 bp, Homo sapiens
  Payload ID: 13740
  Gene Symbol: PTPN12
  Gene Name: protein tyrosine phosphatase, non-receptor type 12
  Uniprot ID: Q05209
  ENST ID: ENST00000248594
  CDS Start-End: 273-2615
agctgggggttggggttggcgctagcgcagcggctcgcctggtactgtgggagagcggcggctgctcctggaagttgtggtgtcgggagcccagccggtgccgccgcagccgccgcctagggcggtggggaggaggagggagccgcggggcttggcggggtcgggagggagggacgtgctgggggaacgagctggggaagacggagcgggctctgtgccgggcgggcgggcggcgggggggccagcgaccgcagccggggggacgcgggaggatggagcaagtggagatcctgaggaaattcatccagagggtccaggccatgaagagtcctgaccacaatggggaggacaacttcgcccgggacttcatgcggttaagaagattgtctaccaaatatagaacagaaaagatatatcccacagccactggagaaaaagaagaaaatgttaaaaagaacagatacaaggacatactgccatttgatcacagccgagttaaattgacattaaagactccttcacaagattcagactatatcaatgcaaattttataaagggcgtctatgggccaaaagcatatgtagcaactcaaggacctttagcaaatacagtaatagatttttggaggatgatatgggagtataatgttgtgatcattgtaatggcctgccgagaatttgagatgggaaggaaaaaatgtgagcgctattggcctttgtatggagaagaccccataacgtttgcaccatttaaaatttcttgtgaggatgaacaagcaagaacagactacttcatcaggacactcttacttgaatttcaaaatgaatctcgtaggctgtatcagtttcattatgtgaactggccagaccatgatgttccttcatcatttgattctattctggacatgataagcttaatgaggaaatatcaagaacatgaagatgttcctatttgtattcattgcagtgcaggctgtggaagaacaggtgccatttgtgccatagattatacgtggaatttactaaaagctgggaaaataccagaggaatttaatgtatttaatttaatacaagaaatgagaacacaaaggcattctgcagtacaaacaaaggagcaatatgaacttgttcatagagctattgcccaactgtttgaaaaacagctacaactatatgaaattcatggagctcagaaaattgctgatggagtgaatgaaattaacactgaaaacatggtcagctccatagagcctgaaaaacaagattctcctcctccaaaaccaccaaggacccgcagttgccttgttgaaggggatgctaaagaagaaatactgcagccaccggaacctcatccagtgccacccatcttgacaccttctcccccttcagcttttccaacagtcactactgtgtggcaggacaatgatagataccatccaaagccagtgttgcatatggtttcatcagaacaacattcagcagacctcaacagaaactatagtaaatcaacagaacttccagggaaaaatgaatcaacaattgaacagatagataaaaaattggaacgaaatttaagttttgagattaagaaggtccctctccaagagggaccaaaaagttttgatgggaacacacttttgaataggggacatgcaattaaaattaaatctgcttcaccttgtatagctgataaaatctctaagccacaggaattaagttcagatctaaatgtcggtgatacttcccagaattcttgtgtggactgcagtgtaacacaatcaaacaaagtttcagttactccaccagaagaatcccagaattcagacacacctccaaggccagaccgcttgcctcttgatgagaaaggacatgtaacgtggtcatttcatggacctgaaaatgccatacccatacctgatttatctgaaggcaattcctcagatatcaactatcaaactaggaaaactgtgagtttaacaccaagtcctacaacacaagttgaaacacctgatcttgtggatcatgataacacttcaccactcttcagaacacccctcagttttactaatccacttcactctgatgactcagactcagatgaaagaaactctgatggtgctgtgacccagaataaaactaatatttcaacagcaagtgccacagtttctgctgccactagtactgaaagcatttctactaggaaagtattgccaatgtccattgctagacataatatagcaggaacaacacattcaggtgctgaaaaagatgttgatgttagtgaagattcacctcctcccctacctgaaagaactcctgaatcgtttgtgttagcaagtgaacataatacacctgtaagatcggaatggagtgaacttcaaagtcaggaacgatctgaacaaaaaaagtctgaaggcttgataacctctgaaaatgagaaatgtgatcatccagcgggaggtattcactatgaaatgtgcatagaatgtccacctactttcagtgacaagagagaacaaatatcagaaaatccaacagaagccacagatattggttttggtaatcgatgtggaaaacccaaaggaccaagagatccaccttcagaatggacatgattcagggagctagaagacactttaagttatactggaaaattcaggtgccactgaaagccagatttatagtattccatctttaatatgtgggactaacagcagtgtagattgttaccttaatattttttgctgggaccatctacctgccttatactacacttaggaaaaagtattacatatggtttattttgaaacttcaagtattattgccttaatgtctcttaaccctgttacacgctgcttgtagacatgttaatatagtaatacctttatgatatattgagtttaaggactactctttttctgttttatcatgtatgcattattttgtatatgtacagggcaagtaggtatataatttgataaagttgcaattgaaatattattaacagaagatgtaagaaatttctgcatggtctaaatctttgtgtactttatttgtaaattatttgccctggagttttagaaaatagtttctgaattttaaacttgctggattcatgcagccagctttgcaggttatcagagatcaaagattgtaataataattttgtaaattgtaagcaaaaagttatttttatattatatacagtctaattgttcatcctaattgttcctgttttcatctagtcagagattcagtaagtgccttggaacaatattgaattctcttagcttgtgtgtgtttctttaatatttgaactcaagtgggattagaagactatcaaaatacatgtatgtttcaggatatttgacctgtcattaaaaaaaacaaacagttttacagtgcc

SEQ ID NO: 171596 - DNA, 704 bp, Homo sapiens
  Payload ID: 13740
  Gene Symbol: PTPN12
  Gene Name: protein tyrosine phosphatase, non-receptor type 12
  ENST ID: ENST00000407343
  CDS Start-End: 1-704
aattcttgtgtggactgcagtgtaacacaatcaaacaaagtttcagttactccaccagaagaatcccagaattcagacacacctccaaggccagaccgcttgcctcttgatgagaaaggacatgtaacgtggtcatttcatggacctgaaaatgccatacccatacctgatttatctgaaggcaattcctcagatatcaactatcaaactaggaaaactgtgagtttaacaccaagtcctacaacacaagttgaaacacctgatcttgtggatcatgataacacttcaccactcttcagaacacccctcagttttactaatccacttcactctgatgactcagactcagatgaaagaaactctgatggtgctgtgacccagaataaaactaatatttcaacagcaagtgccacagtttctgctgccactagtactgaaagcatttctactaggaaagtattgccaatgtccattgctagacataatatagcaggaacaacacattcaggtgctgaaaaagatacacctgtaagatcggaatggagtgaacttcaaagtcaggaacgatctgaacaaaaaaagtctgaaggcttgataacctctgaaaatgagaaatgtgatcatccagcgggaggtattcactatgaaatgtgcatagaatgtccacctactttcagtgacaagagagaacaaatatcagaaaa

SEQ ID NO: 171597 - DNA, 2316 bp, Homo sapiens
  Payload ID: 13740
  Gene Symbol: PTPN12
  Gene Name: protein tyrosine phosphatase, non-receptor type 12
  Uniprot ID: Q05209
  ENST ID: ENST00000415482
  CDS Start-End: 331-2316
gtcgaggcaaggtatctggctgtgaccgggaggagtgcagatcgtggctgacagaggaacgggggtattgagcggttaagaagattgtctaccaaatatagaacagaaaagatatatcccacagccactggagaaaaagaagaaaatgttaaaaagaacagatacaaggacatactgccatttgatcacagccgagttaaattgacattaaagactccttcacaagattcagactatatcaatgcaaattttataaagggcgtctatgggccaaaagcatatgtagcaactcaaggacctttagcaaatacagtaatagatttttggaggatgatatgggagtataatgttgtgatcattgtaatggcctgccgagaatttgagatgggaaggaaaaaatgtgagcgctattggcctttgtatggagaagaccccataacgtttgcaccatttaaaatttcttgtgaggatgaacaagcaagaacagactacttcatcaggacactcttacttgaatttcaaaatgaatctcgtaggctgtatcagtttcattatgtgaactggccagaccatgatgttccttcatcatttgattctattctggacatgataagcttaatgaggaaatatcaagaacatgaagatgttcctatttgtattcattgcagtgcaggctgtggaagaacaggtgccatttgtgccatagattatacgtggaatttactaaaagctgggaaaataccagaggaatttaatgtatttaatttaatacaagaaatgagaacacaaaggcattctgcagtacaaacaaaggagcaatatgaacttgttcatagagctattgcccaactgtttgaaaaacagctacaactatatgaaattcatggagctcagaaaattgctgatggagtgaatgaaattaacactgaaaacatggtcagctccatagagcctgaaaaacaagattctcctcctccaaaaccaccaaggacccgcagttgccttgttgaaggggatgctaaagaagaaatactgcagccaccggaacctcatccagtgccacccatcttgacaccttctcccccttcagcttttccaacagtcactactgtgtggcaggacaatgatagataccatccaaagccagtgttgcatatggtttcatcagaacaacattcagcagacctcaacagaaactatagtaaatcaacagaacttccagggaaaaatgaatcaacaattgaacagatagataaaaaattggaacgaaatttaagttttgagattaagaaggtccctctccaagagggaccaaaaagttttgatgggaacacacttttgaataggggacatgcaattaaaattaaatctgcttcaccttgtatagctgataaaatctctaagccacaggaattaagttcagatctaaatgtcggtgatacttcccagaattcttgtgtggactgcagtgtaacacaatcaaacaaagtttcagttactccaccagaagaatcccagaattcagacacacctccaaggccagaccgcttgcctcttgatgagaaaggacatgtaacgtggtcatttcatggacctgaaaatgccatacccatacctgatttatctgaaggcaattcctcagatatcaactatcaaactaggaaaactgtgagtttaacaccaagtcctacaacacaagttgaaacacctgatcttgtggatcatgataacacttcaccactcttcagaacacccctcagttttactaatccacttcactctgatgactcagactcagatgaaagaaactctgatggtgctgtgacccagaataaaactaatatttcaacagcaagtgccacagtttctgctgccactagtactgaaagcatttctactaggaaagtattgccaatgtccattgctagacataatatagcaggaacaacacattcaggtgctgaaaaagatgttgatgttagtgaagattcacctcctcccctacctgaaagaactcctgaatcgtttgtgttagcaagtgaacataatacacctgtaagatcggaatggagtgaacttcaaagtcaggaacgatctgaacaaaaaaagtctgaaggcttgataacctctgaaaatgagaaatgtgatcatccagcgggaggtattcactatgaaatgtgcatagaatgtccacctactttcagtgacaagagagaacaaatatcagaaaatccaacagaagccacagatattggttttggtaatcgatgtggaaaacccaaaggaccaagagatccaccttcagaatggacatga

SEQ ID NO: 171598 - DNA, 564 bp, Homo sapiens
  Payload ID: 13740
  Gene Symbol: PTPN12
  Gene Name: protein tyrosine phosphatase, non-receptor type 12
  ENST ID: ENST00000418110
  CDS Start-End: 305-564
aacataatgtcacagtacctttccagtgttaaacttctatactctgcggttaagaagattgtctaccaaatatagaacagaaaagatatatcccacagccactggagaaaaagaagaaaatgttaaaaagaacagatacaaggacatactgccatttgatcacagccgagttaaattgacattaaagactccttcacaagattcagactatatcaatgcaaattttataaagggcgtctatgggccaaaagcatatgtagcaactcaaggacctttagcaaatacagtaatagatttttggaggatgatatgggagtataatgttgtgatcattgtaatggcctgccgagaatttgagatgggaaggaaaaaatgtgagcgctattggcctttgtatggagaagaccccataacgtttgcaccatttaaaatttcttgtgaggatgaacaagcaagaacagactacttcatcaggacactcttacttgaatttcaaaatgaatctcgtaggctgtatcagtttcattatgtgaactggccagaccatgatgttccttcatcatt

SEQ ID NO: 171599 - DNA, 572 bp, Homo sapiens
  Payload ID: 13740
  Gene Symbol: PTPN12
  Gene Name: protein tyrosine phosphatase, non-receptor type 12
  ENST ID: ENST00000447995
  CDS Start-End: 73-414
ggcgtctatgggccaaaagcatatgtagcaactcaaggacctttagcaaatacagtaatagatttttggaggatgatatgggagtataatgttgtgatcattgtaatggcctgccgagaatttgagatgggaaggaaaaaatgtgagcgctattggcctttgtatggagaagaccccataacgtttgcaccatttaaaatttcttgtgaggatgaacaagcaagaacagactacttcatcaggacactcttacttgaatttcaaaatgaatctcgtaggctgtatcagtttcattatgtgaactggccagaccatgatgttccttcatcatttgattctattctggacatgataagcttaatgaggaaatatcaagaacatgaagatgttcctatttgtattcattgcagctaacttctcctttgccacttactgaacggtctgatctctggagaattcactgttattgcaggctgtggaagaacaggtgccatttgtgccatagattatacgtggaatttactaaaagctgggaaaataccagaggaatttaatgtatttaatttaataca

SEQ ID NO: 171600 - DNA, 2526 bp, Homo sapiens
  Payload ID: 13740
  Gene Symbol: PTPN12
  Gene Name: protein tyrosine phosphatase, non-receptor type 12
  Uniprot ID: Q05209
  ENST ID: ENST00000435495
  CDS Start-End: 234-2186
gtgcagatcgtggctgacagaggaacgggggtattgagcggttaagaagattgtctaccaaatatagaacagaaaagatatatcccacagccactggagaaaaagaagaaaatgttaaaaagaacagatacaaggacatactgccatttgatcacagccgagttaaattgacattaaagactccttcacaagattcagactatatcaatgcaaattttataaagatcattgtaatggcctgccgagaatttgagatgggaaggaaaaaatgtgagcgctattggcctttgtatggagaagaccccataacgtttgcaccatttaaaatttcttgtgaggatgaacaagcaagaacagactacttcatcaggacactcttacttgaatttcaaaatgaatctcgtaggctgtatcagtttcattatgtgaactggccagaccatgatgttccttcatcatttgattctattctggacatgataagcttaatgaggaaatatcaagaacatgaagatgttcctatttgtattcattgcagtgcaggctgtggaagaacaggtgccatttgtgccatagattatacgtggaatttactaaaagctgggaaaataccagaggaatttaatgtatttaatttaatacaagaaatgagaacacaaaggcattctgcagtacaaacaaaggagcaatatgaacttgttcatagagctattgcccaactgtttgaaaaacagctacaactatatgaaattcatggagctcagaaaattgctgatggagtgaatgaaattaacactgaaaacatggtcagctccatagagcctgaaaaacaagattctcctcctccaaaaccaccaaggacccgcagttgccttgttgaaggggatgctaaagaagaaatactgcagccaccggaacctcatccagtgccacccatcttgacaccttctcccccttcagcttttccaacagtcactactgtgtggcaggacaatgatagataccatccaaagccagtgttgcatatggtttcatcagaacaacattcagcagacctcaacagaaactatagtaaatcaacagaacttccagggaaaaatgaatcaacaattgaacagatagataaaaaattggaacgaaatttaagttttgagattaagaaggtccctctccaagagggaccaaaaagttttgatgggaacacacttttgaataggggacatgcaattaaaattaaatctgcttcaccttgtatagctgataaaatctctaagccacaggaattaagttcagatctaaatgtcggtgatacttcccagaattcttgtgtggactgcagtgtaacacaatcaaacaaagtttcagttactccaccagaagaatcccagaattcagacacacctccaaggccagaccgcttgcctcttgatgagaaaggacatgtaacgtggtcatttcatggacctgaaaatgccatacccatacctgatttatctgaaggcaattcctcagatatcaactatcaaactaggaaaactgtgagtttaacaccaagtcctacaacacaagttgaaacacctgatcttgtggatcatgataacacttcaccactcttcagaacacccctcagttttactaatccacttcactctgatgactcagactcagatgaaagaaactctgatggtgctgtgacccagaataaaactaatatttcaacagcaagtgccacagtttctgctgccactagtactgaaagcatttctactaggaaagtattgccaatgtccattgctagacataatatagcaggaacaacacattcaggtgctgaaaaagatgttgatgttagtgaagattcacctcctcccctacctgaaagaactcctgaatcgtttgtgttagcaagtgaacataatacacctgtaagatcggaatggagtgaacttcaaagtcaggaacgatctgaacaaaaaaagtctgaaggcttgataacctctgaaaatgagaaatgtgatcatccagcgggaggtattcactatgaaatgtgcatagaatgtccacctactttcagtgacaagagagaacaaatatcagaaaatccaacagaagccacagatattggttttggtaatcgatgtggaaaacccaaaggaccaagagatccaccttcagaatggacatgattcagggagctagaagacactttaagttatactggaaaattcaggtgccactgaaagccagatttatagtattccatctttaatatgtgggactaacagcagtgtagattgttaccttaatattttttgctgggaccatctacctgccttatactacacttaggaaaaagtattacatatggtttattttgaaacttcaagtattattgccttaatgtctcttaaccctgttacacgctgcttgtagacatgttaatatagtaatacctttatgatatattgagtttaaggactactctttttctgttttatcatgtatgcattattttgtatatgtaca

SEQ ID NO: 171601 - DNA, 552 bp, Homo sapiens
  Payload ID: 13740
  Gene Symbol: PTPN12
  Gene Name: protein tyrosine phosphatase, non-receptor type 12
  ENST ID: ENST00000433369
  CDS Start-End: 418-552
aggagggtcgaggcaaggtatctggctgtgaccgggaggagtgcagatcgtggctgacagaggaacgggggtattgagggttgtttcccggcttaggaggcggtggttgcggctgctgctcctacggatattgcgcaagactggggcgttggaaaccctcggttaagaagattgtctaccaaatatagaacagaaaagatatatcccacagccactggagaaaaagaagaaaatgttaaaaagaacagatacaaggacatactgccatttgatcacagccgagttaaattgacattaaagactccttcacaagattcagactatatcaatgcaaattttataaagggcgtctatgggccaaaagcatatgtagcaactcaaggacctttagcaaatacagtaatagatttttggaggatgatatgggagtataatgttgtgatcattgtaatggcctgccgagaatttgagatgggaaggaaaaaatgtgagcgctattggcctttgtatggagaagaccccataacgtttgcaccatttaaaatttcttgt

SEQ ID NO: 171602 - DNA, 159 bp, Homo sapiens
  Payload ID: 13740
  Gene Symbol: PTPN12
  Gene Name: protein tyrosine phosphatase, non-receptor type 12
  ENST ID: ENST00000440186
  CDS Start-End: 107-159
gttaaaaagaacagatacaaggacatactgccatggcgtctatgggccaaaagcatatgtagcaactcaaggacctttagcaaatacagtaatagatttttggaggatgatatgggagtataatgttgtgatcattgtaatggcctgccgagaatttga

SEQ ID NO: 171603 - DNA, 500 bp, Homo sapiens
  Payload ID: 13740
  Gene Symbol: PTPN12
  Gene Name: protein tyrosine phosphatase, non-receptor type 12
  ENST ID: ENST00000523952
  CDS Start-End: 1-131
aagtggagatcctgaggaaattcatccagagggtccaggccatgaagagtcctgaccacaatggggaggacaacttcgcccgggacttcatgatggagctctgtcgcccaggctggagtgcagtggtgtgatctcggctcactgcaacctcagcctcctgagtagctgggactacgggcacacaccacgaggcttggctaatttttgtattttttggtagagattgggtttcaccatgttggccaggctggtcttgagctcctgacctcaagtgatctgcccaccttggcctcctaaagtgctgggattacaggcacaagccaccgtgcccagcccatatacatatttttatcggttaagaagattgtctaccaaatatagaacagaaaagatatatcccacagccactggagaaaaagaagaaaatgttaaaaagaacagatacaaggacatactgccatttgatcacagccgagttaaattgacattaaagactcctt

SEQ ID NO: 171604 - DNA, 642 bp, Homo sapiens
  Payload ID: 13740
  Gene Symbol: PTPN12
  Gene Name: protein tyrosine phosphatase, non-receptor type 12
  ENST ID: ENST00000522115
  CDS Start-End: 1-642
tgtctaccaaatatagaacagaaaagatatatcccacagccactggagaaaaagaagaaaatgttaaaaagaacagatacaaggacatactgccatttgatcacagccgagttaaattgacattaaagactccttcacaagattcagactatatcaatgcaaattttataaagggcgtctatgggccaaaagcatatgtagcaactcaaggacctttagcaaatacagtaatagatttttggaggatgatatgggagtataatgttgtgatcattgtaatggcctgccgagaatttgagatgggaagggaggatgaacaagcaagaacagactacttcatcaggacactcttacttgaatttcaaaatgaatctcgtaggctgtatcagtttcattatgtgaactggccagaccatgatgttccttcatcatttgattctattctggacatgataagcttaatgaggaaatatcaagaacatgaagatgttcctatttgtattcattgcagtgcaggctgtggaagaacaggtgccatttgtgccatagattatacgtggaatttactaaaagctgggaaaataccagaggaatttaatgtatttaatttaatacaagaaatgagaacacaaaggcattctg

SEQ ID NO: 171605 - DNA, 7546 bp, Homo sapiens
  Payload ID: 13741
  Gene Symbol: PTPN13
  Gene Name: protein tyrosine phosphatase, non-receptor type 13 (APO-1/CD95 (Fas)-associated phosphatase)
  Uniprot ID: Q12923
  ENST ID: ENST00000316707
  CDS Start-End: 64-6948
cgtccctgcagccctcgcccggcgctccagtagcaggacccggtctcgggaccagccggtaatatgcacgtgtcactagctgaggccctggaggttcggggtggaccacttcaggaggaagaaatatgggctgtattaaatcaaagtgctgaaagtctccaagaattattcagaaaagtaagcctagctgatcctgctgcccttggcttcatcatttctccatggtctctgctgttgctgccatctggtagtgtgtcatttacagatgaaaatatttccaatcaggatcttcgagcattcactgcaccagaggttcttcaaaatcagtcactaacttctctctcagatgttgaaaagatccacatttattctcttggaatgacactgtattggggggctgattatgaagtgcctcagagccaacctattaagcttggagatcatctcaacagcatactgcttggaatgtgtgaggatgttatttacgctcgagtttctgttcggactgtgctggatgcttgcagtgcccacattaggaatagcaattgtgcaccctcattttcctacgtgaaacacttggtaaaactggttctgggaaatctttctgggacagatcagctttcctgtaacagtgaacaaaagcctgatcgaagccaggctattcgagatcgattgcgaggaaaaggattaccaacaggaagaagctctacttctgatgtactagacatacaaaagcctccactctctcatcagacctttcttaacaaagggcttagtaaatctatgggatttctgtccatcaaagatacacaagatgagaattatttcaaggacattttatcagataattctggacgtgaagattctgaaaatacattctccccttaccagttcaaaactagtggcccagaaaaaaaacccatccctggcattgatgtgctttctaagaagaagatctgggcttcatccatggacttgctttgtacagctgacagagacttctcttcaggagagactgccacatatcgtcgttgtcaccctgaggcagtaacagtgcggacttcaactactcctagaaaaaaggaggcaagatactcagatggaagtatagccttggatatctttggccctcagaaaatggatccaatatatcacactcgagaattgcccacctcctcagcaatatcaagtgctttggaccgaatccgagagagacaaaagaaacttcaggttctgagggaagccatgaatgtagaagaaccagttcgaagatacaaaacttatcatggtgatgtctttagtacctccagtgaaagtccatctattatttcctctgaatcagatttcagacaagtgagaagaagtgaagcctcaaagaggtttgaatccagcagtggtctcccaggggtagatgaaaccttaagtcaaggccagtcacagagaccgagcagacaatatgaaacaccctttgaaggcaacttaattaatcaagagatcatgctaaaacggcaagaggaagaactgatgcagctacaagccaaaatggcccttagacagtctcggttgagcctatatccaggagacacaatcaaagcgtccatgcttgacatcaccagggatccgttaagagaaattgccctagaaacagccatgactcaaagaaaactgaggaatttctttggccctgagtttgtgaaaatgacaattgaaccatttatatctttggatttgccacggtctattcttactaagaaagggaagaatgaggataaccgaaggaaagtaaacataatgcttctgaacgggcaaagactggaactgacctgtgataccaaaactatatgtaaagatgtgtttgatatggttgtggcacatattggcttagtagagcatcatttgtttgctttagctaccctcaaagataatgaatatttctttgttgatcctgacttaaaattaaccaaagtggccccagagggatggaaagaagaaccaaagaaaaagaccaaagccactgttaattttactttgtttttcagaattaaattttttatggatgatgttagtctaatacaacatactctgacgtgtcatcagtattaccttcagcttcgaaaagatattttggaggaaaggatgcactgtgatgatgagacttccttattgctggcatccttggctctccaggctgagtatggagattatcaaccagaggttcatggtgtgtcttactttagaatggagcactatttgcccgccagagtgatggagaaacttgatttatcctatatcaaagaagagttacccaaattgcataatacctatgtgggagcttctgaaaaagagacagagttagaatttttaaaggtctgccaaagactgacagaatatggagttcattttcaccgagtgcaccctgagaagaagtcacaaacaggaatattgcttggagtctgttctaaaggtgtccttgtgtttgaagttcacaatggagtgcgcacattggtccttcgctttccatggagggaaaccaagaaaatatctttttctaaaaagaaaatcacattgcaaaatacatcagatggaataaaacatggcttccagacagacaacagtaagatatgccagtacctgctgcacctctgctcttaccagcataagttccagctacagatgagagcaagacagagcaaccaagatgcccaagatattgatgtgctacacaaaagatggagcatagtatcttcaccagaaagggagatcaccttagtgaacctgaaaaaagatgcaaagtatggcttgggatttcaaattattggtggggagaagatgggaagactggacctaggcatatttatcagttcagttgcccctggaggaccagctgacttggatggatgcttgaagccaggagaccgtttgatatctgtgaatagtgtgagtctggagggagtcagccaccatgctgcaattgaaattttgcaaaatgcacctgaagatgtgacacttgttatctctcagccaaaagaaaagatatccaaagtgccttctactcctgtgcatctcaccaatgagatgaaaaactacatgaagaaatcttcctacatgcaagacagtgctatagattcttcttccaaggatcaccactggtcacgtggtaccctgaggcacatctcggagaactcctttgggccatctgggggcctgcgggaaggaagcctgagttctcaagattccaggactgagagtgccagcttgtctcaaagccaggtcaatggtttctttgccagccatttaggtgaccaaacctggcaggaatcacagcatggcagcccttccccatctgtaatatccaaagccaccgagaaagagactttcactgatagtaaccaaagcaaaactaaaaagccaggcatttctgatgtaactgattactcagaccgtggagattcagacatggatgaagccacttactccagcagtcaggatcatcaaacaccaaaacaggaatcttcctcttcagtgaatacatccaacaagatgaattttaaaactttttcttcatcacctcctaagcctggagatatctttgaggttgaactggctaaaaatgataacagcttggggataagtgtcacgggaggtgtgaatacgagtgtcagacatggtggcatttatgtgaaagctgttattccccagggagcagcagagtctgatggtagaattcacaaaggtgatcgcgtcctagctgtcaatggagttagtctagaaggagccacccataagcaagctgtggaaacactgagaaatacaggacaggtggttcatctgttattagaaaagggacaatctccaacatctaaagaacatgtcccggtaaccccacagtgtaccctttcagatcagaatgcccaaggtcaaggcccagaaaaagtgaagaaaacaactcaggtcaaagactacagctttgtcactgaagaaaatacatttgaggtaaaattatttaaaaatagctcaggtctaggattcagtttttctcgagaagataatcttataccggagcaaattaatgccagcatagtaagggttaaaaagctctttcctggacagccagcagcagaaagtggaaaaattgatgtaggagatgttatcttgaaagtgaatggagcctctttgaaaggactatctcagcaggaagtcatatctgctctcaggggaactgctccagaagtattcttgcttctctgcagacctccacctggtgtgctaccggaaattgatactgcgcttttgaccccacttcagtctccagcacaagtacttccaaacagcagtaaagactcttctcagccatcatgtgtggagcaaagcaccagctcagatgaaaatgaaatgtcagacaaaagcaaaaaacagtgcaagtccccatccagaagagacagttacagtgacagcagtgggagtggagaagatgacttagtgacagctccagcaaacatatcaaattcgacctggagttcagctttgcatcagactctaagcaacatggtatcacaggcacagagtcatcatgaagcacccaagagtcaagaagataccatttgtaccatgttttactatcctcagaaaattcccaataaaccagagtttgaggacagtaatccttcccctctaccaccggatatggctcctgggcagagttatcaaccccaatcagaatctgcttcctctagttcgatggataagtatcatatacatcacatttctgaaccaactagacaagaaaactggacacctttgaaaaatgacttggaaaatcaccttgaagactttgaactggaagtagaactcctcattaccctaattaaatcagaaaaaggaagcctgggttttacagtaaccaaaggcaatcagagaattggttgttatgttcatgatgtcatacaggatccagccaaaagtgatggaaggctaaaacctggggaccggctcataaaggttaatgatacagatgttactaatatgactcatacagatgcagttaatctgctccgggctgcatccaaaacagtcagattagttattggacgagttctagaattacccagaataccaatgttgcctcatttgctaccggacataacactaacgtgcaacaaagaggagttgggtttttccttatgtggaggtcatgacagcctttatcaagtggtatatattagtgatattaatccaaggtccgtcgcagccattgagggtaatctccagctattagatgtcatccattatgtgaacggagtcagcacacaaggaatgaccttggaggaagttaacagagcattagacatgtcacttccttcattggtattgaaagcaacaagaaatgatcttccagtggtccccagctcaaagaggtctgctgtttcagctccaaagtcaaccaaaggcaatggttcctacagtgtggggtcttgcagccagcctgccctcactcctaatgattcattctccacggttgctggggaagaaataaatgaaatatcgtaccccaaaggaaaatgttctacttatcagataaagggatcaccaaacttgactctgcccaaagaatcttatatacaagaagatgacatttatgatgattcccaagaagctgaagttatccagtctctgctggatgttgtggatgaggaagcccagaatcttttaaacgaaaataatgcagcaggatactcctgtggtccaggtacattaaagatgaatgggaagttatcagaagagagaacagaagatacagactgcgatggttcacctttacctgagtattttactgaggccaccaaaatgaatggctgtgaagaatattgtgaagaaaaagtaaaaagtgaaagcttaattcagaagccacaagaaaagaagactgatgatgatgaaataacatggggaaatgatgagttgccaatagagagaacaaaccatgaagattctgataaagatcattcctttctgacaaacgatgagctcgctgtactccctgtcgtcaaagtgcttccctctggtaaatacacgggtgccaacttaaaatcagtcattcgagtcctgcggggtttgctagatcaaggaattccttctaaggagctggagaatcttcaagaattaaaacctttggatcagtgtctaattgggcaaactaaggaaaacagaaggaagaacagatataaaaatatacttccctatgatgctacaagagtgcctcttggagatgaaggtggctatatcaatgccagcttcattaagataccagttgggaaagaagagttcgtttacattgcctgccaaggaccactgcctacaactgttggagacttctggcagatgatttgggagcaaaaatccacagtgatagccatgatgactcaagaagtagaaggagaaaaaatcaaatgccagcgctattggcccaacatcctaggcaaaacaacaatggtcagcaacagacttcgactggctcttgtgagaatgcagcagctgaagggctttgtggtgagggcaatgacccttgaagatattcagaccagagaggtgcgccatatttctcatctgaatttcactgcctggccagaccatgatacaccttctcaaccagatgatctgcttacttttatctcctacatgagacacatccacagatcaggcccaatcattacgcactgcagtgctggcattggacgttcagggaccctgatttgcatagatgtggttctgggattaatcagtcaggatcttgattttgacatctctgatttggtgcgctgcatgagactacaaagacacggaatggttcagacagaggatcaatatattttctgctatcaagtcatcctttatgtcctgacacgtcttcaagcagaagaagagcaaaaacagcagcctcagcttctgaagtgacatgaaaagagcctctggatgcatttccatttctctccttaacctccagcagactcctgctctctatccaaaataaagatcacagagcagcaagttcatacaacatgcatgttctcctctatcttagaggggtattcttcttgaaaataaaaaatattgaaatgctgtatttttacagctactttaacctatgataattatttacaaaattttaacactaaccaaacaatgcagatcttagggatgattaaaggcagcatttgatgatagcagacattgttacaaggacatggtgagtctatttttaatgcaccaatcttgtttatagcaaaaatgttttccaatattttaataaagtagttattttataggggatacttgaaaccagtatttaagctttaaatgacagtaatattggcatagaaaaaagtagcaaatgtttactgtatcaatttctaatgtttactatatagaatttcctgtaatatatttatatactttttcatgaaaatggagttatcagttatctgtttgttactgcatcatctgtttgtaatcattatctcactttgtaaataaaaacacaccttaaaacatg

SEQ ID NO: 171606 - DNA, 8573 bp, Homo sapiens
  Payload ID: 13741
  Gene Symbol: PTPN13
  Gene Name: protein tyrosine phosphatase, non-receptor type 13 (APO-1/CD95 (Fas)-associated phosphatase)
  Uniprot ID: Q12923
  ENST ID: ENST00000436978
  CDS Start-End: 481-7953
gagtagctccagcggccacgctgaggcgagggtgacacaccatgctcacggcccctggagaccgtcgtgctggcgagccgtgctccgtagctccccggtccgcctcggcagcggtcagagtcgcctacaggagttgagccgcccgcgccagaaggttttggcgaagctcttggagaggcgtcgagcacagtagggcggcgggggtgcgttgagcgctcgggggtcaggcagtcggccgggatcgccgctggggagcgtttccgaggcgaggaggaggaggaggagatgctgctcctcttctccccctccccaggctccttctacagctccttcagcccacgcccgcagccgcttgtgggagaagtggtggtggctctcggcgcccgcggcggctgccggcggcccgccccgacgccgcgtccctgcagccctcgcccggcgctccagtagcaggacccggtctcgggaccagccggtaatatgcacgtgtcactagctgaggccctggaggttcggggtggaccacttcaggaggaagaaatatgggctgtattaaatcaaagtgctgaaagtctccaagaattattcagaaaagtaagcctagctgatcctgctgcccttggcttcatcatttctccatggtctctgctgttgctgccatctggtagtgtgtcatttacagatgaaaatatttccaatcaggatcttcgagcattcactgcaccagaggttcttcaaaatcagtcactaacttctctctcagatgttgaaaagatccacatttattctcttggaatgacactgtattggggggctgattatgaagtgcctcagagccaacctattaagcttggagatcatctcaacagcatactgcttggaatgtgtgaggatgttatttacgctcgagtttctgttcggactgtgctggatgcttgcagtgcccacattaggaatagcaattgtgcaccctcattttcctacgtgaaacacttggtaaaactggttctgggaaatctttctgggacagatcagctttcctgtaacagtgaacaaaagcctgatcgaagccaggctattcgagatcgattgcgaggaaaaggattaccaacaggaagaagctctacttctgatgtactagacatacaaaagcctccactctctcatcagacctttcttaacaaagggcttagtaaatctatgggatttctgtccatcaaagatacacaagatgagaattatttcaaggacattttatcagataattctggacgtgaagattctgaaaatacattctccccttaccagttcaaaactagtggcccagaaaaaaaacccatccctggcattgatgtgctttctaagaagaagatctgggcttcatccatggacttgctttgtacagctgacagagacttctcttcaggagagactgccacatatcgtcgttgtcaccctgaggcagtaacagtgcggacttcaactactcctagaaaaaaggaggcaagatactcagatggaagtatagccttggatatctttggccctcagaaaatggatccaatatatcacactcgagaattgcccacctcctcagcaatatcaagtgctttggaccgaatccgagagagacaaaagaaacttcaggttctgagggaagccatgaatgtagaagaaccagttcgaagatacaaaacttatcatggtgatgtctttagtacctccagtgaaagtccatctattatttcctctgaatcagatttcagacaagtgagaagaagtgaagcctcaaagaggtttgaatccagcagtggtctcccaggggtagatgaaaccttaagtcaaggccagtcacagagaccgagcagacaatatgaaacaccctttgaaggcaacttaattaatcaagagatcatgctaaaacggcaagaggaagaactgatgcagctacaagccaaaatggcccttagacagtctcggttgagcctatatccaggagacacaatcaaagcgtccatgcttgacatcaccagggatccgttaagagaaattgccctagaaacagccatgactcaaagaaaactgaggaatttctttggccctgagtttgtgaaaatgacaattgaaccatttatatctttggatttgccacggtctattcttactaagaaagggaagaatgaggataaccgaaggaaagtaaacataatgcttctgaacgggcaaagactggaactgacctgtgataccaaaactatatgtaaagatgtgtttgatatggttgtggcacatattggcttagtagagcatcatttgtttgctttagctaccctcaaagataatgaatatttctttgttgatcctgacttaaaattaaccaaagtggccccagagggatggaaagaagaaccaaagaaaaagaccaaagccactgttaattttactttgtttttcagaattaaattttttatggatgatgttagtctaatacaacatactctgacgtgtcatcagtattaccttcagcttcgaaaagatattttggaggaaaggatgcactgtgatgatgagacttccttattgctggcatccttggctctccaggctgagtatggagattatcaaccagaggttcatggtgtgtcttactttagaatggagcactatttgcccgccagagtgatggagaaacttgatttatcctatatcaaagaagagttacccaaattgcataatacctatgtgggagcttctgaaaaagagacagagttagaatttttaaaggtctgccaaagactgacagaatatggagttcattttcaccgagtgcaccctgagaagaagtcacaaacaggaatattgcttggagtctgttctaaaggtgtccttgtgtttgaagttcacaatggagtgcgcacattggtccttcgctttccatggagggaaaccaagaaaatatctttttctaaaaagaaaatcacattgcaaaatacatcagatggaataaaacatggcttccagacagacaacagtaagatatgccagtacctgctgcacctctgctcttaccagcataagttccagctacagatgagagcaagacagagcaaccaagatgcccaagatattgagagagcttcgtttaggagcctgaatctccaagcagagtctgttagaggatttaatatgggacgagcaatcagcactggcagtctggccagcagcaccctcaacaaacttgctgttcgacctttatcagttcaagctgagattctgaagaggctatcctgctcagagctgtcgctttaccagccattgcaaaacagttcaaaagagaagaatgacaaagcttcatgggaggaaaagcctagagagatgagtaaatcataccatgatctcagtcaggcctctctctatccacatcggaaaaatgtcattgttaacatggaacccccaccacaaaccgttgcagagttggtgggaaaaccttctcaccagatgtcaagatctgatgcagaatctttggcaggagtgacaaaacttaataattcaaagtctgttgcgagtttaaatagaagtcctgaaaggaggaaacatgaatcagactcctcatccattgaagaccctgggcaagcatatgttctaggaatgactatgcatagttctggaaactcttcatcccaagtacccttaaaagaaaatgatgtgctacacaaaagatggagcatagtatcttcaccagaaagggagatcaccttagtgaacctgaaaaaagatgcaaagtatggcttgggatttcaaattattggtggggagaagatgggaagactggacctaggcatatttatcagttcagttgcccctggaggaccagctgacttggatggatgcttgaagccaggagaccgtttgatatctgtgaatagtgtgagtctggagggagtcagccaccatgctgcaattgaaattttgcaaaatgcacctgaagatgtgacacttgttatctctcagccaaaagaaaagatatccaaagtgccttctactcctgtgcatctcaccaatgagatgaaaaactacatgaagaaatcttcctacatgcaagacagtgctatagattcttcttccaaggatcaccactggtcacgtggtaccctgaggcacatctcggagaactcctttgggccatctgggggcctgcgggaaggaagcctgagttctcaagattccaggactgagagtgccagcttgtctcaaagccaggtcaatggtttctttgccagccatttaggtgaccaaacctggcaggaatcacagcatggcagcccttccccatctgtaatatccaaagccaccgagaaagagactttcactgatagtaaccaaagcaaaactaaaaagccaggcatttctgatgtaactgattactcagaccgtggagattcagacatggatgaagccacttactccagcagtcaggatcatcaaacaccaaaacaggaatcttcctcttcagtgaatacatccaacaagatgaattttaaaactttttcttcatcacctcctaagcctggagatatctttgaggttgaactggctaaaaatgataacagcttggggataagtgtcacggtactgtttgacaagggaggtgtgaatacgagtgtcagacatggtggcatttatgtgaaagctgttattccccagggagcagcagagtctgatggtagaattcacaaaggtgatcgcgtcctagctgtcaatggagttagtctagaaggagccacccataagcaagctgtggaaacactgagaaatacaggacaggtggttcatctgttattagaaaagggacaatctccaacatctaaagaacatgtcccggtaaccccacagtgtaccctttcagatcagaatgcccaaggtcaaggcccagaaaaagtgaagaaaacaactcaggtcaaagactacagctttgtcactgaagaaaatacatttgaggtaaaattatttaaaaatagctcaggtctaggattcagtttttctcgagaagataatcttataccggagcaaattaatgccagcatagtaagggttaaaaagctctttcctggacagccagcagcagaaagtggaaaaattgatgtaggagatgttatcttgaaagtgaatggagcctctttgaaaggactatctcagcaggaagtcatatctgctctcaggggaactgctccagaagtattcttgcttctctgcagacctccacctggtgtgctaccggaaattgatactgcgcttttgaccccacttcagtctccagcacaagtacttccaaacagcagtaaagactcttctcagccatcatgtgtggagcaaagcaccagctcagatgaaaatgaaatgtcagacaaaagcaaaaaacagtgcaagtccccatccagaagagacagttacagtgacagcagtgggagtggagaagatgacttagtgacagctccagcaaacatatcaaattcgacctggagttcagctttgcatcagactctaagcaacatggtatcacaggcacagagtcatcatgaagcacccaagagtcaagaagataccatttgtaccatgttttactatcctcagaaaattcccaataaaccagagtttgaggacagtaatccttcccctctaccaccggatatggctcctgggcagagttatcaaccccaatcagaatctgcttcctctagttcgatggataagtatcatatacatcacatttctgaaccaactagacaagaaaactggacacctttgaaaaatgacttggaaaatcaccttgaagactttgaactggaagtagaactcctcattaccctaattaaatcagaaaaaggaagcctgggttttacagtaaccaaaggcaatcagagaattggttgttatgttcatgatgtcatacaggatccagccaaaagtgatggaaggctaaaacctggggaccggctcataaaggttaatgatacagatgttactaatatgactcatacagatgcagttaatctgctccgggctgcatccaaaacagtcagattagttattggacgagttctagaattacccagaataccaatgttgcctcatttgctaccggacataacactaacgtgcaacaaagaggagttgggtttttccttatgtggaggtcatgacagcctttatcaagtggtatatattagtgatattaatccaaggtccgtcgcagccattgagggtaatctccagctattagatgtcatccattatgtgaacggagtcagcacacaaggaatgaccttggaggaagttaacagagcattagacatgtcacttccttcattggtattgaaagcaacaagaaatgatcttccagtggtccccagctcaaagaggtctgctgtttcagctccaaagtcaaccaaaggcaatggttcctacagtgtggggtcttgcagccagcctgccctcactcctaatgattcattctccacggttgctggggaagaaataaatgaaatatcgtaccccaaaggaaaatgttctacttatcagataaagggatcaccaaacttgactctgcccaaagaatcttatatacaagaagatgacatttatgatgattcccaagaagctgaagttatccagtctctgctggatgttgtggatgaggaagcccagaatcttttaaacgaaaataatgcagcaggatactcctgtggtccaggtacattaaagatgaatgggaagttatcagaagagagaacagaagatacagactgcgatggttcacctttacctgagtattttactgaggccaccaaaatgaatggctgtgaagaatattgtgaagaaaaagtaaaaagtgaaagcttaattcagaagccacaagaaaagaagactgatgatgatgaaataacatggggaaatgatgagttgccaatagagagaacaaaccatgaagattctgataaagatcattcctttctgacaaacgatgagctcgctgtactccctgtcgtcaaagtgcttccctctggtaaatacacgggtgccaacttaaaatcagtcattcgagtcctgcggggtttgctagatcaaggaattccttctaaggagctggagaatcttcaagaattaaaacctttggatcagtgtctaattgggcaaactaaggaaaacagaaggaagaacagatataaaaatatacttccctatgatgctacaagagtgcctcttggagatgaaggtggctatatcaatgccagcttcattaagataccagttgggaaagaagagttcgtttacattgcctgccaaggaccactgcctacaactgttggagacttctggcagatgatttgggagcaaaaatccacagtgatagccatgatgactcaagaagtagaaggagaaaaaatcaaatgccagcgctattggcccaacatcctaggcaaaacaacaatggtcagcaacagacttcgactggctcttgtgagaatgcagcagctgaagggctttgtggtgagggcaatgacccttgaagatattcagaccagagaggtgcgccatatttctcatctgaatttcactgcctggccagaccatgatacaccttctcaaccagatgatctgcttacttttatctcctacatgagacacatccacagatcaggcccaatcattacgcactgcagtgctggcattggacgttcagggaccctgatttgcatagatgtggttctgggattaatcagtcaggatcttgattttgacatctctgatttggtgcgctgcatgagactacaaagacacggaatggttcagacagaggatcaatatattttctgctatcaagtcatcctttatgtcctgacacgtcttcaagcagaagaagagcaaaaacagcagcctcagcttctgaagtgacatgaaaagagcctctggatgcatttccatttctctccttaacctccagcagactcctgctctctatccaaaataaagatcacagagcagcaagttcatacaacatgcatgttctcctctatcttagaggggtattcttcttgaaaataaaaaatattgaaatgctgtatttttacagctactttaacctatgataattatttacaaaattttaacactaaccaaacaatgcagatcttagggatgattaaaggcagcatttgatgatagcagacattgttacaaggacatggtgagtctatttttaatgcaccaatcttgtttatagcaaaaatgttttccaatattttaataaagtagttattttataggggatacttgaaaccagtatttaagctttaaatgacagtaatattggcatagaaaaaagtagcaaatgtttactgtatcaatttctaatgtttactatatagaatttcctgtaatatatttatatactttttcatgaaaatggagttatcagttatctgtttgttactgcatcatctgtttgtaatcattatctcactttgtaaataaaaacacaccttaaaacatgaacaagccaaaactgtgtgcag

SEQ ID NO: 171607 - DNA, 8119 bp, Homo sapiens
  Payload ID: 13741
  Gene Symbol: PTPN13
  Gene Name: protein tyrosine phosphatase, non-receptor type 13 (APO-1/CD95 (Fas)-associated phosphatase)
  Uniprot ID: Q12923
  ENST ID: ENST00000411767
  CDS Start-End: 64-7521
cgtccctgcagccctcgcccggcgctccagtagcaggacccggtctcgggaccagccggtaatatgcacgtgtcactagctgaggccctggaggttcggggtggaccacttcaggaggaagaaatatgggctgtattaaatcaaagtgctgaaagtctccaagaattattcagaaaagtaagcctagctgatcctgctgcccttggcttcatcatttctccatggtctctgctgttgctgccatctggtagtgtgtcatttacagatgaaaatatttccaatcaggatcttcgagcattcactgcaccagaggttcttcaaaatcagtcactaacttctctctcagatgttgaaaagatccacatttattctcttggaatgacactgtattggggggctgattatgaagtgcctcagagccaacctattaagcttggagatcatctcaacagcatactgcttggaatgtgtgaggatgttatttacgctcgagtttctgttcggactgtgctggatgcttgcagtgcccacattaggaatagcaattgtgcaccctcattttcctacgtgaaacacttggtaaaactggttctgggaaatctttctgggacagatcagctttcctgtaacagtgaacaaaagcctgatcgaagccaggctattcgagatcgattgcgaggaaaaggattaccaacaggaagaagctctacttctgatgtactagacatacaaaagcctccactctctcatcagacctttcttaacaaagggcttagtaaatctatgggatttctgtccatcaaagatacacaagatgagaattatttcaaggacattttatcagataattctggacgtgaagattctgaaaatacattctccccttaccagttcaaaactagtggcccagaaaaaaaacccatccctggcattgatgtgctttctaagaagaagatctgggcttcatccatggacttgctttgtacagctgacagagacttctcttcaggagagactgccacatatcgtcgttgtcaccctgaggcagtaacagtgcggacttcaactactcctagaaaaaaggaggcaagatactcagatggaagtatagccttggatatctttggccctcagaaaatggatccaatatatcacactcgagaattgcccacctcctcagcaatatcaagtgctttggaccgaatccgagagagacaaaagaaacttcaggttctgagggaagccatgaatgtagaagaaccagttcgaagatacaaaacttatcatggtgatgtctttagtacctccagtgaaagtccatctattatttcctctgaatcagatttcagacaagtgagaagaagtgaagcctcaaagaggtttgaatccagcagtggtctcccaggggtagatgaaaccttaagtcaaggccagtcacagagaccgagcagacaatatgaaacaccctttgaaggcaacttaattaatcaagagatcatgctaaaacggcaagaggaagaactgatgcagctacaagccaaaatggcccttagacagtctcggttgagcctatatccaggagacacaatcaaagcgtccatgcttgacatcaccagggatccgttaagagaaattgccctagaaacagccatgactcaaagaaaactgaggaatttctttggccctgagtttgtgaaaatgacaattgaaccatttatatctttggatttgccacggtctattcttactaagaaagggaagaatgaggataaccgaaggaaagtaaacataatgcttctgaacgggcaaagactggaactgacctgtgataccaaaactatatgtaaagatgtgtttgatatggttgtggcacatattggcttagtagagcatcatttgtttgctttagctaccctcaaagataatgaatatttctttgttgatcctgacttaaaattaaccaaagtggccccagagggatggaaagaagaaccaaagaaaaagaccaaagccactgttaattttactttgtttttcagaattaaattttttatggatgatgttagtctaatacaacatactctgacgtgtcatcagtattaccttcagcttcgaaaagatattttggaggaaaggatgcactgtgatgatgagacttccttattgctggcatccttggctctccaggctgagtatggagattatcaaccagaggttcatggtgtgtcttactttagaatggagcactatttgcccgccagagtgatggagaaacttgatttatcctatatcaaagaagagttacccaaattgcataatacctatgtgggagcttctgaaaaagagacagagttagaatttttaaaggtctgccaaagactgacagaatatggagttcattttcaccgagtgcaccctgagaagaagtcacaaacaggaatattgcttggagtctgttctaaaggtgtccttgtgtttgaagttcacaatggagtgcgcacattggtccttcgctttccatggagggaaaccaagaaaatatctttttctaaaaagaaaatcacattgcaaaatacatcagatggaataaaacatggcttccagacagacaacagtaagatatgccagtacctgctgcacctctgctcttaccagcataagttccagctacagatgagagcaagacagagcaaccaagatgcccaagatattgagagagcttcgtttaggagcctgaatctccaagcagagtctgttagaggatttaatatgggacgagcaatcagcactggcagtctggccagcagcaccctcaacaaacttgctgttcgacctttatcagttcaagctgagattctgaagaggctatcctgctcagagctgtcgctttaccagccattgcaaaacagttcaaaagagaagaatgacaaagcttcatgggaggaaaagcctagagagatgagtaaatcataccatgatctcagtcaggcctctctctatccacatcggaaaaatgtcattgttaacatggaacccccaccacaaaccgttgcagagttggtgggaaaaccttctcaccagatgtcaagatctgatgcagaatctttggcaggagtgacaaaacttaataattcaaagtctgttgcgagtttaaatagaagtcctgaaaggaggaaacatgaatcagactcctcatccattgaagaccctgggcaagcatatgttctaggaatgactatgcatagttctggaaactcttcatcccaagtacccttaaaagaaaatgatgtgctacacaaaagatggagcatagtatcttcaccagaaagggagatcaccttagtgaacctgaaaaaagatgcaaagtatggcttgggatttcaaattattggtggggagaagatgggaagactggacctaggcatatttatcagttcagttgcccctggaggaccagctgacttggatggatgcttgaagccaggagaccgtttgatatctgtgaatagtgtgagtctggagggagtcagccaccatgctgcaattgaaattttgcaaaatgcacctgaagatgtgacacttgttatctctcagccaaaagaaaagatatccaaagtgccttctactcctgtgcatctcaccaatgagatgaaaaactacatgaagaaatcttcctacatgcaagacagtgctatagattcttcttccaaggatcaccactggtcacgtggtaccctgaggcacatctcggagaactcctttgggccatctgggggcctgcgggaaggaagcctgagttctcaagattccaggactgagagtgccagcttgtctcaaagccaggtcaatggtttctttgccagccatttaggtgaccaaacctggcaggaatcacagcatggcagcccttccccatctgtaatatccaaagccaccgagaaagagactttcactgatagtaaccaaagcaaaactaaaaagccaggcatttctgatgtaactgattactcagaccgtggagattcagacatggatgaagccacttactccagcagtcaggatcatcaaacaccaaaacaggaatcttcctcttcagtgaatacatccaacaagatgaattttaaaactttttcttcatcacctcctaagcctggagatatctttgaggttgaactggctaaaaatgataacagcttggggataagtgtcacgggaggtgtgaatacgagtgtcagacatggtggcatttatgtgaaagctgttattccccagggagcagcagagtctgatggtagaattcacaaaggtgatcgcgtcctagctgtcaatggagttagtctagaaggagccacccataagcaagctgtggaaacactgagaaatacaggacaggtggttcatctgttattagaaaagggacaatctccaacatctaaagaacatgtcccggtaaccccacagtgtaccctttcagatcagaatgcccaaggtcaaggcccagaaaaagtgaagaaaacaactcaggtcaaagactacagctttgtcactgaagaaaatacatttgaggtaaaattatttaaaaatagctcaggtctaggattcagtttttctcgagaagataatcttataccggagcaaattaatgccagcatagtaagggttaaaaagctctttcctggacagccagcagcagaaagtggaaaaattgatgtaggagatgttatcttgaaagtgaatggagcctctttgaaaggactatctcagcaggaagtcatatctgctctcaggggaactgctccagaagtattcttgcttctctgcagacctccacctggtgtgctaccggaaattgatactgcgcttttgaccccacttcagtctccagcacaagtacttccaaacagcagtaaagactcttctcagccatcatgtgtggagcaaagcaccagctcagatgaaaatgaaatgtcagacaaaagcaaaaaacagtgcaagtccccatccagaagagacagttacagtgacagcagtgggagtggagaagatgacttagtgacagctccagcaaacatatcaaattcgacctggagttcagctttgcatcagactctaagcaacatggtatcacaggcacagagtcatcatgaagcacccaagagtcaagaagataccatttgtaccatgttttactatcctcagaaaattcccaataaaccagagtttgaggacagtaatccttcccctctaccaccggatatggctcctgggcagagttatcaaccccaatcagaatctgcttcctctagttcgatggataagtatcatatacatcacatttctgaaccaactagacaagaaaactggacacctttgaaaaatgacttggaaaatcaccttgaagactttgaactggaagtagaactcctcattaccctaattaaatcagaaaaaggaagcctgggttttacagtaaccaaaggcaatcagagaattggttgttatgttcatgatgtcatacaggatccagccaaaagtgatggaaggctaaaacctggggaccggctcataaaggttaatgatacagatgttactaatatgactcatacagatgcagttaatctgctccgggctgcatccaaaacagtcagattagttattggacgagttctagaattacccagaataccaatgttgcctcatttgctaccggacataacactaacgtgcaacaaagaggagttgggtttttccttatgtggaggtcatgacagcctttatcaagtggtatatattagtgatattaatccaaggtccgtcgcagccattgagggtaatctccagctattagatgtcatccattatgtgaacggagtcagcacacaaggaatgaccttggaggaagttaacagagcattagacatgtcacttccttcattggtattgaaagcaacaagaaatgatcttccagtggtccccagctcaaagaggtctgctgtttcagctccaaagtcaaccaaaggcaatggttcctacagtgtggggtcttgcagccagcctgccctcactcctaatgattcattctccacggttgctggggaagaaataaatgaaatatcgtaccccaaaggaaaatgttctacttatcagataaagggatcaccaaacttgactctgcccaaagaatcttatatacaagaagatgacatttatgatgattcccaagaagctgaagttatccagtctctgctggatgttgtggatgaggaagcccagaatcttttaaacgaaaataatgcagcaggatactcctgtggtccaggtacattaaagatgaatgggaagttatcagaagagagaacagaagatacagactgcgatggttcacctttacctgagtattttactgaggccaccaaaatgaatggctgtgaagaatattgtgaagaaaaagtaaaaagtgaaagcttaattcagaagccacaagaaaagaagactgatgatgatgaaataacatggggaaatgatgagttgccaatagagagaacaaaccatgaagattctgataaagatcattcctttctgacaaacgatgagctcgctgtactccctgtcgtcaaagtgcttccctctggtaaatacacgggtgccaacttaaaatcagtcattcgagtcctgcggggtttgctagatcaaggaattccttctaaggagctggagaatcttcaagaattaaaacctttggatcagtgtctaattgggcaaactaaggaaaacagaaggaagaacagatataaaaatatacttccctatgatgctacaagagtgcctcttggagatgaaggtggctatatcaatgccagcttcattaagataccagttgggaaagaagagttcgtttacattgcctgccaaggaccactgcctacaactgttggagacttctggcagatgatttgggagcaaaaatccacagtgatagccatgatgactcaagaagtagaaggagaaaaaatcaaatgccagcgctattggcccaacatcctaggcaaaacaacaatggtcagcaacagacttcgactggctcttgtgagaatgcagcagctgaagggctttgtggtgagggcaatgacccttgaagatattcagaccagagaggtgcgccatatttctcatctgaatttcactgcctggccagaccatgatacaccttctcaaccagatgatctgcttacttttatctcctacatgagacacatccacagatcaggcccaatcattacgcactgcagtgctggcattggacgttcagggaccctgatttgcatagatgtggttctgggattaatcagtcaggatcttgattttgacatctctgatttggtgcgctgcatgagactacaaagacacggaatggttcagacagaggatcaatatattttctgctatcaagtcatcctttatgtcctgacacgtcttcaagcagaagaagagcaaaaacagcagcctcagcttctgaagtgacatgaaaagagcctctggatgcatttccatttctctccttaacctccagcagactcctgctctctatccaaaataaagatcacagagcagcaagttcatacaacatgcatgttctcctctatcttagaggggtattcttcttgaaaataaaaaatattgaaatgctgtatttttacagctactttaacctatgataattatttacaaaattttaacactaaccaaacaatgcagatcttagggatgattaaaggcagcatttgatgatagcagacattgttacaaggacatggtgagtctatttttaatgcaccaatcttgtttatagcaaaaatgttttccaatattttaataaagtagttattttataggggatacttgaaaccagtatttaagctttaaatgacagtaatattggcatagaaaaaagtagcaaatgtttactgtatcaatttctaatgtttactatatagaatttcctgtaatatatttatatactttttcatgaaaatggagttatcagttatctgtttgttactgcatcatctgtttgtaatcattatctcactttgtaaataaaaacacaccttaaaacatg

SEQ ID NO: 171608 - DNA, 8487 bp, Homo sapiens
  Payload ID: 13741
  Gene Symbol: PTPN13
  Gene Name: protein tyrosine phosphatase, non-receptor type 13 (APO-1/CD95 (Fas)-associated phosphatase)
  Uniprot ID: Q12923
  ENST ID: ENST00000427191
  CDS Start-End: 481-7881
gagtagctccagcggccacgctgaggcgagggtgacacaccatgctcacggcccctggagaccgtcgtgctggcgagccgtgctccgtagctccccggtccgcctcggcagcggtcagagtcgcctacaggagttgagccgcccgcgccagaaggttttggcgaagctcttggagaggcgtcgagcacagtagggcggcgggggtgcgttgagcgctcgggggtcaggcagtcggccgggatcgccgctggggagcgtttccgaggcgaggaggaggaggaggagatgctgctcctcttctccccctccccaggctccttctacagctccttcagcccacgcccgcagccgcttgtgggagaagtggtggtggctctcggcgcccgcggcggctgccggcggcccgccccgacgccgcgtccctgcagccctcgcccggcgctccagtagcaggacccggtctcgggaccagccggtaatatgcacgtgtcactagctgaggccctggaggttcggggtggaccacttcaggaggaagaaatatgggctgtattaaatcaaagtgctgaaagtctccaagaattattcagaaaagtaagcctagctgatcctgctgcccttggcttcatcatttctccatggtctctgctgttgctgccatctggtagtgtgtcatttacagatgaaaatatttccaatcaggatcttcgagcattcactgcaccagaggttcttcaaaatcagtcactaacttctctctcagatgttgaaaagatccacatttattctcttggaatgacactgtattggggggctgattatgaagtgcctcagagccaacctattaagcttggagatcatctcaacagcatactgcttggaatgtgtgaggatgttatttacgctcgagtttctgttcggactgtgctggatgcttgcagtgcccacattaggaatagcaattgtgcaccctcattttcctacgtgaaacacttggtaaaactggttctgggaaatctttctgggacagatcagctttcctgtaacagtgaacaaaagcctgatcgaagccaggctattcgagatcgattgcgaggaaaaggattaccaacaggaagaagctctacttctgatgtactagacatacaaaagcctccactctctcatcagacctttcttaacaaagggcttagtaaatctatgggatttctgtccatcaaagatacacaagatgagaattatttcaaggacattttatcagataattctggacgtgaagattctgaaaatacattctccccttaccagttcaaaactagtggcccagaaaaaaaacccatccctggcattgatgtgctttctaagaagaagatctgggcttcatccatggacttgctttgtacagctgacagagacttctcttcaggagagactgccacatatcgtcgttgtcaccctgaggcagtaacagtgcggacttcaactactcctagaaaaaaggaggcaagatactcagatggaagtatagccttggatatctttggccctcagaaaatggatccaatatatcacactcgagaattgcccacctcctcagcaatatcaagtgctttggaccgaatccgagagagacaaaagaaacttcaggttctgagggaagccatgaatgtagaagaaccagttcgaagatacaaaacttatcatggtgatgtctttagtacctccagtgaaagtccatctattatttcctctgaatcagatttcagacaagtgagaagaagtgaagcctcaaagaggtttgaatccagcagtggtctcccaggggtagatgaaaccttaagtcaaggccagtcacagagaccgagcagacaatatgaaacaccctttgaaggcaacttaattaatcaagagatcatgctaaaacggcaagaggaagaactgatgcagctacaagccaaaatggcccttagacagtctcggttgagcctatatccaggagacacaatcaaagcgtccatgcttgacatcaccagggatccgttaagagaaattgccctagaaacagccatgactcaaagaaaactgaggaatttctttggccctgagtttgtgaaaatgacaattgaaccatttatatctttggatttgccacggtctattcttactaagaaagggaagaatgaggataaccgaaggaaagtaaacataatgcttctgaacgggcaaagactggaactgacctgtgataccaaaactatatgtaaagatgtgtttgatatggttgtggcacatattggcttagtagagcatcatttgtttgctttagctaccctcaaagataatgaatatttctttgttgatcctgacttaaaattaaccaaagtggccccagagggatggaaagaagaaccaaagaaaaagaccaaagccactgttaattttactttgtttttcagaattaaattttttatggatgatgttagtctaatacaacatactctgacgtgtcatcagtattaccttcagcttcgaaaagatattttggaggaaaggatgcactgtgatgatgagacttccttattgctggcatccttggctctccaggctgagtatggagattatcaaccagaggttcatggtgtgtcttactttagaatggagcactatttgcccgccagagtgatggagaaacttgatttatcctatatcaaagaagagttacccaaattgcataatacctatgtgggagcttctgaaaaagagacagagttagaatttttaaaggtctgccaaagactgacagaatatggagttcattttcaccgagtgcaccctgagaagaagtcacaaacaggaatattgcttggagtctgttctaaaggtgtccttgtgtttgaagttcacaatggagtgcgcacattggtccttcgctttccatggagggaaaccaagaaaatatctttttctaaaaagaaaatcacattgcaaaatacatcagatggaataaaacatggcttccagacagacaacagtaagatatgccagtacctgctgcacctctgctcttaccagcataagttccagctacagatgagagcaagacagagcaaccaagatgcccaagatattgagagagcttcgtttaggagcctgaatctccaagcagagtctgttagaggatttaatatgggacgagcaatcagcactggcagtctggccagcagcaccctcaacaaacttgctgttcgacctttatcagttcaagctgagattctgaagaggctatcctgctcagagctgtcgctttaccagccattgcaaaacagttcaaaagagaagaatgacaaagcttcatgggaggaaaagcctagagagatgagtaaatcataccatgatctcagtcaggcctctctctatccacatcggaaaaatgtcattgttaacatggaacccccaccacaaaccgttgcagagttggtgggaaaaccttctcaccagatgtcaagatctgatgcagaatctttggcaggagtgacaaaacttaataattcaaagtctgttgcgagtttaaatagaagtcctgaaaggaggaaacatgaatcagactcctcatccattgaagaccctgggcaagcatatgttctagatgtgctacacaaaagatggagcatagtatcttcaccagaaagggagatcaccttagtgaacctgaaaaaagatgcaaagtatggcttgggatttcaaattattggtggggagaagatgggaagactggacctaggcatatttatcagttcagttgcccctggaggaccagctgacttggatggatgcttgaagccaggagaccgtttgatatctgtgaatagtgtgagtctggagggagtcagccaccatgctgcaattgaaattttgcaaaatgcacctgaagatgtgacacttgttatctctcagccaaaagaaaagatatccaaagtgccttctactcctgtgcatctcaccaatgagatgaaaaactacatgaagaaatcttcctacatgcaagacagtgctatagattcttcttccaaggatcaccactggtcacgtggtaccctgaggcacatctcggagaactcctttgggccatctgggggcctgcgggaaggaagcctgagttctcaagattccaggactgagagtgccagcttgtctcaaagccaggtcaatggtttctttgccagccatttaggtgaccaaacctggcaggaatcacagcatggcagcccttccccatctgtaatatccaaagccaccgagaaagagactttcactgatagtaaccaaagcaaaactaaaaagccaggcatttctgatgtaactgattactcagaccgtggagattcagacatggatgaagccacttactccagcagtcaggatcatcaaacaccaaaacaggaatcttcctcttcagtgaatacatccaacaagatgaattttaaaactttttcttcatcacctcctaagcctggagatatctttgaggttgaactggctaaaaatgataacagcttggggataagtgtcacgggaggtgtgaatacgagtgtcagacatggtggcatttatgtgaaagctgttattccccagggagcagcagagtctgatggtagaattcacaaaggtgatcgcgtcctagctgtcaatggagttagtctagaaggagccacccataagcaagctgtggaaacactgagaaatacaggacaggtggttcatctgttattagaaaagggacaatctccaacatctaaagaacatgtcccggtaaccccacagtgtaccctttcagatcagaatgcccaaggtcaaggcccagaaaaagtgaagaaaacaactcaggtcaaagactacagctttgtcactgaagaaaatacatttgaggtaaaattatttaaaaatagctcaggtctaggattcagtttttctcgagaagataatcttataccggagcaaattaatgccagcatagtaagggttaaaaagctctttcctggacagccagcagcagaaagtggaaaaattgatgtaggagatgttatcttgaaagtgaatggagcctctttgaaaggactatctcagcaggaagtcatatctgctctcaggggaactgctccagaagtattcttgcttctctgcagacctccacctggtgtgctaccggaaattgatactgcgcttttgaccccacttcagtctccagcacaagtacttccaaacagcagtaaagactcttctcagccatcatgtgtggagcaaagcaccagctcagatgaaaatgaaatgtcagacaaaagcaaaaaacagtgcaagtccccatccagaagagacagttacagtgacagcagtgggagtggagaagatgacttagtgacagctccagcaaacatatcaaattcgacctggagttcagctttgcatcagactctaagcaacatggtatcacaggcacagagtcatcatgaagcacccaagagtcaagaagataccatttgtaccatgttttactatcctcagaaaattcccaataaaccagagtttgaggacagtaatccttcccctctaccaccggatatggctcctgggcagagttatcaaccccaatcagaatctgcttcctctagttcgatggataagtatcatatacatcacatttctgaaccaactagacaagaaaactggacacctttgaaaaatgacttggaaaatcaccttgaagactttgaactggaagtagaactcctcattaccctaattaaatcagaaaaaggaagcctgggttttacagtaaccaaaggcaatcagagaattggttgttatgttcatgatgtcatacaggatccagccaaaagtgatggaaggctaaaacctggggaccggctcataaaggttaatgatacagatgttactaatatgactcatacagatgcagttaatctgctccgggctgcatccaaaacagtcagattagttattggacgagttctagaattacccagaataccaatgttgcctcatttgctaccggacataacactaacgtgcaacaaagaggagttgggtttttccttatgtggaggtcatgacagcctttatcaagtggtatatattagtgatattaatccaaggtccgtcgcagccattgagggtaatctccagctattagatgtcatccattatgtgaacggagtcagcacacaaggaatgaccttggaggaagttaacagagcattagacatgtcacttccttcattggtattgaaagcaacaagaaatgatcttccagtggtccccagctcaaagaggtctgctgtttcagctccaaagtcaaccaaaggcaatggttcctacagtgtggggtcttgcagccagcctgccctcactcctaatgattcattctccacggttgctggggaagaaataaatgaaatatcgtaccccaaaggaaaatgttctacttatcagataaagggatcaccaaacttgactctgcccaaagaatcttatatacaagaagatgacatttatgatgattcccaagaagctgaagttatccagtctctgctggatgttgtggatgaggaagcccagaatcttttaaacgaaaataatgcagcaggatactcctgtggtccaggtacattaaagatgaatgggaagttatcagaagagagaacagaagatacagactgcgatggttcacctttacctgagtattttactgaggccaccaaaatgaatggctgtgaagaatattgtgaagaaaaagtaaaaagtgaaagcttaattcagaagccacaagaaaagaagactgatgatgatgaaataacatggggaaatgatgagttgccaatagagagaacaaaccatgaagattctgataaagatcattcctttctgacaaacgatgagctcgctgtactccctgtcgtcaaagtgcttccctctggtaaatacacgggtgccaacttaaaatcagtcattcgagtcctgcggggtttgctagatcaaggaattccttctaaggagctggagaatcttcaagaattaaaacctttggatcagtgtctaattgggcaaactaaggaaaacagaaggaagaacagatataaaaatatacttccctatgatgctacaagagtgcctcttggagatgaaggtggctatatcaatgccagcttcattaagataccagttgggaaagaagagttcgtttacattgcctgccaaggaccactgcctacaactgttggagacttctggcagatgatttgggagcaaaaatccacagtgatagccatgatgactcaagaagtagaaggagaaaaaatcaaatgccagcgctattggcccaacatcctaggcaaaacaacaatggtcagcaacagacttcgactggctcttgtgagaatgcagcagctgaagggctttgtggtgagggcaatgacccttgaagatattcagaccagagaggtgcgccatatttctcatctgaatttcactgcctggccagaccatgatacaccttctcaaccagatgatctgcttacttttatctcctacatgagacacatccacagatcaggcccaatcattacgcactgcagtgctggcattggacgttcagggaccctgatttgcatagatgtggttctgggattaatcagtcaggatcttgattttgacatctctgatttggtgcgctgcatgagactacaaagacacggaatggttcagacagaggatcaatatattttctgctatcaagtcatcctttatgtcctgacacgtcttcaagcagaagaagagcaaaaacagcagcctcagcttctgaagtgacatgaaaagagcctctggatgcatttccatttctctccttaacctccagcagactcctgctctctatccaaaataaagatcacagagcagcaagttcatacaacatgcatgttctcctctatcttagaggggtattcttcttgaaaataaaaaatattgaaatgctgtatttttacagctactttaacctatgataattatttacaaaattttaacactaaccaaacaatgcagatcttagggatgattaaaggcagcatttgatgatagcagacattgttacaaggacatggtgagtctatttttaatgcaccaatcttgtttatagcaaaaatgttttccaatattttaataaagtagttattttataggggatacttgaaaccagtatttaagctttaaatgacagtaatattggcatagaaaaaagtagcaaatgtttactgtatcaatttctaatgtttactatatagaatttcctgtaatatatttatatactttttcatgaaaatggagttatcagttatctgtttgttactgcatcatctgtttgtaatcattatctcactttgtaaataaaaacacaccttaaaacatgaacaagcc

SEQ ID NO: 171609 - DNA, 516 bp, Homo sapiens
  Payload ID: 13741
  Gene Symbol: PTPN13
  Gene Name: protein tyrosine phosphatase, non-receptor type 13 (APO-1/CD95 (Fas)-associated phosphatase)
  ENST ID: ENST00000507902
  CDS Start-End: 100-516
agctccctcgcagaaaatggggcaatcgggtttgttttcaaggcaggacctgaacaaaatgtaggacacctgatctgtgggatgaagggcgctggtaatatgcacgtgtcactagctgaggccctggaggttcggggtggaccacttcaggaggaagaaatatgggctgtattaaatcaaagtgctgaaagtctccaagaattattcagaaaagtaagcctagctgatcctgctgcccttggcttcatcatttctccatggtctctgctgttgctgccatctggtagtgtgtcatttacagatgaaaatatttccaatcaggatcttcgagcattcactgcaccagaggttcttcaaaatcagtcactaacttctctctcagatgttgaaaagatccacatttattctcttggaatgacactgtattggggggctgattatgaagtgcctcagagccaacctattaagcttggagatcatctcaacagcatactgcttggaatgtgtgaggatgtt

SEQ ID NO: 171610 - DNA, 1708 bp, Homo sapiens
  Payload ID: 13741
  Gene Symbol: PTPN13
  Gene Name: protein tyrosine phosphatase, non-receptor type 13 (APO-1/CD95 (Fas)-associated phosphatase)
  ENST ID: ENST00000502971
  CDS Start-End: 479-1162
gtagctccagcggccacgctgaggcgagggtgacacaccatgctcacggcccctggagaccgtcgtgctggcgagccgtgctccgtagctccccggtccgcctcggcagcggtcagagtcgcctacaggagttgagccgcccgcgccagaaggttttggcgaagctcttggagaggcgtcgagcacagtagggcggcgggggtgcgttgagcgctcgggggtcaggcagtcggccgggatcgccgctggggagcgtttccgaggcgaggaggaggaggaggagatgctgctcctcttctccccctccccaggctccttctacagctccttcagcccacgcccgcagccgcttgtgggagaagtggtggtggctctcggcgcccgcggcggctgccggcggcccgccccgacgccgcgtccctgcagccctcgcccggcgctccagtagcaggacccggtctcgggaccagccggtaatatgcacgtgtcactagctgaggccctggaggttcggggtggaccacttcaggaggaagaaatatgggctgtattaaatcaaagtgctgaaagtctccaagaattattcagaaaagtaagcctagctgatcctgctgcccttggcttcatcatttctccatggtctctgctgttgctgccatctggtagtgtgtcatttacagatgaaaatatttccaatcaggatcttcgagcattcactgcaccagaggttcttcaaaatcagtcactaacttctctctcagatgttgaaaagatccacatttattctcttggaatgacactgtattggggggctgattatgaagtgcctcagagccaacctattaagcttggagatcatctcaacagcatactgcttggaatgtgtgaggatgttatttacgctcgagtttctgttcggactgtgctggatgcttgcagtgcccacattaggaatagcaattgtgcaccctcattttcctacgtgaaacacttggtaaaactggttctgggaaatctttctggggtatttcccaaaccttctccactttcccttcttctcggaacactgctacctagtgtatccagggaatccatgcttgtatccctgccagatttccccaagacctggactcttctagtttttctcttgttttggatatgaagaatcccaagaataaccaatgctatatattacctgaaagtcccacctctgttctgcatttctaaggctgtattttatcttgtttgccctatctgatctggatctatactttatctgctcttatccttagggttgtagtcctggagtgttggtccctcttccttgcacaggttacaaatttaccactgccacacagtgttcttgttgacttcctcagaattcctcatcggtaggggtttagttcccatcttaaccaggatgtcagatggctgccaggaatgtattcaaattctgcacagtttttcagttgataacaaacaggcccacagatcttctagacaaatggtttgtaaactctccctcaagaaacctttgcggttctatagtgaagggaaatgtaggaagtagaggccgaataaatggagttcttggttgcccattttccctctttaactagagcagctccagttttatttgatctgtttatatttctgcgtgtgatttttttgaacaaaggtaaagctattaaaaaatctttgaaaacca

SEQ ID NO: 171611 - DNA, 8076 bp, Homo sapiens
  Payload ID: 13741
  Gene Symbol: PTPN13
  Gene Name: protein tyrosine phosphatase, non-receptor type 13 (APO-1/CD95 (Fas)-associated phosphatase)
  Uniprot ID: Q12923
  ENST ID: ENST00000511467
  CDS Start-End: 6-7478
gtaatatgcacgtgtcactagctgaggccctggaggttcggggtggaccacttcaggaggaagaaatatgggctgtattaaatcaaagtgctgaaagtctccaagaattattcagaaaagtaagcctagctgatcctgctgcccttggcttcatcatttctccatggtctctgctgttgctgccatctggtagtgtgtcatttacagatgaaaatatttccaatcaggatcttcgagcattcactgcaccagaggttcttcaaaatcagtcactaacttctctctcagatgttgaaaagatccacatttattctcttggaatgacactgtattggggggctgattatgaagtgcctcagagccaacctattaagcttggagatcatctcaacagcatactgcttggaatgtgtgaggatgttatttacgctcgagtttctgttcggactgtgctggatgcttgcagtgcccacattaggaatagcaattgtgcaccctcattttcctacgtgaaacacttggtaaaactggttctgggaaatctttctgggacagatcagctttcctgtaacagtgaacaaaagcctgatcgaagccaggctattcgagatcgattgcgaggaaaaggattaccaacaggaagaagctctacttctgatgtactagacatacaaaagcctccactctctcatcagacctttcttaacaaagggcttagtaaatctatgggatttctgtccatcaaagatacacaagatgagaattatttcaaggacattttatcagataattctggacgtgaagattctgaaaatacattctccccttaccagttcaaaactagtggcccagaaaaaaaacccatccctggcattgatgtgctttctaagaagaagatctgggcttcatccatggacttgctttgtacagctgacagagacttctcttcaggagagactgccacatatcgtcgttgtcaccctgaggcagtaacagtgcggacttcaactactcctagaaaaaaggaggcaagatactcagatggaagtatagccttggatatctttggccctcagaaaatggatccaatatatcacactcgagaattgcccacctcctcagcaatatcaagtgctttggaccgaatccgagagagacaaaagaaacttcaggttctgagggaagccatgaatgtagaagaaccagttcgaagatacaaaacttatcatggtgatgtctttagtacctccagtgaaagtccatctattatttcctctgaatcagatttcagacaagtgagaagaagtgaagcctcaaagaggtttgaatccagcagtggtctcccaggggtagatgaaaccttaagtcaaggccagtcacagagaccgagcagacaatatgaaacaccctttgaaggcaacttaattaatcaagagatcatgctaaaacggcaagaggaagaactgatgcagctacaagccaaaatggcccttagacagtctcggttgagcctatatccaggagacacaatcaaagcgtccatgcttgacatcaccagggatccgttaagagaaattgccctagaaacagccatgactcaaagaaaactgaggaatttctttggccctgagtttgtgaaaatgacaattgaaccatttatatctttggatttgccacggtctattcttactaagaaagggaagaatgaggataaccgaaggaaagtaaacataatgcttctgaacgggcaaagactggaactgacctgtgataccaaaactatatgtaaagatgtgtttgatatggttgtggcacatattggcttagtagagcatcatttgtttgctttagctaccctcaaagataatgaatatttctttgttgatcctgacttaaaattaaccaaagtggccccagagggatggaaagaagaaccaaagaaaaagaccaaagccactgttaattttactttgtttttcagaattaaattttttatggatgatgttagtctaatacaacatactctgacgtgtcatcagtattaccttcagcttcgaaaagatattttggaggaaaggatgcactgtgatgatgagacttccttattgctggcatccttggctctccaggctgagtatggagattatcaaccagaggttcatggtgtgtcttactttagaatggagcactatttgcccgccagagtgatggagaaacttgatttatcctatatcaaagaagagttacccaaattgcataatacctatgtgggagcttctgaaaaagagacagagttagaatttttaaaggtctgccaaagactgacagaatatggagttcattttcaccgagtgcaccctgagaagaagtcacaaacaggaatattgcttggagtctgttctaaaggtgtccttgtgtttgaagttcacaatggagtgcgcacattggtccttcgctttccatggagggaaaccaagaaaatatctttttctaaaaagaaaatcacattgcaaaatacatcagatggaataaaacatggcttccagacagacaacagtaagatatgccagtacctgctgcacctctgctcttaccagcataagttccagctacagatgagagcaagacagagcaaccaagatgcccaagatattgagagagcttcgtttaggagcctgaatctccaagcagagtctgttagaggatttaatatgggacgagcaatcagcactggcagtctggccagcagcaccctcaacaaacttgctgttcgacctttatcagttcaagctgagattctgaagaggctatcctgctcagagctgtcgctttaccagccattgcaaaacagttcaaaagagaagaatgacaaagcttcatgggaggaaaagcctagagagatgagtaaatcataccatgatctcagtcaggcctctctctatccacatcggaaaaatgtcattgttaacatggaacccccaccacaaaccgttgcagagttggtgggaaaaccttctcaccagatgtcaagatctgatgcagaatctttggcaggagtgacaaaacttaataattcaaagtctgttgcgagtttaaatagaagtcctgaaaggaggaaacatgaatcagactcctcatccattgaagaccctgggcaagcatatgttctaggaatgactatgcatagttctggaaactcttcatcccaagtacccttaaaagaaaatgatgtgctacacaaaagatggagcatagtatcttcaccagaaagggagatcaccttagtgaacctgaaaaaagatgcaaagtatggcttgggatttcaaattattggtggggagaagatgggaagactggacctaggcatatttatcagttcagttgcccctggaggaccagctgacttggatggatgcttgaagccaggagaccgtttgatatctgtgaatagtgtgagtctggagggagtcagccaccatgctgcaattgaaattttgcaaaatgcacctgaagatgtgacacttgttatctctcagccaaaagaaaagatatccaaagtgccttctactcctgtgcatctcaccaatgagatgaaaaactacatgaagaaatcttcctacatgcaagacagtgctatagattcttcttccaaggatcaccactggtcacgtggtaccctgaggcacatctcggagaactcctttgggccatctgggggcctgcgggaaggaagcctgagttctcaagattccaggactgagagtgccagcttgtctcaaagccaggtcaatggtttctttgccagccatttaggtgaccaaacctggcaggaatcacagcatggcagcccttccccatctgtaatatccaaagccaccgagaaagagactttcactgatagtaaccaaagcaaaactaaaaagccaggcatttctgatgtaactgattactcagaccgtggagattcagacatggatgaagccacttactccagcagtcaggatcatcaaacaccaaaacaggaatcttcctcttcagtgaatacatccaacaagatgaattttaaaactttttcttcatcacctcctaagcctggagatatctttgaggttgaactggctaaaaatgataacagcttggggataagtgtcacggtactgtttgacaagggaggtgtgaatacgagtgtcagacatggtggcatttatgtgaaagctgttattccccagggagcagcagagtctgatggtagaattcacaaaggtgatcgcgtcctagctgtcaatggagttagtctagaaggagccacccataagcaagctgtggaaacactgagaaatacaggacaggtggttcatctgttattagaaaagggacaatctccaacatctaaagaacatgtcccggtaaccccacagtgtaccctttcagatcagaatgcccaaggtcaaggcccagaaaaagtgaagaaaacaactcaggtcaaagactacagctttgtcactgaagaaaatacatttgaggtaaaattatttaaaaatagctcaggtctaggattcagtttttctcgagaagataatcttataccggagcaaattaatgccagcatagtaagggttaaaaagctctttcctggacagccagcagcagaaagtggaaaaattgatgtaggagatgttatcttgaaagtgaatggagcctctttgaaaggactatctcagcaggaagtcatatctgctctcaggggaactgctccagaagtattcttgcttctctgcagacctccacctggtgtgctaccggaaattgatactgcgcttttgaccccacttcagtctccagcacaagtacttccaaacagcagtaaagactcttctcagccatcatgtgtggagcaaagcaccagctcagatgaaaatgaaatgtcagacaaaagcaaaaaacagtgcaagtccccatccagaagagacagttacagtgacagcagtgggagtggagaagatgacttagtgacagctccagcaaacatatcaaattcgacctggagttcagctttgcatcagactctaagcaacatggtatcacaggcacagagtcatcatgaagcacccaagagtcaagaagataccatttgtaccatgttttactatcctcagaaaattcccaataaaccagagtttgaggacagtaatccttcccctctaccaccggatatggctcctgggcagagttatcaaccccaatcagaatctgcttcctctagttcgatggataagtatcatatacatcacatttctgaaccaactagacaagaaaactggacacctttgaaaaatgacttggaaaatcaccttgaagactttgaactggaagtagaactcctcattaccctaattaaatcagaaaaaggaagcctgggttttacagtaaccaaaggcaatcagagaattggttgttatgttcatgatgtcatacaggatccagccaaaagtgatggaaggctaaaacctggggaccggctcataaaggttaatgatacagatgttactaatatgactcatacagatgcagttaatctgctccgggctgcatccaaaacagtcagattagttattggacgagttctagaattacccagaataccaatgttgcctcatttgctaccggacataacactaacgtgcaacaaagaggagttgggtttttccttatgtggaggtcatgacagcctttatcaagtggtatatattagtgatattaatccaaggtccgtcgcagccattgagggtaatctccagctattagatgtcatccattatgtgaacggagtcagcacacaaggaatgaccttggaggaagttaacagagcattagacatgtcacttccttcattggtattgaaagcaacaagaaatgatcttccagtggtccccagctcaaagaggtctgctgtttcagctccaaagtcaaccaaaggcaatggttcctacagtgtggggtcttgcagccagcctgccctcactcctaatgattcattctccacggttgctggggaagaaataaatgaaatatcgtaccccaaaggaaaatgttctacttatcagataaagggatcaccaaacttgactctgcccaaagaatcttatatacaagaagatgacatttatgatgattcccaagaagctgaagttatccagtctctgctggatgttgtggatgaggaagcccagaatcttttaaacgaaaataatgcagcaggatactcctgtggtccaggtacattaaagatgaatgggaagttatcagaagagagaacagaagatacagactgcgatggttcacctttacctgagtattttactgaggccaccaaaatgaatggctgtgaagaatattgtgaagaaaaagtaaaaagtgaaagcttaattcagaagccacaagaaaagaagactgatgatgatgaaataacatggggaaatgatgagttgccaatagagagaacaaaccatgaagattctgataaagatcattcctttctgacaaacgatgagctcgctgtactccctgtcgtcaaagtgcttccctctggtaaatacacgggtgccaacttaaaatcagtcattcgagtcctgcggggtttgctagatcaaggaattccttctaaggagctggagaatcttcaagaattaaaacctttggatcagtgtctaattgggcaaactaaggaaaacagaaggaagaacagatataaaaatatacttccctatgatgctacaagagtgcctcttggagatgaaggtggctatatcaatgccagcttcattaagataccagttgggaaagaagagttcgtttacattgcctgccaaggaccactgcctacaactgttggagacttctggcagatgatttgggagcaaaaatccacagtgatagccatgatgactcaagaagtagaaggagaaaaaatcaaatgccagcgctattggcccaacatcctaggcaaaacaacaatggtcagcaacagacttcgactggctcttgtgagaatgcagcagctgaagggctttgtggtgagggcaatgacccttgaagatattcagaccagagaggtgcgccatatttctcatctgaatttcactgcctggccagaccatgatacaccttctcaaccagatgatctgcttacttttatctcctacatgagacacatccacagatcaggcccaatcattacgcactgcagtgctggcattggacgttcagggaccctgatttgcatagatgtggttctgggattaatcagtcaggatcttgattttgacatctctgatttggtgcgctgcatgagactacaaagacacggaatggttcagacagaggatcaatatattttctgctatcaagtcatcctttatgtcctgacacgtcttcaagcagaagaagagcaaaaacagcagcctcagcttctgaagtgacatgaaaagagcctctggatgcatttccatttctctccttaacctccagcagactcctgctctctatccaaaataaagatcacagagcagcaagttcatacaacatgcatgttctcctctatcttagaggggtattcttcttgaaaataaaaaatattgaaatgctgtatttttacagctactttaacctatgataattatttacaaaattttaacactaaccaaacaatgcagatcttagggatgattaaaggcagcatttgatgatagcagacattgttacaaggacatggtgagtctatttttaatgcaccaatcttgtttatagcaaaaatgttttccaatattttaataaagtagttattttataggggatacttgaaaccagtatttaagctttaaatgacagtaatattggcatagaaaaaagtagcaaatgtttactgtatcaatttctaatgtttactatatagaatttcctgtaatatatttatatactttttcatgaaaatggagttatcagttatctgtttgttactgcatcatctgtttgtaatcattatctcactttgtaaataaaaacacaccttaaaacatg

SEQ ID NO: 171612 - DNA, 12985 bp, Homo sapiens
  Payload ID: 13742
  Gene Symbol: PTPN14
  Gene Name: protein tyrosine phosphatase, non-receptor type 14
  Uniprot ID: Q15678
  ENST ID: ENST00000366956
  CDS Start-End: 196-3759
ccgcgcgggactccggggcgccacgggggccatgtaagcagctatcttccagagggccacactgggcatggacacccttttccctgcctggaggagcacaggtgatagtgtaattttccagtcacgaaactgctaaggccatctcaggggcgtgtgcgccaggataggcgggcggcgtccgaggaccacatagccatgccttttggtctgaagctccgccggacacggcgctacaacgtcctgagcaagaactgctttgtcacacggattcgcctgctggacagcaatgttatcgagtgcacgctgtcggtggaaagcacagggcaagaatgcctggaggctgtggcccagaggctggagctgcgagagacgcactactttggcctttggtttctcagcaagagccagcaagcacgatgggtggagctggagaaacctctgaagaaacatctggacaaattcgctaatgagcctttgcttttctttggagtcatgttctatgtgccaaatgtgtcatggcttcagcaagaggccacaagatatcagtattacctgcaagtcaaaaaagatgtgcttgaagggcgattacgatgtacattggaccaggtgattcggctagccggcctagctgtgcaagctgattttggagactataatcagtttgattctcaagatttcctcagagagtatgtgctatttcctatggatttggccctggaagaggctgttctggaggagctgacccagaaggtagcccaagaacacaaagcccacagtggaatcctgccagcagaagctgaactgatgtacatcaatgaagttgaacgtttggatggatttggacaggaaatcttccctgtaaaggacaatcatggaaactgtgtacaccttggcattttctttatggggattttcgtgaggaacagaattggaagacaagcggtaatatacaggtggaatgacatggggaatatcactcataacaagtcgaccattctagtggagctcatcaacaaagaagagactgccctctttcacacggatgatatcgaaaatgccaagtatatttctcggttgtttgccacacgacacaagttttacaaacaaaacaaaatctgcactgaacagtcaaattctccaccccccatcagacgccagcccacctggagccgatcctctctgcccaggcagcagccgtacatcctgcctcccgttcacgtccagtgtggtgagcactactcggaaacgcacacctcgcaagacagcatttttcatgggaatgaagaagccttgtattgcaactctcacaacagcctggacttaaattatttaaatggcactgtcaccaatggcagcgtgtgtagcgttcacagcgtcaactccctcaactgctcgcaaagtttcatccaggcctcccctgtatcctccaacctcagtatccctgggagtgacatcatgcgggccgactacatcccgagccaccggcacagcgcgatcatcgtgccctcgtacaggccaacccccgattatgagacagtcatgcgccagatgaagagggggatcctgcatacagacagccagagccagtctctgagaaacctcaacattatcaacacccatgcctacaaccagccagaggatctggtgtacagccaaccggagatgcgggagaggcacccctacactgtcccttatgggccacagggggtctacagcaacaaacttgtcagtccatctgaccagaggaacccaaagaataatgtggtaccaagcaagccgggggcaagcgccatctcgcacacggtgagcaccccagagctggccaacatgcagctgcagggcagccataactacagcacggcccacatgcttaagaactatctcttcaggccaccgcccccctacccacggccacgacctgccaccagcaccccagacctggccagccaccgccacaagtacgtcagcggcagcagcccggacctggtgacccggaaggtgcagctctcggtgaagaccttccaagaggacagctctccggtggttcatcagtctctccaggaggtgagcgagcccctcacggccaccaagcaccacggcactgtgaacaagcgccacagcctggaggtgatgaacagcatggtgcggggcatggaggccatgacgctcaagtcgctccacctccccatggctcgccgcaacacgctccgggagcagggaccgcccgaggaggggtcaggcagccacgaggtcccccagctccctcagtatcaccacaagaagaccttctctgatgccactatgctaatccacagcagcgagagtgaggaggaggaggaggaggctccagaatcggtgccccagatccccatgctccgggagaagatggagtacagtgcccagctgcaggcggccctggcccgcatccccaacaagcccccgcctgagtaccccggtccaaggaagagtgtgagcaatggggctctgaggcaggaccaagccagccttcctcccgccatggccagagccagggtgctgaggcatgggccagccaaggccatcagcatgtctcggactgacccgccggctgtcaacggggcctctctcggcccatccatctcggaacccgacctgactagtgtgaaggagcgggtcaaaaaagagcctgtgaaggagagacctgtgtctgaaatgttttccctggaagacagcattatagagagagagatgatgatcaggaatctagagaagcagaagatggcaggcctggaggcacagaagaggccgctgatgttggcagcattgaatgggctctcggtggctcgagtctcagggcgggaagagaatcgagttgatgccacccgggttcccatggacgagaggttcagaaccctgaagaagaaactagaagagggaatggtgttcacagaatatgagcaaattccaaagaaaaaggcgaatggcattttcagcacagcagctctgccagaaaacgccgagcgcagccgaatccgtgaagttgtcccctatgaggagaatcgagtagagctgataccaaccaaagaaaataacacaggatacattaatgcctcccacatcaaggtggtggttggcggggcagaatggcactacatagccacccaggggcccctgccacacacgtgccacgacttctggcagatggtgtgggagcagggagtgaatgtgattgccatggtcactgcagaggaggagggtggacgaaccaaaagccaccgatactggcccaaactaggttcaaagcacagctcagccacctatggcaagttcaaggtcaccacgaagtttcgaacggattctgtttgctatgcaaccacgggcttgaaggtcaagcaccttttgtctgggcaagaaaggacggtgtggcatttacaatatactgactggccagatcacggctgtccagaagatgtccaaggatttttatcctacttggaggagatccagtcggtccgtcgccataccaacagcatgctggaaggcaccaagaaccggcacccgcccatcgtggtccactgtagtgctggggtgggaaggaccggcgtgctcattctttctgagctgatgatctactgcttggaacataacgaaaaggtggaagtgcccatgatgctgaggctcctcagggagcagaggatgttcatgatccagactatcgctcagtacaagtttgtctaccaagtcctcatccagttcctccaaaactccagactcatttaatcaccccaatccagctcctggaggagggacccagctccatcgcgctggaggagagtcacctccagacaacatctgctccccccacaggggtgcaggtggctggcagcaaacaggctctctgaagacagtagccaagattattcacacataccatgtattattttatatgagataatttatttttttcccctttggaataacttttgtgaattattataatgcagtttccctagtaatatagtacttttcatttgaaccacatcttgactgatctgtattgtaatatatgtcagcaggtaaggttgcctgctggatcattttgaggacagaggcatgagggagcacatctcttgtgaagttgcagccagatttgtaaccaaccctgaaattcatcagcttaattcatttatcagcttgattcattcatcattcattgcttatatccaaagcaaagacggtaagaaaatgaattcatcctgaaatataaagaaaagggtctgaaggaacaaacacgattctcttatattttggggctcatgagccttgatagacagtttcctctcgtcttcatttccacccctcatcctcagtagtctcctctcccccacgccccaccccaacttcccccccaagcttgagttaaagacagaatagctaaagacagtgctgcctttacaatgcagtaattgccatctttggggccgaaagacaagctctgtgttgtgcttttcttgaccaccccttatcctgggctctggagcttgtgtttccctgctggcgactgtaccttgggtatttgttgctacctctcctgtttgctcagtaggaccctgtctggtggcattgaggctctggaccagaccatctgtgcagttaaggctctaccctgattgagagaggatagcagacctagaaagagaaaggagttgggcagggcctttgaggattgtgtttttcaggcagggccttgatgatcattgttttttatttaaataagatgtgtgtgctggacagagacctaaaagttgaggtcactaagtcattggaaaggccatcaaggaaacagatggggaagctgatttatgggagctgtaaggcatttagctacataacaggggtcctggccaggaaacacatcaaatgtgacccccgctgtgctgatatcatcttcaggctttggtctgcaagatcagaattaatcccactcgggaccccatagtccaaacttggggccacttgatgaacgatggtagaattgtcattggcagagccctgtgcttctttccttttcttcataaaatccactcgctggtcagttatcttcactttgaagcccagttcttagtttcttcctatggcttcattggtcagtgtccttctgaatttccaaggatggtacacaataaatcatgttttgtacttttttcctcttactgcattttgggggatttatcattctatgtctaccttttcttgagtacagctttgatatgcacctgttgttacgtggtgatgggaagtcacaggcgtgctctttctagttaatttgatgccacatcttccttgtcttttcagcttgggaaaaaggcggcagtggaggaaggcatggaatgcccacagtggtcagttcaaagaacaaacgtgcaattaaaaaactgtagtcagccaggcacggtggttcacacctgtaatcccagcactttgaaaggccaaggcgggcagattgcttgagctaaggagttcgagaccagcctgagcaacatgatgaaaccccgtctctacaaaaagtacaaaaattagccaggcgtggtggtatgccctggtagtcccagctgctcgggaggctgaggcaggaggatcacctgattctaagaattcgagactgcagtgagccgtgatcttgccactgtagtccaggctgggctacggagagaccctgcctccaaaaaaaaaaaaaaaaaaggaaaaaaggttgtcaagaaaaactagatgttaggagaaaggaaaatttaattgcagttttttttcttagaattgactgctgtgagagttccatatgcctttcttcattgctgcttttgtcccccgtgagctaaaaagatggagtgacatcaaatcaaccagaaaaagtatgcctttgtgacatcccatcaccacatgccaacaggtatatattccccattaagttcttcggaataggaatcctctgtttcaacctggccaggtgttgtggtggctgtactctagttagactcggaatatctggggatggagggcttcccctgtgtcttctacttcaaggtctgaaggctcagtgaaggagtataatctgctgatctttgtagattctggagttttgttgtatgtcctggaaagaaacccattagtattacatgtattttcagtgaacagagcttataacccttattataagaagctcatcaataagcaaaaagatacttgtttcctttccttggaggtttttccatccttgggatattctgctgttagggatgttttagcaagtggtctcagttactggtttattgcgtgatgaacaacatcagtatttatcttttatctctaagccccaaggtgggcactgttagaatatgtctcatgtggacagcatatagatctggtgcgtctttgaggtcgtcagagctcatgggcttccctgaaattcatccactgtccctgccgtatgctacgggaatattcattagtgtacaaaatgcagggaggaagtaggtttaatattcaactttctagccaaagtttatattgaaacccaaaagaaaacatttaagagttgttccacatatttcacttttaaaaacaaatgcctttggttctttagcacattttgcattccttttcacatctccagtaaatgccaacatatctcctgttaaattagcagcagccatttaaagtcctttcggtggcatctgcataataattgcccagagatgctttatatctgggaagcaagccaaggaataaaccttgaagcaaagtgtattaaattagttatctagttagagcttttggaatgatttcctgatgatgtatcaagtctgaagctggagctgtcagtgtctattgctgcagtttggatttgaagggagaaaatgtaaaatggaggaaaaaaaagttaccatctcacaacaaagccatcaaacattttccagccgctgttttcgaggttttccagttgaactgtttggtttctttcatccacactcatttggatacattgacccgaggtattcatccttgtttactgtggtccctgaatcatgggggctgaatttgatgtcttcatccttgagatgagcctgctggcttagctgaggaatgtcctgctgaggtttcttaggtttccttgggttctaaggatatactggatataccatcttttagcaagagtatctggtagcatttacagatagcatagacattggtatgcacttctttccccagataggaagtaaaggaggatttagttgcatgaaaaaaggatgttaaacattgattacataggagtaaagatgaatgagctgcaatattcagtcggagctaaacaataagatcagggaaggtaaaaatacctatgtggaatattttgaatcgtaagcttttgaggagcttaaattgagagaattttacttttaattttgtagattgagaagaggaaccgctttttaaaattatagctaaactgtcattgttttcctaagagtcacttggccatctctggccccctctttcatcagcctgaagagagggtctttgtagactgctgagggtgggccttgtaggacttgaccatggcttacacctacttaacctttatcctgctttctttcagcttgtgcttttcagttataaactccagtgggtacagcaggctggccttttcatccagctgattatttttccagcttaatatagattgacccatatgaaatttccaataatggaccatattttctgcaaatagacagtactcgcatggatcacctatatcttccccctgatacactgtgggtcccaacaccagatgtcatttctccagagcagtgctaatgaacacaaaaggtataccctgggtggcccagctcttttcacgaacgtgctgccctgctcatagtgatccttgcatcacttggtgaatgggccatctcctgggacatggaagttgcagaggtagatagtgcactgcagcttctcttaagccggattggccatcaggcatatcactctggagtttttagctgctgtcctttcccgatgaacagtctgtattagctgacctcagcctacttgttacgtgacgtatgggtcccaaaagtgtcctttgtcaaaaagcagaatgtgccttctagtctccctttccccatctaatggtgtattcgatggtgaagatgagtacagttgaccacccctatctgtgggttccacatccctatattcaaccaagtacagattgaaaaatatttggggaagaggggaaacccacaaagttccaaaaagcaaaagttgaatttgccacatgctgaatactacattgaattcacacaaatgaagtgatgtgtaggcattgagttaggtattgtaaataatctagagatgatttaaagtatgcaagagatgtgcataggttatatgcaaatactgtgctattttatataaaagacttgaacatccatggattctggtattctcagagggtccttgattgccccctttggtaaaggacaactatttcgttactgattttcgtttggggaagatctgtcaatcccttgaggtgcgggggttggggggatggagggtacagggcattctaggatgtgtgccagggagcacagattcaagggatgggattgagtcagacctgtgttcttactcagtgtcagaaataactctgtggagctcctagagtaagacatttccggaagcaccacataattactgttgggctcttagggtagcccttttagggaattgagcattcccatgttttaccaacaattattctgctgctgtgttttattatattgccaatggttttgagacactcatcatgctcttatttagtgatttcttttcatgagcagagcaacagctcatccagcatggtttccaaatggagaaatttgggtcttctgtagaaaccacacaaattctccaatggcctacagccttatggttggcacactagttggccctatagggtggaaataaagctgtaagatgttaaactgcatttgatacttctcttgaacgctgagcaaggaagcaaaatagttcttgtctttacttaagcttctaagacattttggggcaaaggaccttacagatggcgtctgttgaaagtaacagcaacgtgccagggagaaatgtgggggaaatctcatcaaattctgccacctcaaatgtgttgtccagaagtcagtgttattcagggggccctgtgaaacttgaccaccagcttgcgccatcaacactcagcctttatccagcctgctctcagcttttgtgtttctgttagaaactcagataggtaagtatttttattcagtagactacctttcttatcttttcagcttaatatagctgcatcttctttctcaaagccaaactaagatattctctattaaaatgtccatgagcctagcattgagtgtctggcatccatcaatttcatagactggaaaatgattgttgtttggtacagtaaagaagaggatgtgcatcagttcctaccgtttgcagctttgtttttagccttcccattttaaaaataaattcaaggacattgagttacaaggcaggagggctggagctactgggcagcctgaatatgacaagcatttgtgtggaaagtcattgctccttctgccacactttgggccatcaggatcattctttcccagaagtgccataaacttgctcaaaagtttctataaatgggaagagggagaggaaggatttttgcatcagtcctgaagttgctatccaaaagttctctgtttcacaaataattttctgaactctggaatgcctctcctactccctgcctccctttctgtaatgtcagagtgatggaaaccaccaagtggcatgctagggaaagcctgcagcagtgttggagtctatttcaccctagctcatagttttaaactgtcttcactgttgaggtagagcttgatgaatgtcatggattatgatgtgtggtttatcatatttgcctggatttgctgatcaaaagcaccatcttccctcgcctgctgctggcagcctttccttgccttgcttgttagcagagcattctgcttacccatgtggctcccagagttagcagccccggctcttggatttcttgattcttctcccctgtgatctcagaggtgctgcagaggacattcccctttagagcaagtcatgtttctattcaggccacaaaactgggatgtacatgcagtgactttggtgttccttgtcttgttcaggggaacgggtgggactgttgtgtgctgtcaccctcttcattccatgagcaccttgttcacttagggtctgctgcctttttttttttctttttctttttttttttttttttagtttttgagatcgtgtctcactcctgttgcgcaggctggagtgcagcctccaaagtagctgggattataggcgtgcaccaccacacccggctaatttttatatttttagtagagacggggttttgccatgttggccagactggtctcaaacctctgacctcgtgatgacccccctcggcctcccaaagtgctgggattacacccagcctctgctgccttttcatatttccccatctgctttatggatcaactctcaacagtacactttttcttttctttacctaccctatgagtgcaacccagatgtaagagttaatcctcgtcagagaatcattgccttaaacctctcagaaatatgtaattaggaaatcttattttaattttttaaaaattgcttgtatagtttcaaagaataagatctggcaaatggccagatgtggtggctcacacctgtaatcaaaccagcactttgggaggctgaggcaggcagatcacctgaggtcaggcgttcaagaccagcctggccaacatggtgaaatcccgtctctactaaaaatacaaaaaaaaaaaaaaaaaaaaaaattagccaggcatggtggcacatgcctgtaatcccagctactcaggaggctgaggcaggataattgcttgaacccgggaggtggaggttgcagtgagccgagatcatgccactgcactccagcctgggcaacagagtgagactttgtctcaaaaaaaaaaaaaaaaaaaaaaaaagatctggcggatgaaaataaccagaatgaaaatagctagaaaactcagcaagcaggaagctccctttctcacccttttgttcccttgccgatagaatcagtcactattagaaaaaatgaaagacgctctgtttaaaacaatgatgacagcagtacttaatatgtatttcgaggtgaacttatatagattgagagaggctgcatttggcagactgatgtataggaagacccatttgtttctagcttctccctgcagggaaaatgctttcgtcattatagcctctttacacagactggccattctagtgaaacaggtggtaaacctttgggctgcccagaaacattttatctgttttcacttacctaggaaggggaaagattagcgggtcatccaaaatctgtatgtaagctatcttcattttcttccccaaccttctcctcctgggaaacacaaatgctatctcatctgacaaaaggttttagaggataaagctgaaaagattggattgggatctttttgtggcttggggcggagccttttgctaaaatctcaagaatgctgctttgagtttagctagggtggctctcagaactggggtgcctggcattctcagcatttctcaggggcctcccacctctgacaactgcagtgttagctaatacataccttgagcatagaactgaatgctgtaattcagagccattttttttttcaacttgaacattgtacaattttactgcaatttcctttgaactttcttgccactgtttggaatcttaaaaattcattagccttctcctttctgacataaagctactcttcatcagagatgagttcctatgtatgtcctttgttccttcaatagctaattaatgtgcttgaggatacttcagtggaaaaaaaggtttaaatatgcaaattactaataaatgtgtaaccttatgtaacttgtgttacatcaagtaacaagctaatctagtttgtttcactggactaggcttgtgctccctacttcagtattttgatgctttccttgatctttgtttcacaaaatgttgtgaattttggtatcattcaaaacaaatgacatttattaggtttcattttgaaacgatgtacagacaagtccccaacttagaaaccggtttgttcttaaggttcttgcgtcagcccatagaagcccactgacctccaccacagcccaaatggagggctgtgatagccagatctggttggcttttgtgggctgacccagacatttaatcaccatctcttatgttgttgccgtaagaaatgcattccaggttgggacttgggatcctgagagcacattcgccccctgtggtggccgcttgccaccttgcaagatggaagcccagtctccttactaccaaactgtagttgtaagcagagggaggggtgagatgtttataggacattccctaagctggggagtgatttttatcactattcatgtcaactgtactttggtatagactccctatcaatttaataatatgaaaagcctaaaataaaactatgcatgctattctatgtgctattttatatcagtaaataagcttatgcttgccagttgtatacacagttatgaggtgtatagaactgactttgacagtattttttgcactgtttcctatctgtttttataaagtcttatttagatattggaccttgttgatgttctcactgcccttgtgcttgctataaaatgtttcatatgtgcctttacaaatgtgagatctttattctaacctttttttgtaaaagatatctattgatttccatatgcaataaacctttttttcagagaaaagtta

SEQ ID NO: 171613 - DNA, 3842 bp, Homo sapiens
  Payload ID: 13742
  Gene Symbol: PTPN14
  Gene Name: protein tyrosine phosphatase, non-receptor type 14
  ENST ID: ENST00000543945
  CDS Start-End: 196-831
ccgcgcgggactccggggcgccacgggggccatgtaagcagctatcttccagagggccacactgggcatggacacccttttccctgcctggaggagcacaggtgatagtgtaattttccagtcacgaaactgctaaggccatctcaggggcgtgtgcgccaggataggcgggcggcgtccgaggaccacatagccatgccttttggtctgaagctccgccggacacggcgctacaacgtcctgagcaagaactgctttgtcacacggattcgcctgctggacagcaatgttatcgagtgcacgctgtcggtggaaagcacagggcaagaatgcctggaggctgtggcccagaggctggagctgcgagagacgcactactttggcctttggtttctcagcaagagccagcaagcacgatgggtggagctggagaaacctctgaagaaacatctggacaaattcgctaatgagcctttgcttttctttggagtcatgttctatgtgccaaatgtgtcatggcttcagcaagaggccacaagatatcagtattacctgcaagtcaaaaaagatgtgcttgaagggcgattacgatgtacattggaccaggtgattcggctagccggcctagctgtgcaagctgattttggagactataatcagtttgattctcaagatttcctcagagagtatgtgctatttcctatggatttggccctggaagaggctgttctggaggagctgacccagaaggtagcccaagaacacaaagcccacaggacaatcatggaaactgtgtacaccttggcattttctttatggggattttcgtgaggaacagaattggaagacaagcggtaatatacaggtggaatgacatggggaatatcactcataacaagtcgaccattctagtggagctcatcaacaaagaagagactgccctctttcacacggatgatatcgaaaatgccaagtatatttctcggttgtttgccacacgacacaagttttacaaacaaaacaaaatctgcactgaacagtcaaattctccaccccccatcagacgccagcccacctggagccgatcctctctgcccaggcagcagccgtacatcctgcctcccgttcacgtccagtgtggtgagcactactcggaaacgcacacctcgcaagacagcatttttcatgggaatgaagaagccttgtattgcaactctcacaacagcctggacttaaattatttaaatggcactgtcaccaatggcagcgtgtgtagcgttcacagcgtcaactccctcaactgctcgcaaagtttcatccaggcctcccctgtatcctccaacctcagtatccctgggagtgacatcatgcgggccgactacatcccgagccaccggcacagcgcgatcatcgtgccctcgtacaggccaacccccgattatgagacagtcatgcgccagatgaagagggggatcctgcatacagacagccagagccagtctctgagaaacctcaacattatcaacacccatgcctacaaccagccagaggatctggtgtacagccaaccggagatgcgggagaggcacccctacactgtcccttatgggccacagggggtctacagcaacaaacttgtcagtccatctgaccagaggaacccaaagaataatgtggtaccaagcaagccgggggcaagcgccatctcgcacacggtgagcaccccagagctggccaacatgcagctgcagggcagccataactacagcacggcccacatgcttaagaactatctcttcaggccaccgcccccctacccacggccacgacctgccaccagcaccccagacctggccagccaccgccacaagtacgtcagcggcagcagcccggacctggtgacccggaaggtgcagctctcggtgaagaccttccaagaggacagctctccggtggttcatcagtctctccaggaggtgagcgagcccctcacggccaccaagcaccacggcactgtgaacaagcgccacagcctggaggtgatgaacagcatggtgcggggcatggaggccatgacgctcaagtcgctccacctccccatggctcgccgcaacacgctccgggagcagggaccgcccgaggaggggtcaggcagccacgaggtcccccagctccctcagtatcaccacaagaagaccttctctgatgccactatgctaatccacagcagcgagagtgaggaggaggaggaggaggctccagaatcggtgccccagatccccatgctccgggagaagatggagtacagtgcccagctgcaggcggccctggcccgcatccccaacaagcccccgcctgagtaccccggtccaaggaagagtgtgagcaatggggctctgaggcaggaccaagccagccttcctcccgccatggccagagccagggtgctgaggcatgggccagccaaggccatcagcatgtctcggactgacccgccggctgtcaacggggcctctctcggcccatccatctcggaacccgacctgactagtgtgaaggagcgggtcaaaaaagagcctgtgaaggagagacctgtgtctgaaatgttttccctggaagacagcattatagagagagagatgatgatcaggaatctagagaagcagaagatggcaggcctggaggcacagaagaggccgctgatgttggcagcattgaatgggctctcggtggctcgagtctcagggcgggaagagaatcgagttgatgccacccgggttcccatggacgagaggttcagaaccctgaagaagaaactagaagagggaatggtgttcacagaatatgagcaaattccaaagaaaaaggcgaatggcattttcagcacagcagctctgccagaaaacgccgagcgcagccgaatccgtgaagttgtcccctatgaggagaatcgagtagagctgataccaaccaaagaaaataacacaggatacattaatgcctcccacatcaaggtggtggttggcggggcagaatggcactacatagccacccaggggcccctgccacacacgtgccacgacttctggcagatggtgtgggagcagggagtgaatgtgattgccatggtcactgcagaggaggagggtggacgaaccaaaagccaccgatactggcccaaactaggttcaaagcacagctcagccacctatggcaagttcaaggtcaccacgaagtttcgaacggattctgtttgctatgcaaccacgggcttgaaggtcaagcaccttttgtctgggcaagaaaggacggtgtggcatttacaatatactgactggccagatcacggctgtccagaagatgtccaaggatttttatcctacttggaggagatccagtcggtccgtcgccataccaacagcatgctggaaggcaccaagaaccggcacccgcccatcgtggtccactgtagtgctggggtgggaaggaccggcgtgctcattctttctgagctgatgatctactgcttggaacataacgaaaaggtggaagtgcccatgatgctgaggctcctcagggagcagaggatgttcatgatccagactatcgctcagtacaagtttgtctaccaagtcctcatccagttcctccaaaactccagactcatttaatcaccccaatccagctcctggaggagggacccagctccatcgcgctggaggagagtcacctccagacaacatctgctccccccacaggggtgcaggtggctggcagcaaacaggctctctgaagacagtagccaagattattcacacataccatgtattattttatatgag

SEQ ID NO: 171614 - DNA, 3669 bp, Homo sapiens
  Payload ID: 13743
  Gene Symbol: PTPN18
  Gene Name: protein tyrosine phosphatase, non-receptor type 18 (brain-derived)
  Uniprot ID: Q99952
  ENST ID: ENST00000175756
  CDS Start-End: 102-1484
gaggcaagggcggggactcagtcaccggcctccgcctcccgcggcgtccacactcgccgcgcgcgcggcggccgggctggaccttgctggcccgcggcgccatgagccgcagcctggactcggcgcggagcttcctggagcggctggaagcgcggggcggccgggagggggcagtcctcgccggcgagttcagcgacatccaggcctgctcggccgcctggaaggctgacggcgtgtgctccaccgtggccggcagtcggccagagaacgtgaggaagaaccgctacaaagacgtgctgccttatgatcagacgcgagtaatcctctccctgctccaggaagagggacacagcgactacattaatggcaacttcatccggggcgtggatggaagcctggcctacattgccacgcaaggacccttgcctcacaccctgctagacttctggagactggtctgggagtttggggtcaaggtgatcctgatggcctgtcgagagatagagaatgggcggaaaaggtgtgagcggtactgggcccaggagcaggagccactgcagactgggcttttctgcatcactctgataaaggagaagtggctgaatgaggacatcatgctcaggaccctcaaggtcacattccagaaggagtcccgttctgtgtaccagctacagtatatgtcctggccagaccgtggggtccccagcagtcctgaccacatgctcgccatggtggaggaagcccgtcgcctccagggatctggccctgaacccctctgtgtccactgcagtgcgggttgtgggcgaacaggcgtcctgtgcaccgtggattatgtgaggcagctgctcctgacccagatgatcccacctgacttcagtctctttgatgtggtccttaagatgaggaagcagcggcctgcggccgtgcagacagaggagcagtacaggttcctgtaccacacggtggctcagatgttctgctccacactccagaatgccagcccccactaccagaacatcaaagagaattgtgccccactctacgacgatgccctcttcctccggactccccaggcacttctcgccataccccgcccaccaggaggggtcctcaggagcatctctgtgcccgggtccccgggccacgccatggctgacacctacgcggtggtgcagaagcgcggggctccagcgggcgccgggagtgggacgcagacggggacggggacggggacgggggcgcgcagcgcggaggaggcgccgctctacagcaaggtgacgccgcgcgcccagcgacccggggcgcacgcggaggacgcgagggggacgctgcctggccgcgttcctgctgaccaaagtcctgccggatctggcgcctacgaggacgtggcgggtggagctcagaccggtgggctaggtttcaacctgcgcattgggaggccgaagggtccccgggacccgcctgctgagtggacccgggtgtaagtctaacgccagttcctgcctgttgcctcttgtgagctcggactgctgatgccccggtgctgctgagcgccgtgcgcagaatggaaacagtgggcctggatcaaagttaaagtttctcagggtgggaaatgtgggggctttgccccaatgactgtagcattcaaggcttgaggctggaggaggtagctagggtatagtggctggtgaggctgcacagagcagattcaagaaagaagatcaggaaggggcatgacccctgagttatgaaggggagaagggacagatgagcttccggagactgctctcctcaccacacagcactagtccatcctcagcacctgagcctccctcacttggacactcaggggaccacacagagaagtggatggacacttcgccatccaggcagaactaagccaggcataaccacagccaagcagattaaccccaggcagaccgataaaaagacctccagataggcagacagacagatggaccaccaacctggacagacagccaaagcttcagagatacagtccacaggtggacaaagggatccccagccagagagagagagaccagccaacagcttgatagaccagtgcagccagagagaccaccaaacagagcccccaaaagacagacatctctgctagctggacagccaggtggaccccctaagttagattactagacagatataaacagatcccctgctgaacagatacacagagttctcagaccccacccccaccctcaggtgggctggctggctgacagaccttctggccagacagactcctaaccaaccagatggactgccagacaggcagacatcagccacatggaatcctgacatcccagccagccggccagactctcatcttgatgtcttgatggatggaccccagctagtcagacatgatcctccagattgacagacaagtcccccaaatgagtacacatctccagctattcagacagatggacccccagcaaatcaggacctatctaggcagaccccagccagacccccgccagacagactcccaaccagactgaccccttactattcacacagcctgccgagtagctgggactacaggtctaattttttttttttttaagaaatgagtttttgccatgttgcccagactggtcttgaactcccaacctcaagcaatcctcctgcctcagcctcccaaagtgctgagattacaggtgtgagccaccaggctcagccccctaagatttgaaacactttaaatggcccatggtagggttcctgctaggataaaacattaagcggctgttaaaagaaataaaaggaggacacgtctctgtgcactggtgtggacaaatctccaagtcactgcaaaatggaaaaagtataagatgctctttccctgaacctcaagggtcccgcccctctcactttcaggtctctggacctctgactgacactgtgcctgcccaggtccctgtatgcactgccacagtgccctgggccccatgtccacccctgtcctgcccttctctgggatagggctggccttcctctgcctctgcctggctgcatccatggtcgatctcaagtgccttggcatgaactccactctcctgcagccttcaatcaaggaatgatggggatgtgtacataccccaccccaccccttggcagggtgatgctgaggtgtggatttttaacagttcccagactttcccaggaggcttgggtttgggtgcccacagtgggagctggtgtgatatcataccttcgccggccgcctttccttcctgttctctgtgcccctactcccactctagagctgccccgtttctctgttttcgtgaaagagctgaccctgtgctgcctcccactctcccaatgcccctgccactcctgtgagcctgctgctggtgaggtcggtgctgacctctgtgttgctggataatgagtcatctatctctggaggagaagaaaggcaggtcctccacagccctgataaaatctccaagtctcccagtttcgggtccctctcctgggatgcagacccactgcctgcccagctggtacgatccacatgccctcttcttgggaataggggcatgggaaagtgactaaagatactgttctggctgctgtgttcactgtgagtaataaactgtccatttctccgattca

SEQ ID NO: 171615 - DNA, 2472 bp, Homo sapiens
  Payload ID: 13743
  Gene Symbol: PTPN18
  Gene Name: protein tyrosine phosphatase, non-receptor type 18 (brain-derived)
  Uniprot ID: Q99952
  ENST ID: ENST00000347849
  CDS Start-End: 64-1125
ccgcggcgtccacactcgccgcgcgcgcggcggccgggctggaccttgctggcccgcggcgccatgagccgcagcctggactcggcgcggagcttcctggagcggctggaagcgcggggcggccgggagggggcagtcctcgccggcgagttcagcaaaaggtgtgagcggtactgggcccaggagcaggagccactgcagactgggcttttctgcatcactctgataaaggagaagtggctgaatgaggacatcatgctcaggaccctcaaggtcacattccagaaggagtcccgttctgtgtaccagctacagtatatgtcctggccagaccgtggggtccccagcagtcctgaccacatgctcgccatggtggaggaagcccgtcgcctccagggatctggccctgaacccctctgtgtccactgcagtgcgggttgtgggcgaacaggcgtcctgtgcaccgtggattatgtgaggcagctgctcctgacccagatgatcccacctgacttcagtctctttgatgtggtccttaagatgaggaagcagcggcctgcggccgtgcagacagaggagcagtacaggttcctgtaccacacggtggctcagatgttctgctccacactccagaatgccagcccccactaccagaacatcaaagagaattgtgccccactctacgacgatgccctcttcctccggactccccaggcacttctcgccataccccgcccaccaggaggggtcctcaggagcatctctgtgcccgggtccccgggccacgccatggctgacacctacgcggtggtgcagaagcgcggggctccagcgggcgccgggagtgggacgcagacggggacggggacggggacgggggcgcgcagcgcggaggaggcgccgctctacagcaaggtgacgccgcgcgcccagcgacccggggcgcacgcggaggacgcgagggggacgctgcctggccgcgttcctgctgaccaaagtcctgccggatctggcgcctacgaggacgtggcgggtggagctcagaccggtgggctaggtttcaacctgcgcattgggaggccgaagggtccccgggacccgcctgctgagtggacccgggtgtaagtctaacgccagttcctgcctgttgcctcttgtgagctcggactgctgatgccccggtgctgctgagcgccgtgcgcagaatggaaacagtgggcctggatcaaagttaaagtttctcagggtgggaaatgtgggggctttgccccaatgactgtagcattcaaggcttgaggctggaggaggtagctagggtatagtggctggtgaggctgcacagagcagattcaagaaagaagatcaggaaggggcatgacccctgagttatgaaggggagaagggacagatgagcttccggagactgctctcctcaccacacagcactagtccatcctcagcacctgagcctccctcacttggacactcaggggaccacacagagaagtggatggacacttcgccatccaggcagaactaagccaggcataaccacagccaagcagattaaccccaggcagaccgataaaaagacctccagataggcagacagacagatggaccaccaacctggacagacagccaaagcttcagagatacagtccacaggtggacaaagggatccccagccagagagagagagaccagccaacagcttgatagaccagtgcagccagagagaccaccaaacagagcccccaaaagacagacatctctgctagctggacagccaggtggaccccctaagttagattactagacagatataaacagatcccctgctgaacagatacacagagttctcagaccccacccccaccctcaggtgggctggctggctgacagaccttctggccagacagactcctaaccaaccagatggactgccagacaggcagacatcagccacatggaatcctgacatcccagccagccggccagactctcatcttgatgtcttgatggatggaccccagctagtcagacatgatcctccagattgacagacaagtcccccaaatgagtacacatctccagctattcagacagatggacccccagcaaatcaggacctatctaggcagaccccagccagacccccgccagacagactcccaaccagactgaccccttactattcacacagcctgccgagtagctgggactacaggtctaattttttttttttttaagaaatgagtttttgccatgttgcccagactggtcttgaactcccaacctcaagcaatcctcctgcctcagcctcccaaagtgctgagattacaggtgtgagccaccaggctcagccccctaagatttgaaacactttaaatggcccatggtagggttcctgctaggataaaacattaagcggctgttaaaagaaataaaaggaggacacgtctctgtgca

SEQ ID NO: 171616 - DNA, 993 bp, Homo sapiens
  Payload ID: 13743
  Gene Symbol: PTPN18
  Gene Name: protein tyrosine phosphatase, non-receptor type 18 (brain-derived)
  ENST ID: ENST00000409022
  CDS Start-End: 1-808
agaccgtggggtccccagcagtcctgaccacatgctcgccatggtggaggaagcccgtcgcctccagggatctggccctgaacccctctgtgtccactgcagtgcgggttgtgggcgaacaggcgtcctgtgcaccgtggattatgtgaggcagctgctcctgacccagatgatcccacctgacttcagtctctttgatgtggtccttaagatgaggaagcagcggcctgcggccgtgcagacagaggagcagtacaggttcctgtaccacacggtggctcagatgttctgctccacactccagaatgccagcccccactaccagaacatcaaagagaattgtgccccactctacgacgatgccctcttcctccggactccccaggcacttctcgccataccccgcccaccaggaggggtcctcaggagcatctctgtgcccgggtccccgggccacgccatggctgacacctacgcggtggtgcagaagcgcggggctccagcgggcgccgggagtgggacgcagacggggacggggacggggacgggggcgcgcagcgcggaggaggcgccgctctacagcaaggtgacgccgcgcgcccagcgacccggggcgcacgcggaggacgcgagggggacgctgcctggccgcgttcctgctgaccaaagtcctgccggatctggcgcctacgaggacgtggcgggtggagctcagaccggtgggctaggtttcaacctgcgcattgggaggccgaagggtccccgggacccgcctgctgagtggacccgggtgtctctggacctctgactgacactgtgcctgcccaggtccctgtatgcactgccacagtgccctgggccccatgtccacccctgtcctgcccttctctgggatagggctggccttcctctgcctctgcctggctgcatccatggtcgatctcaagtgccttggcatgaactccactctcctgcagccttcaatcaaggaat

SEQ ID NO: 171617 - DNA, 785 bp, Homo sapiens
  Payload ID: 13743
  Gene Symbol: PTPN18
  Gene Name: protein tyrosine phosphatase, non-receptor type 18 (brain-derived)
  ENST ID: ENST00000428843
  CDS Start-End: 43-189
cgcgcgcggcggccgggctggaccttgctggcccgcggcgccatgagccgcagcctggactcggcgcggagcttcctggagcggctggaagcgcggggcggccgggagggggcagtcctcgccggcgagttcagcgaaggaaggggctgcagcagggcgaagaggaacacggaggctgtggcgtggtgagggacatccaggcctgctcggccgcctggaaggctgacggcgtgtgctccaccgtggccggcagtcggccagagaacgtgaggaagaaccgctacaaagacgtgctgccttatgatcagacgcgagtaatcctctccctgctccaggaagagggacacagcgactacattaatggcaacttcatccggggcgtggatggaagcctggcctacattgccacgcaaggacccttgcctcacaccctgctagacttctggagactggtctgggagtttggggtcaaggtgatcctgatggcctgtcgagagatagagaatgggcggaaaaggtgtgagcggtactgggcccaggagcaggagccactgcagactgggcttttctgcatcactctgataaaggagaagtggctgaatgaggacatcatgctcaggaccctcaaggtcacattccagaaggagtcccgttctgtgtaccagctacagtatatgtcctggccagaccgtggggtccccagcagtcctgaccacatgctcgccatggtggaggaagcccgtcgcctccagggatctggccctgaacccctctgtgtccactgc

SEQ ID NO: 171618 - DNA, 3467 bp, Homo sapiens
  Payload ID: 13744
  Gene Symbol: PTPN2
  Gene Name: protein tyrosine phosphatase, non-receptor type 2
  Uniprot ID: P17706
  ENST ID: ENST00000309660
  CDS Start-End: 95-1342
atgcgccgcagcgccagcgctctccccggatcgtgcggggcctgagcctctccgccggcgcaggctctgctcgcgccagctcgctcccgcagccatgcccaccaccatcgagcgggagttcgaagagttggatactcagcgtcgctggcagccgctgtacttggaaattcgaaatgagtcccatgactatcctcatagagtggccaagtttccagaaaacagaaatcgaaacagatacagagatgtaagcccatatgatcacagtcgtgttaaactgcaaaatgctgagaatgattatattaatgccagtttagttgacatagaagaggcacaaaggagttacatcttaacacagggtccacttcctaacacatgctgccatttctggcttatggtttggcagcagaagaccaaagcagttgtcatgctgaaccgcattgtggagaaagaatcggttaaatgtgcacagtactggccaacagatgaccaagagatgctgtttaaagaaacaggattcagtgtgaagctcttgtcagaagatgtgaagtcgtattatacagtacatctactacaattagaaaatatcaatagtggtgaaaccagaacaatatctcactttcattatactacctggccagattttggagtccctgaatcaccagcttcatttctcaatttcttgtttaaagtgagagaatctggctccttgaaccctgaccatgggcctgcggtgatccactgtagtgcaggcattgggcgctctggcaccttctctctggtagacacttgtcttgttttgatggaaaaaggagatgatattaacataaaacaagtgttactgaacatgagaaaataccgaatgggtcttattcagaccccagatcaactgagattctcatacatggctataatagaaggagcaaaatgtataaagggagattctagtatacagaaacgatggaaagaactttctaaggaagacttatctcctgcctttgatcattcaccaaacaaaataatgactgaaaaatacaatgggaacagaataggtctagaagaagaaaaactgacaggtgaccgatgtacaggactttcctctaaaatgcaagatacaatggaggagaacagtgagagtgctctacggaaacgtattcgagaggacagaaaggccaccacagctcagaaggtgcagcagatgaaacagaggctaaatgagaatgaacgaaaaagaaaaaggtggttatattggcaacctattctcactaagatggggtttatgtcagtcattttggttggcgcttttgttggctggacactgttttttcagcaaaatgccctataaacaattaattttgcccagcaagcttctgcactagtaactgacagtgctacattaatcataggggtttgtctgcagcaaacgcctcatatcccaaaaacggtgcagtagaatagacatcaaccagataagtgatatttacagtcacaagcccaacatctcaggactcttgactgcaggttcctctgaaccccaaactgtaaatggctgtctaaaataaagacattcatgtttgttaaaaactggtaaattttgcaactgtattcatacatgtcaaacacagtatttcacctgaccaacattgagatatcctttatcacaggatttgtttttggaggctatctggattttaacctgcacttgatataagcaataaatattgtggttttatctacgttattggaaagaaaatgacatttaaataatgtgtgtaatgtataatgtactattgacatgggcatcaacacttttattcttaagcatttcagggtaaatatattttataagtatctatttaatcttttgtagttaactgtactttttaagagctcaatttgaaaaatctgttactaaaaaaataaattgtatgtcgattgaattgtactggatacattttccatttttctaaagagaagtttgatatgagcagttagaagttggaataagcaatttctactatatattgcatttcttttatgttttacagttttccccattttaaaaagaaaagcaaacaaagaaacaaaagtttttcctaaaaatatctttgaaggaaaattctccttactgggatagtcaggtaaacagttggtcaagactttgtaaagaaattggtttctgtaaatcccattattgatatgtttatttttcatgaaaatttcaatgtagttggggtagattatgatttaggaagcaaaagtaagaagcagcattttatgattcataatttcagtttactagactgaagttttgaagtaaacacttttcagtttctttctacttcaataaatagtatgattatatgcaaaccttacattgtcattttaacttaatgaatattttttaaagcaaactgtttaatgaatttaactgctcatttgaatgctagctttcctcagatttcaacattccattcagtgtttaatttgtcttacttaaacttgaaattgttgttacaaatttaattgctaggaggcatggatagcatacattattatggatagcataccttatttcagtggttttcaaactatgctcattggatgtccaggtgggtcaagaggttactttcaaccacagcatctctgccttgtctctttatatgccacataagatttctgcataaggcttaagtattttaaagggggcagttatcatttaaaaacagtttggtcgggcgcggtggctcatgcctgtaatcccagcactttgggaggctgaagtgggcagatcacctgaggtcaggagttcaagaccagcctggccaacgtggtgaaacaccatctctactaaaaatgcaaaaattagctgggcatggtggagggcacctgtaatctcagctactcaggaggctgaggtaggagaattgcttgaacccaggagatggaggttgcagtgagctgagatcacgtcactgcactccagccagggcgacagagcgagactccatctcaaaagaaacaaacaaaaaaaacagtttgggccgggtgtggtggctcacgcttgtaatcccagcacttcggaaggccaaggcgggcggatcacgaggtcaagagatggagactgtcctggccaacatggtgaaatcccttctttactaaaaatacaaaaattatctgggcgtggtggtgcatgcctgtagtcccagctccttgggaggctaaggcaggagaatcacttgaacccgggaggcagaggttgcagtgagccgagattgcaccactgcactccagcctggcaacagagcaagacttcgtctcaaaaaaaaaaaaaaaaaaagtttgaaaaccattggtatagatagatattttgaattgatttgcatagtctccttgaatgtgttaaattatgttgaaagtatgaaagcaggatgtaggtggtactacatattaaataagatttatataac

SEQ ID NO: 171619 - DNA, 1706 bp, Homo sapiens
  Payload ID: 13744
  Gene Symbol: PTPN2
  Gene Name: protein tyrosine phosphatase, non-receptor type 2
  Uniprot ID: P17706
  ENST ID: ENST00000327283
  CDS Start-End: 198-1361
cgcgctcgggcgccgagtctgcgcgctgacgtccgacgctccaggtactttccccacggccgacagggcttggcgtgggggcggggcgcggcgcgcagcgcgcatgcgccgcagcgccagcgctctccccggatcgtgcggggcctgagcctctccgccggcgcaggctctgctcgcgccagctcgctcccgcagccatgcccaccaccatcgagcgggagttcgaagagttggatactcagcgtcgctggcagccgctgtacttggaaattcgaaatgagtcccatgactatcctcatagagtggccaagtttccagaaaacagaaatcgaaacagatacagagatgtaagcccatatgatcacagtcgtgttaaactgcaaaatgctgagaatgattatattaatgccagtttagttgacatagaagaggcacaaaggagttacatcttaacacagggtccacttcctaacacatgctgccatttctggcttatggtttggcagcagaagaccaaagcagttgtcatgctgaaccgcattgtggagaaagaatcggttaaatgtgcacagtactggccaacagatgaccaagagatgctgtttaaagaaacaggattcagtgtgaagctcttgtcagaagatgtgaagtcgtattatacagtacatctactacaattagaaaatatcaatagtggtgaaaccagaacaatatctcactttcattatactacctggccagattttggagtccctgaatcaccagcttcatttctcaatttcttgtttaaagtgagagaatctggctccttgaaccctgaccatgggcctgcggtgatccactgtagtgcaggcattgggcgctctggcaccttctctctggtagacacttgtcttgttttgatggaaaaaggagatgatattaacataaaacaagtgttactgaacatgagaaaataccgaatgggtcttattcagaccccagatcaactgagattctcatacatggctataatagaaggagcaaaatgtataaagggagattctagtatacagaaacgatggaaagaactttctaaggaagacttatctcctgcctttgatcattcaccaaacaaaataatgactgaaaaatacaatgggaacagaataggtctagaagaagaaaaactgacaggtgaccgatgtacaggactttcctctaaaatgcaagatacaatggaggagaacagtgagagtgctctacggaaacgtattcgagaggacagaaaggccaccacagctcagaaggtgcagcagatgaaacagaggctaaatgagaatgaacgaaaaagaaaaaggccaagattgacagacacctaatattcatgacttgagaatattctgcagctataaattttgaaccattgatgtgcaaagcaagacctgaagcccactccggaaactaaagtgaggctcgctaaccctctagattgcctcacagttgtttgtttacaaagtaaactttacatccaggggatgaagagcacccaccagcagaagactttgcagaacctttaattggatgtgttaagtgtttttaatgagtgtatgaaatgtagaaagatgtacaagaaataaattaggggagattactttgtattgtactgccattcctactgtatttttatactttttggcagcattaaatatttttgttaaatagtc

SEQ ID NO: 171620 - DNA, 1542 bp, Homo sapiens
  Payload ID: 13744
  Gene Symbol: PTPN2
  Gene Name: protein tyrosine phosphatase, non-receptor type 2
  Uniprot ID: P17706
  ENST ID: ENST00000353319
  CDS Start-End: 141-1202
ggccgacagggcttggcgtgggggcggggcgcggcgcgcagcgcgcatgcgccgcagcgccagcgctctccccggatcgtgcggggcctgagcctctccgccggcgcaggctctgctcgcgccagctcgctcccgcagccatgcccaccaccatcgagcgggagttcgaagagttggatactcagcgtcgctggcagccgctgtacttggaaattcgaaatgagtcccatgactatcctcatagagtggccaagtttccagaaaacagaaatcgaaacagatacagagatgtaagcccatatgatcacagtcgtgttaaactgcaaaatgctgagaatgattatattaatgccagtttagttgacatagaagaggcacaaaggagttacatcttaacacagggtccacttcctaacacatgctgccatttctggcttatggtttggcagcagaagaccaaagcagttgtcatgctgaaccgcattgtggagaaagaatcggttaaatgtgcacagtactggccaacagatgaccaagagatgctgtttaaagaaacaggattcagtgtgaagctcttgtcagaagatgtgaagtcgtattatacagtacatctactacaattagaaaatatcaatagtggtgaaaccagaacaatatctcactttcattatactacctggccagattttggagtccctgaatcaccagcttcatttctcaatttcttgtttaaagtgagagaatctggctccttgaaccctgaccatgggcctgcggtgatccactgtagtgcaggcattgggcgctctggcaccttctctctggtagacacttgtcttgttttgatggaaaaaggagatgatattaacataaaacaagtgttactgaacatgagaaaataccgaatgggtcttattcagaccccagatcaactgagattctcatacatggctataatagaaggagcaaaatgtataaagggagattctagtatacagaaacgatggaaagaactttctaaggaagacttatctcctgcctttgatcattcaccaaacaaaataatgactgaaaaatacaatgggaacagaataggtctagaagaagaaaaactgacaggtgaccgatgtacaggactttcctctaaaatgcaagatacaatggaggagaacagtgagaggccaagattgacagacacctaatattcatgacttgagaatattctgcagctataaattttgaaccattgatgtgcaaagcaagacctgaagcccactccggaaactaaagtgaggctcgctaaccctctagattgcctcacagttgtttgtttacaaagtaaactttacatccaggggatgaagagcacccaccagcagaagactttgcagaacctttaattggatgtgttaagtgtttttaatgagtgtatgaaatgtagaaagatgtacaagaaataaattaggggagattactttgtattgtactgccattcctactgtatttttatactttttggcagcattaaatatttttgttaaa

SEQ ID NO: 171621 - DNA, 812 bp, Homo sapiens
  Payload ID: 13744
  Gene Symbol: PTPN2
  Gene Name: protein tyrosine phosphatase, non-receptor type 2
  ENST ID: ENST00000585666
  CDS Start-End: 1-454
aaaataccgaatgggtcttattcagaccccagatcaactgagattctcatacatggctataatagaaggagcaaaatgtataaagggagattctagtatacagaaacgatggaaagaactttctaaggaagacttatctcctgcctttgatcattcaccaaacaaaataatgactgaaaaatacaatgggaacagaataggtctagaagaagaaaaactgacaggtgaccgatgtacaggactttcctctaaaatgcaagatacaatggaggagaacagtgagagtgctctacggaaacgtattcgagaggacagaaaggccaccacagctcagaaggtgcagcagatgaaacagaggctaaatgagaatgaacgaaaaagaaaaagacacaggttgctcttgatacatcaaatttctgctgttaaaaacttcagttattttgagtttagttaattcaggagcgggaacctaggccaagattgacagacacctaatattcatgacttgagaatattctgcagctataaattttgaaccattgatgtgcaaagcaagacctgaagcccactccggaaactaaagtgaggctcgctaaccctctagattgcctcacagttgtttgtttacaaagtaaactttacatccaggggatgaagagcacccaccagcagaagactttgcagaacctttaattggatgtgttaagtgtttttaatgagtgtatgaaatgtagaaagatgtacaagaaataaattaggggagattactttgtattgtactgccattcctactgtatttttatactttttgg

SEQ ID NO: 171622 - DNA, 743 bp, Homo sapiens
  Payload ID: 13744
  Gene Symbol: PTPN2
  Gene Name: protein tyrosine phosphatase, non-receptor type 2
  ENST ID: ENST00000591901
  CDS Start-End: 1-338
agaaacgatggaaagaactttctaaggaagacttatctcctgcctttgatcattcaccaaacaaaataatgactgaaaaatacaatgggaacagaataggtctagaagaagaaaaactgacaggtgaccgatgtacaggactttcctctaaaatgcaagatacaatggaggagaacagtgagagtgctctacggaaacgtattcgagaggacagaaaggccaccacagctcagaaggtgcagcagatgaaacagaggctaaatgagaatgaacgaaaaagaaaaagttttccccattttaaaaagaaaagcaaacaaagaaacaaaagtttttcctaaaaatatctttgaaggaaaattctccttactgggatagtcaggccaagattgacagacacctaatattcatgacttgagaatattctgcagctataaattttgaaccattgatgtgcaaagcaagacctgaagcccactccggaaactaaagtgaggctcgctaaccctctagattgcctcacagttgtttgtttacaaagtaaactttacatccaggggatgaagagcacccaccagcagaagactttgcagaacctttaattggatgtgttaagtgtttttaatgagtgtatgaaatgtagaaagatgtacaagaaataaattaggggagattactttgtattgtactgccattcctactgtatttttatactttttggcagcattaaatatttttgttaaata

SEQ ID NO: 171623 - DNA, 577 bp, Homo sapiens
  Payload ID: 13744
  Gene Symbol: PTPN2
  Gene Name: protein tyrosine phosphatase, non-receptor type 2
  ENST ID: ENST00000592059
  CDS Start-End: 374-577
aggagacaccagagctcagtctctctccctccctgcacaggtgcagagggaaggaactgggagcacacagcaagaaagtggctgttcacaagctaggacctgaccctgctggcaccttgatctcggacttccagcctccaaaactgaaattcgaaatgagtcccatgactatcctcatagagtggccaagtttccagaaaacagaaatcgaaacagatacagagatgtaagcccatatgatcacagtcgtgttaaactgcaaaatgctgagaatgattatattaatgccagtttagttgacatagaagaggcacaaaggagttacatcttaacacagggtccacttcctaacacatgctgccatttctggcttatggtttggcagcagaagaccaaagcagttgtcatgctgaaccgcattgtggagaaagaatcggttaaatgtgcacagtactggccaacagatgaccaagagatgctgtttaaagaaacaggattcagtgtgaagctcttgtcagaagatgtgaagtcgtattatacagtacatctactacaattagaaaatatcaatgtaaga

SEQ ID NO: 171624 - DNA, 1648 bp, Homo sapiens
  Payload ID: 13744
  Gene Symbol: PTPN2
  Gene Name: protein tyrosine phosphatase, non-receptor type 2
  Uniprot ID: P17706
  ENST ID: ENST00000591115
  CDS Start-End: 74-1306
ctccccggatcgtgcggggcctgagcctctccgccggcgcaggctctgctcgcgccagctcgctcccgcagccatgcccaccaccatcgagcgggagttcgaagagttggatactcagcgtcgctggcagccgctgtacttggaaattcgaaatgagtcccatgactatcctcatagagtggccaagtttccagaaaacagaaatcgaaacagatacagagatgtaagcccatatgatcacagtcgtgttaaactgcaaaatgctgagaatgattatattaatgccagtttagttgacatagaagaggcacaaaggagttacatcttaacacagggtccacttcctaacacatgctgccatttctggcttatggtttggcagcagaagaccaaagcagttgtcatgctgaaccgcattgtggagaaagaatcggttaaatgtgcacagtactggccaacagatgaccaagagatgctgtttaaagaaacaggattcagtgtgaagctcttgtcagaagatgtgaagtcgtattatacagtacatctactacaattagaaaatatcaattatattgagaacttgtggatcacactgtatttgaaattattaatgctggatgttaaaaggtcactaaaaagtggtgaaaccagaacaatatctcactttcattatactacctggccagattttggagtccctgaatcaccagcttcatttctcaatttcttgtttaaagtgagagaatctggctccttgaaccctgaccatgggcctgcggtgatccactgtagtgcaggcattgggcgctctggcaccttctctctggtagacacttgtcttgttttgatggaaaaaggagatgatattaacataaaacaagtgttactgaacatgagaaaataccgaatgggtcttattcagaccccagatcaactgagattctcatacatggctataatagaaggagcaaaatgtataaagggagattctagtatacagaaacgatggaaagaactttctaaggaagacttatctcctgcctttgatcattcaccaaacaaaataatgactgaaaaatacaatgggaacagaataggtctagaagaagaaaaactgacaggtgaccgatgtacaggactttcctctaaaatgcaagatacaatggaggagaacagtgagagtgctctacggaaacgtattcgagaggacagaaaggccaccacagctcagaaggtgcagcagatgaaacagaggctaaatgagaatgaacgaaaaagaaaaaggccaagattgacagacacctaatattcatgacttgagaatattctgcagctataaattttgaaccattgatgtgcaaagcaagacctgaagcccactccggaaactaaagtgaggctcgctaaccctctagattgcctcacagttgtttgtttacaaagtaaactttacatccaggggatgaagagcacccaccagcagaagactttgcagaacctttaattggatgtgttaagtgtttttaatgagtgtatgaaatgtagaaagatgtacaagaaataaattaggggagattactttgtattgtactgccattcctactgtatttttatactttttggcagcattaaatatttttgttaaata

SEQ ID NO: 171625 - DNA, 577 bp, Homo sapiens
  Payload ID: 13744
  Gene Symbol: PTPN2
  Gene Name: protein tyrosine phosphatase, non-receptor type 2
  ENST ID: ENST00000587703
  CDS Start-End: 1-439
agaagaggcacaaaggagttacatcttaacacagggtccacttcctaacacatgctgccatttctggcttatggtttggcagcagaagaccaaagcagttgtcatgctgaaccgcattgtggagaaagaatcgaaacgatggaaagaactttctaaggaagacttatctcctgcctttgatcattcaccaaacaaaataatgactgaaaaatacaatgggaacagaataggtctagaagaagaaaaactgacaggtgaccgatgtacaggactttcctctaaaatgcaagatacaatggaggagaacagtgagagtgctctacggaaacgtattcgagaggacagaaaggccaccacagctcagaaggtgcagcagatgaaacagaggctaaatgagaatgaacgaaaaagaaaaaggccaagattgacagacacctaatattcatgacttgagaatattctgcagctataaattttgaaccattgatgtgcaaagcaagacctgaagcccactccggaaactaaagtgaggctcgctaaccctctagattgcctcacagttgtttgtttacaaagt

SEQ ID NO: 171626 - DNA, 3390 bp, Homo sapiens
  Payload ID: 13744
  Gene Symbol: PTPN2
  Gene Name: protein tyrosine phosphatase, non-receptor type 2
  ENST ID: ENST00000591497
  CDS Start-End: 254-1414
agatcggtggttaggggtggaatggggaagagtgtgcctgccaaggggcacacagaacctttgtgctgatggaatagtattcaatgcagggaacagaccagttcatcatggaggcattccatcagagcgtctagttagagaagatatgtcatggactgcatcggcacagaagtggggtttatgtgagagaggagttggaagtcacacctgagtggagagcaacgtgaaaaggtgatgtcagcaagaatttaggatgtatggaaaggatggtaaaggcaccaactggatggatcagggagacatggaatgcagaatgcaggaaatagatgatcacagtcgtgttaaactgcaaaatgctgagaatgattatattaatgccagtttagttgacatagaagaggcacaaaggagttacatcttaacacagggtccacttcctaacacatgctgccatttctggcttatggtttggcagcagaagaccaaagcagttgtcatgctgaaccgcattgtggagaaagaatcggttaaatgtgcacagtactggccaacagatgaccaagagatgctgtttaaagaaacaggattcagtgtgaagctcttgtcagaagatgtgaagtcgtattatacagtacatctactacaattagaaaatatcaatagtggtgaaaccagaacaatatctcactttcattatactacctggccagattttggagtccctgaatcaccagcttcatttctcaatttcttgtttaaagtgagagaatctggctccttgaaccctgaccatgggcctgcggtgatccactgtagtgcaggcattgggcgctctggcaccttctctctggtagacacttgtcttgttttgatggaaaaaggagatgatattaacataaaacaagtgttactgaacatgagaaaataccgaatgggtcttattcagaccccagatcaactgagattctcatacatggctataatagaaggagcaaaatgtataaagggagattctagtatacagaaacgatggaaagaactttctaaggaagacttatctcctgcctttgatcattcaccaaacaaaataatgactgaaaaatacaatgggaacagaataggtctagaagaagaaaaactgacaggtgaccgatgtacaggactttcctctaaaatgcaagatacaatggaggagaacagtgagagtgctctacggaaacgtattcgagaggacagaaaggccaccacagctcagaaggtgcagcagatgaaacagaggctaaatgagaatgaacgaaaaagaaaaaggtggttatattggcaacctattctcactaagatggggtttatgtcagtcattttggttggcgcttttgttggctggacactgttttttcagcaaaatgccctataaacaattaattttgcccagcaagcttctgcactagtaactgacagtgctacattaatcataggggtttgtctgcagcaaacgcctcatatcccaaaaacggtgcagtagaatagacatcaaccagataagtgatatttacagtcacaagcccaacatctcaggactcttgactgcaggttcctctgaaccccaaactgtaaatggctgtctaaaataaagacattcatgtttgttaaaaactggtaaattttgcaactgtattcatacatgtcaaacacagtatttcacctgaccaacattgagatatcctttatcacaggatttgtttttggaggctatctggattttaacctgcacttgatataagcaataaatattgtggttttatctacgttattggaaagaaaatgacatttaaataatgtgtgtaatgtataatgtactattgacatgggcatcaacacttttattcttaagcatttcagggtaaatatattttataagtatctatttaatcttttgtagttaactgtactttttaagagctcaatttgaaaaatctgttactaaaaaaataaattgtatgtcgattgaattgtactggatacattttccatttttctaaagagaagtttgatatgagcagttagaagttggaataagcaatttctactatatattgcatttcttttatgttttacagttttccccattttaaaaagaaaagcaaacaaagaaacaaaagtttttcctaaaaatatctttgaaggaaaattctccttactgggatagtcaggtaaacagttggtcaagactttgtaaagaaattggtttctgtaaatcccattattgatatgtttatttttcatgaaaatttcaatgtagttggggtagattatgatttaggaagcaaaagtaagaagcagcattttatgattcataatttcagtttactagactgaagttttgaagtaaacacttttcagtttctttctacttcaataaatagtatgattatatgcaaaccttacattgtcattttaacttaatgaatattttttaaagcaaactgtttaatgaatttaactgctcatttgaatgctagctttcctcagatttcaacattccattcagtgtttaatttgtcttacttaaacttgaaattgttgttacaaatttaattgctaggaggcatggatagcatacattattatggatagcataccttatttcagtggttttcaaactatgctcattggatgtccaggtgggtcaagaggttactttcaaccacagcatctctgccttgtctctttatatgccacataagatttctgcataaggcttaagtattttaaagggggcagttatcatttaaaaacagtttggtcgggcgcggtggctcatgcctgtaatcccagcactttgggaggctgaagtgggcagatcacctgaggtcaggagttcaagaccagcctggccaacgtggtgaaacaccatctctactaaaaatgcaaaaattagctgggcatggtggagggcacctgtaatctcagctactcaggaggctgaggtaggagaattgcttgaacccaggagatggaggttgcagtgagctgagatcacgtcactgcactccagccagggcgacagagcgagactccatctcaaaagaaacaaacaaaaaaaacagtttgggccgggtgtggtggctcacgcttgtaatcccagcacttcggaaggccaaggcgggcggatcacgaggtcaagagatggagactgtcctggccaacatggtgaaatcccttctttactaaaaatacaaaaattatctgggcgtggtggtgcatgcctgtagtcccagctccttgggaggctaaggcaggagaatcacttgaacccgggaggcagaggttgcagtgagccgagattgcaccactgcactccagcctggcaacagagcaagacttcgtctc

SEQ ID NO: 171627 - DNA, 876 bp, Homo sapiens
  Payload ID: 13744
  Gene Symbol: PTPN2
  Gene Name: protein tyrosine phosphatase, non-receptor type 2
  ENST ID: ENST00000591305
  CDS Start-End: 82-210
ccagcgctctccccggatcgtgcggggcctgagcctctccgccggcgcaggctctgctcgcgccagctcgctcccgcagccatgcccaccaccatcgagcgggagttcgaagagttggatactcagcgtcgctggcagccgctgtacttgatgatcacagtcgtgttaaactgcaaaatgctgagaatgattatattaatgccagtttagttgacatagaagaggcacaaaggagttacatcttaacacagggtccacttcctaacacatgctgccatttctggcttatggtttggcagcagaagaccaaagcagttgtcatgctgaaccgcattgtggagaaagaatcgagtggtgaaaccagaacaatatctcactttcattatactacctggccagattttggagtccctgaatcaccagcttcatttctcaatttcttgtttaaagtgagagaatctggctccttgaaccctgaccatgggcctgcggtgatccactgtagtgcaggcattgggcgctctggcaccttctctctggtagacacttgtcttgttttgatggaaaaaggagatgatattaacataaaacaagtgttactgaacatgagaaaataccgaatgggtcttattcagaccccagatcaactgagattctcatacatggctataatagaaggagcaaaatgtataaagggagattctagtatacagaaacgatggaaagaactttctaaggaagacttatctcctgcctttgatcattcaccaaacaaaataatgactgaaaaatacaatgggaacagaataggtctagaagaagaaaaactgacaggtgaccgatgtacaggactttcctctaaaatgcaagatacaa

SEQ ID NO: 171628 - DNA, 772 bp, Homo sapiens
  Payload ID: 13744
  Gene Symbol: PTPN2
  Gene Name: protein tyrosine phosphatase, non-receptor type 2
  ENST ID: ENST00000592776
  CDS Start-End: 137-634
gacagggcttggcgtgggggcggggcgcggcgcgcagcgcgcatgcgccgcagcgccagcgctctccccggatcgtgcggggcctgagcctctccgccggcgcaggctctgctcgcgccagctcgctcccgcagccatgcccaccaccatcgagcgggagttcgaagagttggatactcagcgtcgctggcagccgctgtacttggaaattcgaaatgagtcccatgactatcctcatagagtggccaagtttccagaaaacagaaatcgaaacagatacagagatgtaagcccatatgatcacagtcgtgttaaactgcaaaatgctgagaatgattatattaatgccagtttagttgacatagaagaggcacaaaggagttacatcttaacacagggtccacttcctaacacatgctgccatttctggcttatggtttggcagcagaagaccaaagcagttgtcatgctgaaccgcattgtggagaaagaatcggttaaatgtgcacagtactggccaacagatgaccaagagatgctgtttaaagaaacaggattcagtgtgaagctcttgtcagaagatgtgaagtcgtattatacagtacatctactacaattagaaaatatcaattgagagaatctggctccttgaaccctgaccatgggcctgcggtgatccactgtagtgcaggcattgggcgctctggcaccttctctctggtagacacttgtcttgttttgatggaaaaaggagatgatattaacataaaac

SEQ ID NO: 171629 - DNA, 646 bp, Homo sapiens
  Payload ID: 13744
  Gene Symbol: PTPN2
  Gene Name: protein tyrosine phosphatase, non-receptor type 2
  ENST ID: ENST00000589216
  CDS Start-End: 58-186
gggcctgagcctctccgccggcgcaggctctgctcgcgccagctcgctcccgcagccatgcccaccaccatcgagcgggagttcgaagagttggatactcagcgtcgctggcagccgctgtacttgatgatcacagtcgtgttaaactgcaaaatgctgagaatgattatattaatgccagtttagttgacatagaagaggcacaaaggagttacatcttaacacagggtccacttcctaacacatgctgccatttctggcttatggtttggcagcagaagaccaaagcagttgtcatgctgaaccgcattgtggagaaagaatcggttaaatgtgcacagtactggccaacagatgaccaagagatgctgtttaaagaaacaggattcagtgtgaagctcttgtcagaagatgtgaagtcgtattatacagtacatctactacaattagaaaatatcaatagtggtgaaaccagaacaatatctcactttcattatactacctggccagattttggagtccctgaatcaccagcttcatttctcaatttcttgtttaaagtgagagaatctggctccttgaaccctgaccatgggcctgcggtgatccactgtagtgcaggcattgggcgctctggcaccttctc

SEQ ID NO: 171630 - DNA, 2872 bp, Homo sapiens
  Payload ID: 13745
  Gene Symbol: PTPN20
  Gene Name: protein tyrosine phosphatase, non-receptor type 20
  Uniprot ID: Q4JDL3
  ENST ID: ENST00000374218
  CDS Start-End: 274-1293
tggacccaactggcgaggctgctggggttgcagcgggacagttggggcggccccgcaggcccagtaaacgattatgagggaaatgactctgaagcagaagacttgaatttcagggagactttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaatagataccgagatattcttccatatgattcaacacgcgttcctcttggaaaaagcaaggactacatcaatgctagttatattagaatagtcaattgtggagaagagtatttttatatcgctactcaaggaccactgctgagcaccatagatgacttttggcaaatggtgttggaaaataattcaaatgttattgccatgataaccagagagatagaaggtggaattatcaaatgctaccattactggcccatttctctgaagaagccattggaattgaaacacttccgtgtattcctggagaactaccagatacttcaatatttcatcattcgaatgtttcaagttgtggagaagtccacgggaactagtcactctgtaaaacagttgcagttcaccaagtggccagaccatggcactcctgcctcagcagatagcttcataaaatatattcgttatgcaaggaagagccaccttacaggacccatggttgttcactgcagtgccggcataggccggacaggggtgttcctatgtgtggatgtcgtgttctgtgccatcgtaaagaactgttcattcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcacctcctcataaagaacatgtttgcactgtgctgaagggctttgctatgcatacaatctgctttcttggtttatcagtttattttctttctaaaagctccctgaagggcaatatcatttggcttggggtgatcagtgtttacttattgatcttgctagacaatatcaaaataacttcccacattttccagtgaaacagatgttacataaaacgattgcagcttggctatttggttgaagggattacagagcccaataaaggatttaaaatatattcattaagattttatttggaaaggtggctggagagagctgaggatttccaggactttgtaagttcttattctgggagaacataaggccaataatcatgacctcttccaggcatttttaagacagatgtctattcatgttctttagctagagcctgtactttttgctggcatttgaataacccagtttaaaaagagtccagttagggtggactaactttggacacaaattggcttccatttcctacattttcatactgctgccttcctacagctgctagaccaagacctgttggtctgggaagcatttcatggatagggagagctcctctcggtgaacagtccaaaactaaaatagatgtttatatagaaagcccaagaggagacttttgccatgcctgagttctttcctatcccaccctaacacttaacatattacttagtctgctttgttaaaagcaagtattacctttaacttgcctcttactctttgccctttagctaactaataaagtttgatataggcattattatataattctgagtcattcatggtatctctcatgtttgatgtatttttcaaactaagatctatgatagttttttttccagagttccattaaatcatttatttcctttactttctcacctctgttgaaacatttagaaactggatttgggaacccaattttggaaaaccagattcatagtcatgaaaatggaaacttccatattctgtttttgaaaagatgtggccattattacagtaattttattataggactttgcctcgtacaattaatagtgatattttggacaaggagttctggtgacaagctatacctaattataagctataaaacaatagatatgagtgtttgtacagtttaactcaatggagatcagaatattctatgtattgagaaaatgtttaatatcaatctataaatcttgaatttctaagaggcttattttgttcttttggctgaatgagtatatttgaattggttgaataattaataattctcattgtaaaaataattatatgccaaaaatatatttgatgttaaatcaaatagatgattctgtttacattgttcatatgaataataatctgtgttaatttcattttgataattggcctttaatatttgtatctctaattttattttctctctgttactgtaaaataatagctataatgtataacaattttcttcagaagaattctatgctattattaaaataaaatatttactgtg

SEQ ID NO: 171631 - DNA, 1388 bp, Homo sapiens
  Payload ID: 13745
  Gene Symbol: PTPN20
  Gene Name: protein tyrosine phosphatase, non-receptor type 20
  Uniprot ID: Q4JDL3
  ENST ID: ENST00000374339
  CDS Start-End: 78-1340
tggcctgactcacaggacactaaggctccttttctgaagaagccttttaccagtctcatttaggggatgggaacaacatgtcttcacctagggactttagagcagagcctgtaaacgattatgagggaaatgactctgaagcagaagacttgaatttcagggagactttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaatagataccgagatattcttccatatgattcaacacgcgttcctcttggaaaaagcaaggactacatcaatgctagttatattagaatagtcaattgtggagaagagtatttttatatcgctactcaaggaccactgctgagcaccatagatgacttttggcaaatggtgttggaaaataattcaaatgttattgccatgataaccagagagatagaaggtggaattatcaaatgctaccattactggcccatttctctgaagaagccattggaattgaaacacttccgtgtattcctggagaactaccagatacttcaatatttcatcattcgaatgtttcaagttgtggagaagtccacgggaactagtcactctgtaaaacagttgcagttcaccaagtggccagaccatggcactcctgcctcagcagatagcttcataaaatatattcgttatgcaaggaagagccaccttacaggacccatggttgttcactgcagtgccggcataggccggacaggggtgttcctatgtgtggatgtcgtgttctgtgccatcgtaaagaactgttcattcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcac

SEQ ID NO: 171632 - DNA, 1929 bp, Homo sapiens
  Payload ID: 13745
  Gene Symbol: PTPN20
  Gene Name: protein tyrosine phosphatase, non-receptor type 20
  ENST ID: ENST00000374342
  CDS Start-End: 123-317
gcaggtgggattggatagcgacgaaggccggcaggctaggcgtggacccaactggcgaggctgctggggttgcagcgggacagttggggcggccccgcaggcccagtggcagtgatcccagcatgtggacagccagaggccccttcagaagagacaggtggagcagtgaggatgaggaggctgcagggccatcacaggctctctcccctctactttctgttcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcacctcctcataaagaacatgtttgcactgtgctgaagggctttgctatgcatacaatctgctttcttggtttatcagtttattttctttctaaaagctccctgaagggcaatatcatttggcttggggtgatcagtgtttacttattgatcttgctagacaatatcaaaataacttcccacattttccagtgaaacagatgttacataaaacgattgcagcttggctatttggttgaagggattacagagcccaataaaggatttaaaatatattcattaagattttatttggaaaggtggctggagagagctgaggatttccaggactttgtaagttcttattctgggagaacataaggccaataatcatgacctcttccaggcatttttaagacagatgtctattcatgttctttagctagagcctgtactttttgctggcatttgaataacccagtttaaaaagagtccagttagggtggactaactttggacacaaattggcttccatttcctacattttcatactgctgccttcctacagctgctagaccaagacctgttggtctgggaagcatttcatggatagggagagctcctctcggtgaacagtccaaaactaaaatagatgtttatatagaaagcccaagaggagacttttgccatgcctgagttctttcctatcccaccctaacacttaacatattacttagtctgctttgttaaaagcaagtattacctttaacttgcctcttactctttgccctttagctaactaataaagtttgatataggcattattatataattctgagtcattcatggtatctctcatgtttgatgtatttttcaaactaagatctatgatagttttttttccagagttccattaaatcatttatttcctttactttctcacctctgttgaaacatttagaaactggatttgggaacccaattttggaaaaccagattcatagtcatgaaaatggaaacttccatattctgtttttgaaaagatgtggccattattacagtaattttattataggactttgcctcgtacaattaatagtgatattttggacaaggagttctggtgacaagctatacctaattataagctataaaacaatagatatgagtgtttgtacagtttaactcaatggagatcagaatattctatgtattgagaaaatgtttaatatcaatctataaatcttgaatttctaagaggcttattttgttcttttggctgaatgagtatatttgaattggttgaataattaataattctcattgtaaaaataattatatgccaaaaatatatttgatgttaaatcaaatagatgattctgtttacattgttcatatgaataataatctgtgttaatttcattttgataattggcctttaatatttgtatctctaattttattttctctctgttactgtaaaataatagctataatgtataacaattttcttcagaagaattctatgctattattaaaataaaatatttactgtgta

SEQ ID NO: 171633 - DNA, 2481 bp, Homo sapiens
  Payload ID: 13745
  Gene Symbol: PTPN20
  Gene Name: protein tyrosine phosphatase, non-receptor type 20
  Uniprot ID: Q4JDL3
  ENST ID: ENST00000374346
  CDS Start-End: 191-871
gcgtggacccaactggcgaggctgctggggttgcagcgggacagttggggcggccccgcaggcccaggtgaacaaaaattgtttgctggcccccaggatactaactagacctttggcctgactcacaggacactaaggctccttttctgaagaagccttttaccagtctcatttaggggatgggaacaacatgtcttcacctagggactttagagcagagcctgtaaacgattatgagggaaatgactctgaagcagaagacttgaatttcagggagactttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaatagataccgagatattcttccatttcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcacctcctcataaagaacatgtttgcactgtgctgaagggctttgctatgcatacaatctgctttcttggtttatcagtttattttctttctaaaagctccctgaagggcaatatcatttggcttggggtgatcagtgtttacttattgatcttgctagacaatatcaaaataacttcccacattttccagtgaaacagatgttacataaaacgattgcagcttggctatttggttgaagggattacagagcccaataaaggatttaaaatatattcattaagattttatttggaaaggtggctggagagagctgaggatttccaggactttgtaagttcttattctgggagaacataaggccaataatcatgacctcttccaggcatttttaagacagatgtctattcatgttctttagctagagcctgtactttttgctggcatttgaataacccagtttaaaaagagtccagttagggtggactaactttggacacaaattggcttccatttcctacattttcatactgctgccttcctacagctgctagaccaagacctgttggtctgggaagcatttcatggatagggagagctcctctcggtgaacagtccaaaactaaaatagatgtttatatagaaagcccaagaggagacttttgccatgcctgagttctttcctatcccaccctaacacttaacatattacttagtctgctttgttaaaagcaagtattacctttaacttgcctcttactctttgccctttagctaactaataaagtttgatataggcattattatataattctgagtcattcatggtatctctcatgtttgatgtatttttcaaactaagatctatgatagttttttttccagagttccattaaatcatttatttcctttactttctcacctctgttgaaacatttagaaactggatttgggaacccaattttggaaaaccagattcatagtcatgaaaatggaaacttccatattctgtttttgaaaagatgtggccattattacagtaattttattataggactttgcctcgtacaattaatagtgatattttggacaaggagttctggtgacaagctatacctaattataagctataaaacaatagatatgagtgtttgtacagtttaactcaatggagatcagaatattctatgtattgagaaaatgtttaatatcaatctataaatcttgaatttctaagaggcttattttgttcttttggctgaatgagtatatttgaattggttgaataattaataattctcattgtaaaaataattatatgccaaaaatatatttgatgttaaatcaaatagatgattctgtttacattgttcatatgaataataatctgtgttaatttcattttgataattggcctttaatatttgtatctctaattttattttctctctgttactgtaaaataatagctataatgtataacaattttcttcagaagaattctatgctattattaaaataaaatatttactgtg

SEQ ID NO: 171634 - DNA, 2779 bp, Homo sapiens
  Payload ID: 13745
  Gene Symbol: PTPN20
  Gene Name: protein tyrosine phosphatase, non-receptor type 20
  Uniprot ID: Q4JDL3
  ENST ID: ENST00000395721
  CDS Start-End: 179-1198
tggacccaactggcgaggctgctggggttgcagcgggacagttggggcggccccgcaggcccaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaatagataccgagatattcttccatatgattcaacacgcgttcctcttggaaaaagcaaggactacatcaatgctagttatattagaatagtcaattgtggagaagagtatttttatatcgctactcaaggaccactgctgagcaccatagatgacttttggcaaatggtgttggaaaataattcaaatgttattgccatgataaccagagagatagaaggtggaattatcaaatgctaccattactggcccatttctctgaagaagccattggaattgaaacacttccgtgtattcctggagaactaccagatacttcaatatttcatcattcgaatgtttcaagttgtggagaagtccacgggaactagtcactctgtaaaacagttgcagttcaccaagtggccagaccatggcactcctgcctcagcagatagcttcataaaatatattcgttatgcaaggaagagccaccttacaggacccatggttgttcactgcagtgccggcataggccggacaggggtgttcctatgtgtggatgtcgtgttctgtgccatcgtaaagaactgttcattcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcacctcctcataaagaacatgtttgcactgtgctgaagggctttgctatgcatacaatctgctttcttggtttatcagtttattttctttctaaaagctccctgaagggcaatatcatttggcttggggtgatcagtgtttacttattgatcttgctagacaatatcaaaataacttcccacattttccagtgaaacagatgttacataaaacgattgcagcttggctatttggttgaagggattacagagcccaataaaggatttaaaatatattcattaagattttatttggaaaggtggctggagagagctgaggatttccaggactttgtaagttcttattctgggagaacataaggccaataatcatgacctcttccaggcatttttaagacagatgtctattcatgttctttagctagagcctgtactttttgctggcatttgaataacccagtttaaaaagagtccagttagggtggactaactttggacacaaattggcttccatttcctacattttcatactgctgccttcctacagctgctagaccaagacctgttggtctgggaagcatttcatggatagggagagctcctctcggtgaacagtccaaaactaaaatagatgtttatatagaaagcccaagaggagacttttgccatgcctgagttctttcctatcccaccctaacacttaacatattacttagtctgctttgttaaaagcaagtattacctttaacttgcctcttactctttgccctttagctaactaataaagtttgatataggcattattatataattctgagtcattcatggtatctctcatgtttgatgtatttttcaaactaagatctatgatagttttttttccagagttccattaaatcatttatttcctttactttctcacctctgttgaaacatttagaaactggatttgggaacccaattttggaaaaccagattcatagtcatgaaaatggaaacttccatattctgtttttgaaaagatgtggccattattacagtaattttattataggactttgcctcgtacaattaatagtgatattttggacaaggagttctggtgacaagctatacctaattataagctataaaacaatagatatgagtgtttgtacagtttaactcaatggagatcagaatattctatgtattgagaaaatgtttaatatcaatctataaatcttgaatttctaagaggcttattttgttcttttggctgaatgagtatatttgaattggttgaataattaataattctcattgtaaaaataattatatgccaaaaatatatttgatgttaaatcaaatagatgattctgtttacattgttcatatgaataataatctgtgttaatttcattttgataattggcctttaatatttgtatctctaattttattttctctctgttactgtaaaataatagctataatgtataacaattttcttcagaagaattctatgctattattaaaataaaatatttactgtgta

SEQ ID NO: 171635 - DNA, 1995 bp, Homo sapiens
  Payload ID: 13745
  Gene Symbol: PTPN20
  Gene Name: protein tyrosine phosphatase, non-receptor type 20
  ENST ID: ENST00000395722
  CDS Start-End: 189-383
aggctaggcgtggacccaactggcgaggctgctggggttgcagcgggacagttggggcggccccgcaggcccaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgttcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcacctcctcataaagaacatgtttgcactgtgctgaagggctttgctatgcatacaatctgctttcttggtttatcagtttattttctttctaaaagctccctgaagggcaatatcatttggcttggggtgatcagtgtttacttattgatcttgctagacaatatcaaaataacttcccacattttccagtgaaacagatgttacataaaacgattgcagcttggctatttggttgaagggattacagagcccaataaaggatttaaaatatattcattaagattttatttggaaaggtggctggagagagctgaggatttccaggactttgtaagttcttattctgggagaacataaggccaataatcatgacctcttccaggcatttttaagacagatgtctattcatgttctttagctagagcctgtactttttgctggcatttgaataacccagtttaaaaagagtccagttagggtggactaactttggacacaaattggcttccatttcctacattttcatactgctgccttcctacagctgctagaccaagacctgttggtctgggaagcatttcatggatagggagagctcctctcggtgaacagtccaaaactaaaatagatgtttatatagaaagcccaagaggagacttttgccatgcctgagttctttcctatcccaccctaacacttaacatattacttagtctgctttgttaaaagcaagtattacctttaacttgcctcttactctttgccctttagctaactaataaagtttgatataggcattattatataattctgagtcattcatggtatctctcatgtttgatgtatttttcaaactaagatctatgatagttttttttccagagttccattaaatcatttatttcctttactttctcacctctgttgaaacatttagaaactggatttgggaacccaattttggaaaaccagattcatagtcatgaaaatggaaacttccatattctgtttttgaaaagatgtggccattattacagtaattttattataggactttgcctcgtacaattaatagtgatattttggacaaggagttctggtgacaagctatacctaattataagctataaaacaatagatatgagtgtttgtacagtttaactcaatggagatcagaatattctatgtattgagaaaatgtttaatatcaatctataaatcttgaatttctaagaggcttattttgttcttttggctgaatgagtatatttgaattggttgaataattaataattctcattgtaaaaataattatatgccaaaaatatatttgatgttaaatcaaatagatgattctgtttacattgttcatatgaataataatctgtgttaatttcattttgataattggcctttaatatttgtatctctaattttattttctctctgttactgtaaaataatagctataatgtataacaattttcttcagaagaattctatgctattattaaaataaaatatttactgtgta

SEQ ID NO: 171636 - DNA, 2226 bp, Homo sapiens
  Payload ID: 13745
  Gene Symbol: PTPN20
  Gene Name: protein tyrosine phosphatase, non-receptor type 20
  Uniprot ID: Q4JDL3
  ENST ID: ENST00000395725
  CDS Start-End: 179-616
tggacccaactggcgaggctgctggggttgcagcgggacagttggggcggccccgcaggcccaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaatagataccgagatattcttccatttcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcacctcctcataaagaacatgtttgcactgtgctgaagggctttgctatgcatacaatctgctttcttggtttatcagtttattttctttctaaaagctccctgaagggcaatatcatttggcttggggtgatcagtgtttacttattgatcttgctagacaatatcaaaataacttcccacattttccagtgaaacagatgttacataaaacgattgcagcttggctatttggttgaagggattacagagcccaataaaggatttaaaatatattcattaagattttatttggaaaggtggctggagagagctgaggatttccaggactttgtaagttcttattctgggagaacataaggccaataatcatgacctcttccaggcatttttaagacagatgtctattcatgttctttagctagagcctgtactttttgctggcatttgaataacccagtttaaaaagagtccagttagggtggactaactttggacacaaattggcttccatttcctacattttcatactgctgccttcctacagctgctagaccaagacctgttggtctgggaagcatttcatggatagggagagctcctctcggtgaacagtccaaaactaaaatagatgtttatatagaaagcccaagaggagacttttgccatgcctgagttctttcctatcccaccctaacacttaacatattacttagtctgctttgttaaaagcaagtattacctttaacttgcctcttactctttgccctttagctaactaataaagtttgatataggcattattatataattctgagtcattcatggtatctctcatgtttgatgtatttttcaaactaagatctatgatagttttttttccagagttccattaaatcatttatttcctttactttctcacctctgttgaaacatttagaaactggatttgggaacccaattttggaaaaccagattcatagtcatgaaaatggaaacttccatattctgtttttgaaaagatgtggccattattacagtaattttattataggactttgcctcgtacaattaatagtgatattttggacaaggagttctggtgacaagctatacctaattataagctataaaacaatagatatgagtgtttgtacagtttaactcaatggagatcagaatattctatgtattgagaaaatgtttaatatcaatctataaatcttgaatttctaagaggcttattttgttcttttggctgaatgagtatatttgaattggttgaataattaataattctcattgtaaaaataattatatgccaaaaatatatttgatgttaaatcaaatagatgattctgtttacattgttcatatgaataataatctgtgttaatttcattttgataattggcctttaatatttgtatctctaattttattttctctctgttactgtaaaataatagctataatgtataacaattttcttcagaagaattctatgctattattaaaataaaatatttactgtg

SEQ ID NO: 171637 - DNA, 790 bp, Homo sapiens
  Payload ID: 13745
  Gene Symbol: PTPN20
  Gene Name: protein tyrosine phosphatase, non-receptor type 20
  Uniprot ID: Q4JDL3
  ENST ID: ENST00000395727
  CDS Start-End: 56-742
ctgtggctctgtggtaggggaatgccaccaactccctgaggagcagccgtgtggtatgattgatgattcaacacgcgttcctcttggaaaaagcaaggactacatcaatgctagttatattagaatagtcaattgtggagaagagtatttttatatcgctactcaaggaccactgctgagcaccatagatgacttttggcaaatggtgttggaaaataattcaaatgttattgccatgataaccagagagatagaaggtggaattatcaaatgctaccattactggcccatttctctgaagaagccattggaattgaaacacttccgtgtattcctggagaactaccagatacttcaatatttcatcattcgaatgtttcaagttgtggagaagtccacgggaactagtcactctgtaaaacagttgcagttcaccaagtggccagaccatggcactcctgcctcagcagatagcttcataaaatatattcgttatgcaaggaagagccaccttacaggacccatggttgttcactgcagtgccggcataggccggacaggggtgttcctatgtgtggatgtcgtgttctgtgccatcgtaaagaactgttcattcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcac

SEQ ID NO: 171638 - DNA, 567 bp, Homo sapiens
  Payload ID: 13745
  Gene Symbol: PTPN20
  Gene Name: protein tyrosine phosphatase, non-receptor type 20
  ENST ID: ENST00000417004
  CDS Start-End: 189-567
aggctaggcgtggacccaactggcgaggctgctggggttgcagcgggacagttggggcggccccgcaggcccaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaatagataccgagatattcttccatttcaacatcatggatatagtggcccaaatgagagaacaa

SEQ ID NO: 171639 - DNA, 3125 bp, Homo sapiens
  Payload ID: 13745
  Gene Symbol: PTPN20
  Gene Name: protein tyrosine phosphatase, non-receptor type 20
  ENST ID: ENST00000437863
  CDS Start-End: 251-439
tgttttctatttgatcagtttttccccccgcctttgttcagtaaacgattatgagggaaatgactctgaagcagaagacttgaatttcagggagactttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctggacttgagcatctgaggattttggtatctgtgggaggtcctggaaccaattccttgcaaatacagagggacaacagtagtacaagtatttaatacaacaaatcttcctatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaatagataccgagatattcttccatatgattcaacacgcgttcctcttggaaaaagcaaggactacatcaatgctagttatattagaatagtcaattgtggagaagagtatttttatatcgctactcaaggaccactgctgagcaccatagatgacttttggcaaatggtgttggaaaataattcaaatgttattgccatgataaccagagagatagaaggtggaattatcaaatgctaccattactggcccatttctctgaagaagccattggaattgaaacacttccgtgtattcctggagaactaccagatacttcaatatttcatcattcgaatgtttcaagttgtggagaagtccacgggaactagtcactctgtaaaacagttgcagttcaccaagtggccagaccatggcactcctgcctcagcagatagcttcataaaatatattcgttatgcaaggaagagccaccttacaggacccatggttgttcactgcagtgccggcataggccggacaggggtgttcctatgtgtggatgtcgtgttctgtgccatcgtaaagaactgttcattcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcacctcctcataaagaacatgtttgcactgtgctgaagggctttgctatgcatacaatctgctttcttggtttatcagtttattttctttctaaaagctccctgaagggcaatatcatttggcttggggtgatcagtgtttacttattgatcttgctagacaatatcaaaataacttcccacattttccagtgaaacagatgttacataaaacgattgcagcttggctatttggttgaagggattacagagcccaataaaggatttaaaatatattcattaagattttatttggaaaggtggctggagagagctgaggatttccaggactttgtaagttcttattctgggagaacataaggccaataatcatgacctcttccaggcatttttaagacagatgtctattcatgttctttagctagagcctgtactttttgctggcatttgaataacccagtttaaaaagagtccagttagggtggactaactttggacacaaattggcttccatttcctacattttcatactgctgccttcctacagctgctagaccaagacctgttggtctgggaagcatttcatggatagggagagctcctctcggtgaacagtccaaaactaaaatagatgtttatatagaaagcccaagaggagacttttgccatgcctgagttctttcctatcccaccctaacacttaacatattacttagtctgctttgttaaaagcaagtattacctttaacttgcctcttactctttgccctttagctaactaataaagtttgatataggcattattatataattctgagtcattcatggtatctctcatgtttgatgtatttttcaaactaagatctatgatagttttttttccagagttccattaaatcatttatttcctttactttctcacctctgttgaaacatttagaaactggatttgggaacccaattttggaaaaccagattcatagtcatgaaaatggaaacttccatattctgtttttgaaaagatgtggccattattacagtaattttattataggactttgcctcgtacaattaatagtgatattttggacaaggagttctggtgacaagctatacctaattataagctataaaacaatagatatgagtgtttgtacagtttaactcaatggagatcagaatattctatgtattgagaaaatgtttaatatcaatctataaatcttgaatttctaagaggcttattttgttcttttggctgaatgagtatatttgaattggttgaataattaataattctcattgtaaaaataattatatgccaaaaatatatttgatgttaaatcaaatagatgattctgtttacattgttcatatgaataataatctgtgttaatttcattttgataattggcctttaatatttgtatctctaattttattttctctctgttactgtaaaataatagctataatgtataacaattttcttcagaagaattctatgctattattaaaataaaatatttactgtgtattgcctgaagtatttttatttatctgggccttgaaatcgtcttgtaaagaaaaattccacaatgcttgatgttaaacatgtctcttctttaatgtgtgcctcatatttttacagctggactaatttttagttttccagggaaattaaaggagtgaatatggaaata

SEQ ID NO: 171640 - DNA, 854 bp, Homo sapiens
  Payload ID: 13745
  Gene Symbol: PTPN20
  Gene Name: protein tyrosine phosphatase, non-receptor type 20
  Uniprot ID: Q4JDL3
  ENST ID: ENST00000502705
  CDS Start-End: 186-806
ctgtggctctgtggtaggggaatgccaccaactccctgaggagcagccgtgtggtatgattggtgaacaaaaattgtttgctggcccccaggatactaactagacctttggcctgactcacaggacactaaggctccttttctgaagaagccttttaccagtctcatttaggggatgggaacaacatgtcttcacctagggactttagagcagagcctgtaaacgattatgagggaaatgactctgaagcagaagacttgaatttcagggagactttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatgttcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcac

SEQ ID NO: 171641 - DNA, 599 bp, Homo sapiens
  Payload ID: 13745
  Gene Symbol: PTPN20
  Gene Name: protein tyrosine phosphatase, non-receptor type 20
  Uniprot ID: Q4JDL3
  ENST ID: ENST00000502254
  CDS Start-End: 84-521
gacctttggcctgactcacaggacactaaggctccttttctgaagaagccttttaccagtctcatttaggggatgggaacaacatgtcttcacctagggactttagagcagagcctgtaaacgattatgagggaaatgactctgaagcagaagacttgaatttcagggagactttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgttcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgca

SEQ ID NO: 171642 - DNA, 1153 bp, Homo sapiens
  Payload ID: 13745
  Gene Symbol: PTPN20
  Gene Name: protein tyrosine phosphatase, non-receptor type 20
  Uniprot ID: Q4JDL3
  ENST ID: ENST00000510335
  CDS Start-End: 177-491
ctgtggctctgtggtaggggaatgccaccaactccctgaggagcagccgtgtggtatgattggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatgatgattcaacacgcgttcctcttggaaaaagcaaggactacatcaatgctagttatattagaatagtcaattgtggagaagagtatttttatatcgctactcaaggaccactgctgagcaccatagatgacttttggcaaatggtgttggaaaataattcaaatgttattgccatgataaccagagagatagaaggtggaattatcaaatgctaccattactggcccatttctctgaagaagccattggaattgaaacacttccgtgtattcctggagaactaccagatacttcaatatttcatcattcgaatgtttcaagttgtggagaagtccacgggaactagtcactctgtaaaacagttgcagttcaccaagtggccagaccatggcactcctgcctcagcagatagcttcataaaatatattcgttatgcaaggaagagccaccttacaggacccatggttgttcactgcagtgccggcataggccggacaggggtgttcctatgtgtggatgtcgtgttctgtgccatcgtaaagaactgttcattcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcac

SEQ ID NO: 171643 - DNA, 1401 bp, Homo sapiens
  Payload ID: 13745
  Gene Symbol: PTPN20
  Gene Name: protein tyrosine phosphatase, non-receptor type 20
  Uniprot ID: Q4JDL3
  ENST ID: ENST00000506080
  CDS Start-End: 334-1353
ctgtggctctgtggtaggggaatgccaccaactccctgaggagcagccgtgtggtatgattggtgaacaaaaattgtttgctggcccccaggatactaactagacctttggcctgactcacaggacactaaggctccttttctgaagaagccttttaccagtctcatttaggggatgggaacaacatgtcttcacctagggactttagagcagagcctggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaatagataccgagatattcttccatatgattcaacacgcgttcctcttggaaaaagcaaggactacatcaatgctagttatattagaatagtcaattgtggagaagagtatttttatatcgctactcaaggaccactgctgagcaccatagatgacttttggcaaatggtgttggaaaataattcaaatgttattgccatgataaccagagagatagaaggtggaattatcaaatgctaccattactggcccatttctctgaagaagccattggaattgaaacacttccgtgtattcctggagaactaccagatacttcaatatttcatcattcgaatgtttcaagttgtggagaagtccacgggaactagtcactctgtaaaacagttgcagttcaccaagtggccagaccatggcactcctgcctcagcagatagcttcataaaatatattcgttatgcaaggaagagccaccttacaggacccatggttgttcactgcagtgccggcataggccggacaggggtgttcctatgtgtggatgtcgtgttctgtgccatcgtaaagaactgttcattcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcac

SEQ ID NO: 171644 - DNA, 457 bp, Homo sapiens
  Payload ID: 13745
  Gene Symbol: PTPN20
  Gene Name: protein tyrosine phosphatase, non-receptor type 20
  ENST ID: ENST00000506881
  CDS Start-End: 254-457
aggtggcatattggtttttctggaatccgttgcgaaactgttcttatctacttaaagggaactcatttgaagtctgagtcttgagggaataggcagaacaggcatgttggaaggaaagtatgagtctcaggtgaacaaaaattgtttgctggcccccaggatactaactagacctttggcctgactcacaggacactaaggctccttttctgaagaagccttttaccagtctcatttaggggatgggaacaacatgtcttcacctagggactttagagcagagcctgtaaacgattatgagggaaatgactctgaagcagaagacttgaatttcagggagactttgccttcatcaagtcaggaaaacacacctagatcaaaggtttttgaaaataaagttaattcagagaaggtaaaactttctcttcggaatttcccacataatgattatgaggat

SEQ ID NO: 171645 - DNA, 818 bp, Homo sapiens
  Payload ID: 13745
  Gene Symbol: PTPN20
  Gene Name: protein tyrosine phosphatase, non-receptor type 20
  Uniprot ID: Q4JDL3
  ENST ID: ENST00000513266
  CDS Start-End: 177-770
ctgtggctctgtggtaggggaatgccaccaactccctgaggagcagccgtgtggtatgattggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatgacgggaactagtcactctgtaaaacagttgcagttcaccaagtggccagaccatggcactcctgcctcagcagatagcttcataaaatatattcgttatgcaaggaagagccaccttacaggacccatggttgttcactgcagtgccggcataggccggacaggggtgttcctatgtgtggatgtcgtgttctgtgccatcgtaaagaactgttcattcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcac

SEQ ID NO: 171646 - DNA, 693 bp, Homo sapiens
  Payload ID: 13745
  Gene Symbol: PTPN20
  Gene Name: protein tyrosine phosphatase, non-receptor type 20
  Uniprot ID: Q4JDL3
  ENST ID: ENST00000509900
  CDS Start-End: 177-614
ctgtggctctgtggtaggggaatgccaccaactccctgaggagcagccgtgtggtatgattggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaatagataccgagatattcttccatttcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcac

SEQ ID NO: 171647 - DNA, 1339 bp, Homo sapiens
  Payload ID: 13745
  Gene Symbol: PTPN20
  Gene Name: protein tyrosine phosphatase, non-receptor type 20
  Uniprot ID: Q4JDL3
  ENST ID: ENST00000511769
  CDS Start-End: 56-1291
ctgtggctctgtggtaggggaatgccaccaactccctgaggagcagccgtgtggtatgattgtaaacgattatgagggaaatgactctgaagcagaagacttgaatttcagggagactttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaatagataccgagatattcttccatatgattcaacacgcgttcctcttggaaaaagcaaggactacatcaatgctagttatattagaatagtcaattgtggagaagagtatttttatatcgctactcaaggaccactgctgagcaccatagatgacttttggcaaatggtgttggaaaataattcaaatgttattgccatgataaccagagagatagaaggtggaattatcaaatgctaccattactggcccatttctctgaagaagccattggaattgaaacacttccgtgtattcctggagaactaccagatacttcaatatttcatcattcgaatgtttcaagttgtggagaagtccacgggaactagtcactctgtaaaacagttgcagttcaccaagtggccagaccatggcactcctgcctcagcagatagcttcataaaatatattcgttatgcaaggaagagccaccttacaggacccatggttgttcactgcagtgccggcataggccggacaggggtgttcctatgtgtggatgtcgtgttctgtgccatcgtaaagaactgttcattcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcac

SEQ ID NO: 171648 - DNA, 742 bp, Homo sapiens
  Payload ID: 13745
  Gene Symbol: PTPN20
  Gene Name: protein tyrosine phosphatase, non-receptor type 20
  Uniprot ID: Q4JDL3
  ENST ID: ENST00000508602
  CDS Start-End: 226-663
tggcctgactcacaggacactaaggctccttttctgaagaagccttttaccagtctcatttaggggatgggaacaacatgtcttcacctagggactttagagcagagcctggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaatagataccgagatattcttccatttcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcac

SEQ ID NO: 171649 - DNA, 945 bp, Homo sapiens
  Payload ID: 13745
  Gene Symbol: PTPN20
  Gene Name: protein tyrosine phosphatase, non-receptor type 20
  Uniprot ID: Q4JDL3
  ENST ID: ENST00000509599
  CDS Start-End: 186-866
ctgtggctctgtggtaggggaatgccaccaactccctgaggagcagccgtgtggtatgattggtgaacaaaaattgtttgctggcccccaggatactaactagacctttggcctgactcacaggacactaaggctccttttctgaagaagccttttaccagtctcatttaggggatgggaacaacatgtcttcacctagggactttagagcagagcctgtaaacgattatgagggaaatgactctgaagcagaagacttgaatttcagggagactttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaatagataccgagatattcttccatttcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcac

SEQ ID NO: 171650 - DNA, 788 bp, Homo sapiens
  Payload ID: 13745
  Gene Symbol: PTPN20
  Gene Name: protein tyrosine phosphatase, non-receptor type 20
  Uniprot ID: Q4JDL3
  ENST ID: ENST00000509774
  CDS Start-End: 56-709
ctgtggctctgtggtaggggaatgccaccaactccctgaggagcagccgtgtggtatgattgtaaacgattatgagggaaatgactctgaagcagaagacttgaatttcagggagactttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaatagataccgagatattcttccatttcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcac

SEQ ID NO: 171651 - DNA, 913 bp, Homo sapiens
  Payload ID: 13745
  Gene Symbol: PTPN20
  Gene Name: protein tyrosine phosphatase, non-receptor type 20
  Uniprot ID: Q4JDL3
  ENST ID: ENST00000513156
  CDS Start-End: 56-865
ctgtggctctgtggtaggggaatgccaccaactccctgaggagcagccgtgtggtatgattgtaaacgattatgagggaaatgactctgaagcagaagacttgaatttcagggagactttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatgacgggaactagtcactctgtaaaacagttgcagttcaccaagtggccagaccatggcactcctgcctcagcagatagcttcataaaatatattcgttatgcaaggaagagccaccttacaggacccatggttgttcactgcagtgccggcataggccggacaggggtgttcctatgtgtggatgtcgtgttctgtgccatcgtaaagaactgttcattcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcac

SEQ ID NO: 171652 - DNA, 1244 bp, Homo sapiens
  Payload ID: 13745
  Gene Symbol: PTPN20
  Gene Name: protein tyrosine phosphatase, non-receptor type 20
  Uniprot ID: Q4JDL3
  ENST ID: ENST00000505814
  CDS Start-End: 177-1196
ctgtggctctgtggtaggggaatgccaccaactccctgaggagcagccgtgtggtatgattggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaatagataccgagatattcttccatatgattcaacacgcgttcctcttggaaaaagcaaggactacatcaatgctagttatattagaatagtcaattgtggagaagagtatttttatatcgctactcaaggaccactgctgagcaccatagatgacttttggcaaatggtgttggaaaataattcaaatgttattgccatgataaccagagagatagaaggtggaattatcaaatgctaccattactggcccatttctctgaagaagccattggaattgaaacacttccgtgtattcctggagaactaccagatacttcaatatttcatcattcgaatgtttcaagttgtggagaagtccacgggaactagtcactctgtaaaacagttgcagttcaccaagtggccagaccatggcactcctgcctcagcagatagcttcataaaatatattcgttatgcaaggaagagccaccttacaggacccatggttgttcactgcagtgccggcataggccggacaggggtgttcctatgtgtggatgtcgtgttctgtgccatcgtaaagaactgttcattcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcac

SEQ ID NO: 171653 - DNA, 1213 bp, Homo sapiens
  Payload ID: 13745
  Gene Symbol: PTPN20
  Gene Name: protein tyrosine phosphatase, non-receptor type 20
  ENST ID: ENST00000508357
  CDS Start-End: 420-608
gttggtggcagttcttgtactcctgtacttgcttgtatctgcagcagctcctgctccttccttggactccactccagaaaatgtgtgcccagtcgaaaccactaccaatttcatctgggagctttcttcaccccacaacacttccgcagttctgctggttgtcttccacaagggccccagtgagatatagtcagggatggcgtccctgtgctcgagctggagactgggagtgcatacaaggcacttcctgctgctacttctactttcatattttgtgtgactctctaaatcccttccatctctaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgtattccattcaccagttgaaggacactgtgttgcttccagattttggcaattatggataaaagtactacagatattcacaaactttgtgtaaacataagtttccattactttaagatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaatagataccgagatattcttccatgtctcatgaacaaagtggccataatggcagggatggaggttatgtatgagctcagcaacatggacttccactcaccaaggctgacctggctacagctgctactgagtgtccaatctgccagcaacagagaccaacactgagtacctgatgggcactattccatgggatgatcagccagctagctgatggcaggttgattacactgggaccacttccataatgcatggagcagtgcttttttcttactagaatagacagtaactctgggtatggatttgccttccctgcacacagtgctcccaccaatttaccatctgtggacctacagaatgccttatc

SEQ ID NO: 171654 - DNA, 545 bp, Homo sapiens
  Payload ID: 13745
  Gene Symbol: PTPN20
  Gene Name: protein tyrosine phosphatase, non-receptor type 20
  Uniprot ID: Q4JDL3
  ENST ID: ENST00000503851
  CDS Start-End: 56-466
ctgtggctctgtggtaggggaatgccaccaactccctgaggagcagccgtgtggtatgattgtaaacgattatgagggaaatgactctgaagcagaagacttgaatttcagggagactttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgttcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcac

SEQ ID NO: 171655 - DNA, 450 bp, Homo sapiens
  Payload ID: 13745
  Gene Symbol: PTPN20
  Gene Name: protein tyrosine phosphatase, non-receptor type 20
  ENST ID: ENST00000513159
  CDS Start-End: 177-371
ctgtggctctgtggtaggggaatgccaccaactccctgaggagcagccgtgtggtatgattggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgttcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcac

SEQ ID NO: 171656 - DNA, 640 bp, Homo sapiens
  Payload ID: 13745
  Gene Symbol: PTPN20
  Gene Name: protein tyrosine phosphatase, non-receptor type 20
  ENST ID: ENST00000513756
  CDS Start-End: 368-562
gacctttggcctgactcacaggacactaaggctccttttctgaagaagccttttaccagtctcatttaggggatgggaacaacatgtcttcacctagggactttagagcagagcctgtgttttctatttgatcagtttttccccccgcctttgttcagtaaacgattatgagggaaatgactctgaagcagaagacttgaatttcagggagactttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgttcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgca

SEQ ID NO: 171657 - DNA, 586 bp, Homo sapiens
  Payload ID: 13745
  Gene Symbol: PTPN20
  Gene Name: protein tyrosine phosphatase, non-receptor type 20
  ENST ID: ENST00000508715
  CDS Start-End: 313-507
ctgtggctctgtggtaggggaatgccaccaactccctgaggagcagccgtgtggtatgattgtgttttctatttgatcagtttttccccccgcctttgttcagtaaacgattatgagggaaatgactctgaagcagaagacttgaatttcagggagactttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgttcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcac

SEQ ID NO: 171658 - DNA, 6089 bp, Homo sapiens
  Payload ID: 13746
  Gene Symbol: PTPN21
  Gene Name: protein tyrosine phosphatase, non-receptor type 21
  Uniprot ID: Q16825
  ENST ID: ENST00000328736
  CDS Start-End: 206-3730
cagcgctggcgtcaatgctcccttcctcgggccattggagactccgttgctttttaatggcggcagcggctgctgggtgagcagctggaggccggacagtgttcgtcccatccggagaggatcgctttctcctggcgtcaccagcgctgggttggtgggggtagcttttccctctttgctcctccattcttgaagaaagaagaagatgccactgccatttgggttgaaactgaaacgcacccggcgctacacggtgtccagcaagagttgcctggttgcccggatccaactgcttaataacgagtttgtggagttcaccctgtccgtggagagcactggccaggaaagcctcgaggccgtggcccagaggctggagctgcgggaggtcacttacttcagcctctggtactacaacaagcaaaatcagcgccggtgggtagatttggaaaaacctttgaagaagcagctggataaatatgcattggaacctaccgtctattttggagtggtgttttatgtgccttcagtttctcagctgcagcaggagattaccaggtatcagtattatctgcaactgaagaaagatatcttggaaggaagtattccttgtaccttagaacaagcaattcagctagcaggcttagctgttcaagcggattttggtgactttgatcagtatgaatcccaggactttcttcagaaatttgccttgtttcctgtgggatggttacaagatgaaaaagtattggaagaagcaacccaaaaagtggccttactacatcagaaatacagagggctcacagctcctgatgctgaaatgctgtacatgcaggaggtagagagaatggatggctatggagaagagagctaccctgctaaggatagccaaggaagtgacatatccattggagcgtgtcttgaaggtatctttgtgaaacacaagaatggaaggcatcctgtggtatttaggtggcatgacattgccaacatgtcccacaacaagtccttttttgcattagagctggcaaataaagaggagaccattcaatttcaaactgaagacatggaaacagcaaaatacatttggagactctgtgttgcgcgacacaagttttacagactaaaccagtgtaacctgcaaactcagactgtcacagtgaacccaatcaggaggaggtcttcttcaaggatgtctctgcctaaaccccagccctacgtgatgcctcccccaccgcagttgcactataatggacattatacagaaccatatgcttcttcccaagataacctctttgtgcccaaccagaacggatactactgtcactctcagacaagcttggatagagcccagattgacctcaacggtcggatccgtaatggcagtgtctacagtgcacacagcaccaactccttaaataatcctcagccctacttgcagccctcgccgatgtcgtccaaccctagcatcaccgggagtgacgtcatgaggcctgactacctcccgtcccatcggcacagcgccgtgatacccccgtcctaccgccccaccccagactatgagactgtgatgaagcagctcaacaggggcctggtgcatgcggaacggcagagccactcgctgcgaaacctcaacatcggcagctcgtacgcctacagcaggcccgcggcgctggtctacagccagcccgagatccgcgagcacgcacagctcccctcgccagcggccgcacactgcccgttcagcctgagctacagcttccacagcccgtctccctacccctaccctgccgagcggcggcccgtggtgggcgcggtcagcgtgccggagctgaccaatgcgcagctgcaggcgcaggactacccgtctcccaacatcatgcggacgcaggtgtaccggccacccccaccctacccgccccccaggcccgccaacagcacgccagacctgtcccgccacctttacatcagcagcagcaaccccgacctcatcacgcggcgcgtgcaccactcggtgcaaacgttccaggaggacagcctgcccgtggcgcactcgctgcaggaggtcagcgagcccctcaccgccgcgcgccacgcgcagctgcacaaacggaacagcatcgaggtggccgggctcagccacggcctggagggcctgcggctcaaggagcgcaccctatccgcgtcggcggcagaggtggcgccgcgagccgtctcggtgggctcccagcccagcgttttcaccgagaggacacagcgagaagggccggaggaggcggagggcttgaggtacggccataagaagtccctgtcggacgccaccatgctaatccacagcagcgaggaggaggaggacgaggacttcgaggaggagagcggggcccgggcgcctcctgcacgtgcgcgcgagcctcggcccggcctggcccaggacccacctggctgccctcgcgtcctgctcgccgggcccctgcacatcctggagcccaaggcccacgtcccagacgcggagaagaggatgatggacagcagccccgtccgcacgaccgcagaggcccagcggccctggagagacgggctgctgatgccctccatgtcggagtccgacctcaccacgtcaggccgctaccgagcccggagggactctctgaagaaaaggccggtgtcggaccttctctctgggaagaagaacatcgtggaagggctcccgcctctagggggaatgaaaaagactcgagtagatgcaaaaaaaattggtcctcttaaactggctgccctaaatggactctccctatctcgagtgcctctgcctgatgaaggaaaggaagtggctaccagagcaacgaatgatgaaaggtgtaaaattctggaacaacgattagaacaaggaatggtattcacagaatatgaaagaattcttaagaaacggctagttgatggggagtgctcaacagcacgactccctgaaaatgcagaaagaaatcgattccaagatgttcttccttatgatgatgtgagagtggagttggtcccaactaaagaaaacaacactggttacatcaacgcatcacatattaaggtctctgtcagtggaatcgaatgggattatattgccacacagggaccattacagaatacctgtcaagatttttggcagatggtatgggaacagggaattgcaattatagcaatggtgacagcagaagaggagggtggaagggagaagagctttaggtactggccacgacttggttccaggcacaacactgtcacctatggaaggtttaagatcacgacccggttccgcacagactctggctgctatgccaccacaggcctgaagatgaagcacctccttactgggcaagagaggaccgtctggcacctccaatacacagactggcctgaacatggctgtccagaagacctcaagggatttttatcatatcttgaagagatccagtctgttcgacgccatacaaatagcacaagtgatccccaaagccccaaccctccgttgttggtccactgcagtgctggggtaggaaggactggcgtggtgattttgtcggagatcatgatcgcctgcctggaacacaatgaggtgctggacatcccgagagtgctggacatgctgaggcaacagagaatgatgctggtgcagactctctgccagtacacatttgtgtacagagtcctcatccagttcctgaaaagctccaggctcatctaagctcccacaatttcttacggggccagtcatgtgaagcgtttacagcttaaaaaaaaagcgcttgcctaactcatactttcccgttgacacttgatccacgcagcgtggcactgggacgtaagtggcgcagtctgaatggcggcacgctgaaggaaacgtgcgaagcacaggctgaagaggggtttctaacctgggaaaggtgctcaaggaggacttggtttcaagggccttgccctgccccggtctgtccggtttgcagtacttgcacacattttggagattgtattttctagacaattctctattttactgaagctatgctgggcaattctggcaatcattaaagtgcatagatttctatcttaaactaatttttgataatggagtttttattttatgacaaatatttagggatttttctagtgagaaacaactttgtgtaaggatgatccacagatatgagttgctcctatataactttgtatttaaaaatcatgttattatcttttgttattttttaaaaaccttgggtacttaataatggtttagttgccaaactgaaaactatactgagaatctgtgttattttgaaacatcaaaaggatttttctatccagaacattttttatcctaaaaattctatatagttgtaccttctgtttttcaaatgagagctcaattcatttagatactgaaatgagtcagttaatgtaaagttgaggatgaaggcacattatttaaaatgtaagagaataagcattattttttcagtattattcatagatctaaatgaatttgattttattggttgaaaatgaagtgaaaaacaattgcctagggtggttttaagcacttttttgttaaaaacaaatctgagttttaatatatgtgttgctttgtagatgacacaataacaatgggcgctgagaagcgttttgggagagattaaggactaagagtatgtaagatgactaggacaagagtaggtggagtgtgatggtaaatgcaggatgccttcgtctttacaaaaatgcagtattatctatactcagactgaggtgctgggatggcgagcaggggaccccacagcactgtccccagggaattcaagtcctgtgaccgccagtgacttactccgtttccttggggcttttcccacctcaacctgtattgtttctttttcataaataaattcagcattatagtatcattaaaagaagccttaaagaggcgtatttttccttttggttgaaggaagggaatagttaataatagttttcacctcttctcccaaaaagtacagtccaaatttgtgcacagagattgctgtggtattcaagaggtacttgcattttagctccttaataattccctggccagtgttagctgtttagtgccccctcacccatcccatttaggcacatcccaatagacagagccaggctgagttacagggggagagtgtcatctctggccccgattaagatggccttgtcacagtgaccgctgagtaggcatggatgagtgggatatttagctgaggaaccctttcccttttccttctttttggggtctcttcttacagtgaacttccaaaatgtcaaatctagggctgtttcccaaattacactattctaggcatcattttgattcccatgtcactccttaactcacttccttgagcactacatgtatgttgtcagccacgagacaggacttcctaaatagtgtgtgcaccagcctaactctgccttacccagaaaccaaccacctaagaggaaaactcagaagatattaatgaaaactaattgaaagtacgcacacttctcatgtaggaacaaaattaaaattttacatttttattttacaaaattaaaaaattacattttgtaggaacaaaatgtaaattttgtaaatacaaaattctttttaaagtcctgtttaaagaacagtagaactaagtgaaaatattcagaacgagctccttagaagaaaggaataagaactttttactggaactattttccatctctagaaaaagtgcttcttcccctccccctccctctccatggtacgtttttgtgaaaatgcttttctgtcaggtttaaacaaacagtttgacatagctcgttgacaagaacatattgtaaaacaaatctaattaaagagtaatatgtggtctatttgtgttcctgttgtaataatttgataagtaaacttctgagggcaaaattactgtttaatattactcttaaaatgttgcatgtttggcgtcattcctaagagccatgtaattttaaacttttaattgcagttagtgaatatgaaaggatttctgaataaaaatctatccacatta

SEQ ID NO: 171659 - DNA, 3943 bp, Homo sapiens
  Payload ID: 13746
  Gene Symbol: PTPN21
  Gene Name: protein tyrosine phosphatase, non-receptor type 21
  ENST ID: ENST00000536337
  CDS Start-End: 114-299
cggacagtgttcgtcccatccggagaggatcgctttctcctggcgtcaccagcgctgggttggtgggggtagcttttccctctttgctcctccattcttgaagaaagaagaagatgccactgccatttgggttgaaactgaaacgcacccggcgctacacggtgtccagcaagagttgcctggttgcccggatccaactgcttaataacgagtttgtggagttcaccctgtccgtggagagcactggccaggaaagcctcgaggccgtggcccagaggctggagctgcgggagggatgaggtctcactccatcacccaggctggagtacagtggcaccgtcatagctcaatgcatcctcaaacacctaggctcaagtgatccttttgccttagcctgccaagagctgggactacaggtcacttacttcagcctctggtactacaacaagcaaaatcagcgccggtgggtagatttggaaaaacctttgaagaagcagctggataaatatgcattggaacctaccgtctattttggagtggtgttttatgtgccttcagtttctcagctgcagcaggagattaccaggtatcagtattatctgcaactgaagaaagatatcttggaaggaagtattccttgtaccttagaacaagcaattcagctagcaggcttagctgttcaagcggattttggtgactttgatcagtatgaatcccaggactttcttcagaaatttgccttgtttcctgtgggatggttacaagatgaaaaagtattggaagaagcaacccaaaaagtggccttactacatcagaaatacagagggctcacagctcctgatgctgaaatgctgtacatgcaggaggtagagagaatggatggctatggagaagagagctaccctgctaaggatagccaaggaagtgacatatccattggagcgtgtcttgaaggtatctttgtgaaacacaagaatggaaggcatcctgtggtatttaggtggcatgacattgccaacatgtcccacaacaagtccttttttgcattagagctggcaaataaagaggagaccattcaatttcaaactgaagacatggaaacagcaaaatacatttggagactctgtgttgcgcgacacaagttttacagactaaaccagtgtaacctgcaaactcagactgtcacagtgaacccaatcaggaggaggtcttcttcaaggatgtctctgcctaaaccccagccctacgtgatgcctcccccaccgcagttgcactataatggacattatacagaaccatatgcttcttcccaagataacctctttgtgcccaaccagaacggatactactgtcactctcagacaagcttggatagagcccagattgacctcaacggtcggatccgtaatggcagtgtctacagtgcacacagcaccaactccttaaataatcctcagccctacttgcagccctcgccgatgtcgtccaaccctagcatcaccgggagtgacgtcatgaggcctgactacctcccgtcccatcggcacagcgccgtgatacccccgtcctaccgccccaccccagactatgagactgtgatgaagcagctcaacaggggcctggtgcatgcggaacggcagagccactcgctgcgaaacctcaacatcggcagctcgtacgcctacagcaggcccgcggcgctggtctacagccagcccgagatccgcgagcacgcacagctcccctcgccagcggccgcacactgcccgttcagcctgagctacagcttccacagcccgtctccctacccctaccctgccgagcggcggcccgtggtgggcgcggtcagcgtgccggagctgaccaatgcgcagctgcaggcgcaggactacccgtctcccaacatcatgcggacgcaggtgtaccggccacccccaccctacccgccccccaggcccgccaacagcacgccagacctgtcccgccacctttacatcagcagcagcaaccccgacctcatcacgcggcgcgtgcaccactcggtgcaaacgttccaggaggacagcctgcccgtggcgcactcgctgcaggaggtcagcgagcccctcaccgccgcgcgccacgcgcagctgcacaaacggaacagcatcgaggtggccgggctcagccacggcctggagggcctgcggctcaaggagcgcaccctatccgcgtcggcggcagaggtggcgccgcgagccgtctcggtgggctcccagcccagcgttttcaccgagaggacacagcgagaagggccggaggaggcggagggcttgaggtacggccataagaagtccctgtcggacgccaccatgctaatccacagcagcgaggaggaggaggacgaggacttcgaggaggagagcggggcccgggcgcctcctgcacgtgcgcgcgagcctcggcccggcctggcccaggacccacctggctgccctcgcgtcctgctcgccgggcccctgcacatcctggagcccaaggcccacgtcccagacgcggagaagaggatgatggacagcagccccgtccgcacgaccgcagaggcccagcggccctggagagacgggctgctgatgccctccatgtcggagtccgacctcaccacgtcaggccgctaccgagcccggagggactctctgaagaaaaggccggtgtcggaccttctctctgggaagaagaacatcgtggaagggctcccgcctctagggggaatgaaaaagactcgagtagatgcaaaaaaaattggtcctcttaaactggctgccctaaatggactctccctatctcgagtgcctctgcctgatgaaggaaaggaagtggctaccagagcaacgaatgatgaaaggtgtaaaattctggaacaacgattagaacaaggaatggtattcacagaatatgaaagaattcttaagaaacggctagttgatggggagtgctcaacagcacgactccctgaaaatgcagaaagaaatcgattccaagatgttcttccttatgatgatgtgagagtggagttggtcccaactaaagaaaacaacactggttacatcaacgcatcacatattaaggtctctgtcagtggaatcgaatgggattatattgccacacagggaccattacagaatacctgtcaagatttttggcagatggtatgggaacagggaattgcaattatagcaatggtgacagcagaagaggagggtggaagggagaagagctttaggtactggccacgacttggttccaggcacaacactgtcacctatggaaggtttaagatcacgacccggttccgcacagactctggctgctatgccaccacaggcctgaagatgaagcacctccttactgggcaagagaggaccgtctggcacctccaatacacagactggcctgaacatggctgtccagaagacctcaagggatttttatcatatcttgaagagatccagtctgttcgacgccatacaaatagcacaagtgatccccaaagccccaaccctccgttgttggtccactgcagtgctggggtaggaaggactggcgtggtgattttgtcggagatcatgatcgcctgcctggaacacaatgaggtgctggacatcccgagagtgctggacatgctgaggcaacagagaatgatgctggtgcagactctctgccagtacacatttgtgtacagagtcctcatccagttcctgaaaagctccaggctcatctaagctcccacaatttcttacggggccagtcatgtgaagcgtttacagcttaaaaaaaaagcgcttgcctaactcatactttcccgttgacacttgatccacgcagcgtggcactgggacgtaagtggcgcagtctgaatggcggcacgctgaaggaaacgtgcgaagcacaggctgaagagggg

SEQ ID NO: 171660 - DNA, 704 bp, Homo sapiens
  Payload ID: 13746
  Gene Symbol: PTPN21
  Gene Name: protein tyrosine phosphatase, non-receptor type 21
  ENST ID: ENST00000553531
  CDS Start-End: 1-387
gccaccacaggcctgaagatgaagcacctccttactgggcaagagaggaccgtctggcacctccaatacacagactggcctgaacatggctgtccagaagacctcaagggatttttatcatatcttgaagagatccagtctgttcgacgccatacaaatagcacaagtgatccccaaagccccaaccctccgttgttggtccactgcagtgctggacatcccgagagtgctggacatgctgaggcaacagagaatgatgctggtgcagactctctgccagtacacatttgtgtacagagtcctcatccagttcctgaaaagctccaggctcatctaagctcccacaatttcttacggggccagtcatgtgaagcgtttacagcttaaaaaaaaagcgcttgcctaactcatactttcccgttgacacttgatccacgcagcgtggcactgggacgtaagtggcgcagtctgaatggcggcacgctgaaggaaacgtgcgaagcacaggctgaagaggggtttctaacctgggaaaggtgctcaaggaggacttggtttcaagggccttgccctgccccggtctgtccggtttgcagtacttgcacacattttggagattgtattttctagacaattctctattttactgaagctatgctgggcaattctggcaatcattaaagtgcatagatttctatcttaaa

SEQ ID NO: 171661 - DNA, 1014 bp, Homo sapiens
  Payload ID: 13746
  Gene Symbol: PTPN21
  Gene Name: protein tyrosine phosphatase, non-receptor type 21
  ENST ID: ENST00000555243
  CDS Start-End: 428-1014
ttcccaaggggaggacgcgggagaagccggggcctgagtgctccaaggccccgtgggcttcttgggtttgttgcctccggccgctcattaactcaggatggcgtggaagacctcgcccgcctccccttctgggccgcggctccgcttaggtgaaggcctgtttgggcgtccccaccctggagaggggccggggtctggattttcagaactgccactcttctagtgcgctggcgtcaatgctcccttcctcgggccattggagactccgttgctttttaatggcggcagcggctgctgggtgagcagctggaggccggacagtgttcgtcccatccggagaggatcgctttctcctggcgtcaccagcgctgggttggtgggggtagcttttccctctttgctcctccattcttgaagaaagaagaagatgccactgccatttgggttgaaactgaaacgcacccggcgctacacggtgtccagcaagagttgcctggttgcccggatccaactgcttaataacgagtttgtggagttcaccctgtccgtggagagcactggccaggaaagcctcgaggccgtggcccagaggctggagctgcgggaggtcacttacttcagcctctggtactacaacaagcaaaatcagcgccggtgggtagatttggaaaaacctttgaagaagcagctggataaatatgcattggaacctaccgtctattttggagtggtgttttatgtgccttcagtttctcagctgcagcaggagattaccaggtatcagtattatctgcaactgaagaaagatatcttggaaggaagtattccttgtaccttagaacaagcaattcagctagcaggcttagctgttcaagcggattttggtgactttgatcagtatgaatcccaggactttcttcagaaatttgccttgtttcctgtgggatggttacaagatgaaaaagtattggaagaagcaacccaaaaagtggccttactacatcagaaatacag

SEQ ID NO: 171662 - DNA, 6166 bp, Homo sapiens
  Payload ID: 13746
  Gene Symbol: PTPN21
  Gene Name: protein tyrosine phosphatase, non-receptor type 21
  Uniprot ID: Q16825
  ENST ID: ENST00000556564
  CDS Start-End: 286-3810
gcggccgcgcggcggggccccgggaggcgggtcgctgagcggggcgcgcggccccgaggatgcgggagcgggagcgggagcagcgctggcgtcaatgctcccttcctcgggccattggagactccgttgctttttaatggcggcagcggctgctgggtgagcagctggaggccggacagtgttcgtcccatccggagaggatcgctttctcctggcgtcaccagcgctgggttggtgggggtagcttttccctctttgctcctccattcttgaagaaagaagaagatgccactgccatttgggttgaaactgaaacgcacccggcgctacacggtgtccagcaagagttgcctggttgcccggatccaactgcttaataacgagtttgtggagttcaccctgtccgtggagagcactggccaggaaagcctcgaggccgtggcccagaggctggagctgcgggaggtcacttacttcagcctctggtactacaacaagcaaaatcagcgccggtgggtagatttggaaaaacctttgaagaagcagctggataaatatgcattggaacctaccgtctattttggagtggtgttttatgtgccttcagtttctcagctgcagcaggagattaccaggtatcagtattatctgcaactgaagaaagatatcttggaaggaagtattccttgtaccttagaacaagcaattcagctagcaggcttagctgttcaagcggattttggtgactttgatcagtatgaatcccaggactttcttcagaaatttgccttgtttcctgtgggatggttacaagatgaaaaagtattggaagaagcaacccaaaaagtggccttactacatcagaaatacagagggctcacagctcctgatgctgaaatgctgtacatgcaggaggtagagagaatggatggctatggagaagagagctaccctgctaaggatagccaaggaagtgacatatccattggagcgtgtcttgaaggtatctttgtgaaacacaagaatggaaggcatcctgtggtatttaggtggcatgacattgccaacatgtcccacaacaagtccttttttgcattagagctggcaaataaagaggagaccattcaatttcaaactgaagacatggaaacagcaaaatacatttggagactctgtgttgcgcgacacaagttttacagactaaaccagtgtaacctgcaaactcagactgtcacagtgaacccaatcaggaggaggtcttcttcaaggatgtctctgcctaaaccccagccctacgtgatgcctcccccaccgcagttgcactataatggacattatacagaaccatatgcttcttcccaagataacctctttgtgcccaaccagaacggatactactgtcactctcagacaagcttggatagagcccagattgacctcaacggtcggatccgtaatggcagtgtctacagtgcacacagcaccaactccttaaataatcctcagccctacttgcagccctcgccgatgtcgtccaaccctagcatcaccgggagtgacgtcatgaggcctgactacctcccgtcccatcggcacagcgccgtgatacccccgtcctaccgccccaccccagactatgagactgtgatgaagcagctcaacaggggcctggtgcatgcggaacggcagagccactcgctgcgaaacctcaacatcggcagctcgtacgcctacagcaggcccgcggcgctggtctacagccagcccgagatccgcgagcacgcacagctcccctcgccagcggccgcacactgcccgttcagcctgagctacagcttccacagcccgtctccctacccctaccctgccgagcggcggcccgtggtgggcgcggtcagcgtgccggagctgaccaatgcgcagctgcaggcgcaggactacccgtctcccaacatcatgcggacgcaggtgtaccggccacccccaccctacccgccccccaggcccgccaacagcacgccagacctgtcccgccacctttacatcagcagcagcaaccccgacctcatcacgcggcgcgtgcaccactcggtgcaaacgttccaggaggacagcctgcccgtggcgcactcgctgcaggaggtcagcgagcccctcaccgccgcgcgccacgcgcagctgcacaaacggaacagcatcgaggtggccgggctcagccacggcctggagggcctgcggctcaaggagcgcaccctatccgcgtcggcggcagaggtggcgccgcgagccgtctcggtgggctcccagcccagcgttttcaccgagaggacacagcgagaagggccggaggaggcggagggcttgaggtacggccataagaagtccctgtcggacgccaccatgctaatccacagcagcgaggaggaggaggacgaggacttcgaggaggagagcggggcccgggcgcctcctgcacgtgcgcgcgagcctcggcccggcctggcccaggacccacctggctgccctcgcgtcctgctcgccgggcccctgcacatcctggagcccaaggcccacgtcccagacgcggagaagaggatgatggacagcagccccgtccgcacgaccgcagaggcccagcggccctggagagacgggctgctgatgccctccatgtcggagtccgacctcaccacgtcaggccgctaccgagcccggagggactctctgaagaaaaggccggtgtcggaccttctctctgggaagaagaacatcgtggaagggctcccgcctctagggggaatgaaaaagactcgagtagatgcaaaaaaaattggtcctcttaaactggctgccctaaatggactctccctatctcgagtgcctctgcctgatgaaggaaaggaagtggctaccagagcaacgaatgatgaaaggtgtaaaattctggaacaacgattagaacaaggaatggtattcacagaatatgaaagaattcttaagaaacggctagttgatggggagtgctcaacagcacgactccctgaaaatgcagaaagaaatcgattccaagatgttcttccttatgatgatgtgagagtggagttggtcccaactaaagaaaacaacactggttacatcaacgcatcacatattaaggtctctgtcagtggaatcgaatgggattatattgccacacagggaccattacagaatacctgtcaagatttttggcagatggtatgggaacagggaattgcaattatagcaatggtgacagcagaagaggagggtggaagggagaagagctttaggtactggccacgacttggttccaggcacaacactgtcacctatggaaggtttaagatcacgacccggttccgcacagactctggctgctatgccaccacaggcctgaagatgaagcacctccttactgggcaagagaggaccgtctggcacctccaatacacagactggcctgaacatggctgtccagaagacctcaagggatttttatcatatcttgaagagatccagtctgttcgacgccatacaaatagcacaagtgatccccaaagccccaaccctccgttgttggtccactgcagtgctggggtaggaaggactggcgtggtgattttgtcggagatcatgatcgcctgcctggaacacaatgaggtgctggacatcccgagagtgctggacatgctgaggcaacagagaatgatgctggtgcagactctctgccagtacacatttgtgtacagagtcctcatccagttcctgaaaagctccaggctcatctaagctcccacaatttcttacggggccagtcatgtgaagcgtttacagcttaaaaaaaaagcgcttgcctaactcatactttcccgttgacacttgatccacgcagcgtggcactgggacgtaagtggcgcagtctgaatggcggcacgctgaaggaaacgtgcgaagcacaggctgaagaggggtttctaacctgggaaaggtgctcaaggaggacttggtttcaagggccttgccctgccccggtctgtccggtttgcagtacttgcacacattttggagattgtattttctagacaattctctattttactgaagctatgctgggcaattctggcaatcattaaagtgcatagatttctatcttaaactaatttttgataatggagtttttattttatgacaaatatttagggatttttctagtgagaaacaactttgtgtaaggatgatccacagatatgagttgctcctatataactttgtatttaaaaatcatgttattatcttttgttattttttaaaaaccttgggtacttaataatggtttagttgccaaactgaaaactatactgagaatctgtgttattttgaaacatcaaaaggatttttctatccagaacattttttatcctaaaaattctatatagttgtaccttctgtttttcaaatgagagctcaattcatttagatactgaaatgagtcagttaatgtaaagttgaggatgaaggcacattatttaaaatgtaagagaataagcattattttttcagtattattcatagatctaaatgaatttgattttattggttgaaaatgaagtgaaaaacaattgcctagggtggttttaagcacttttttgttaaaaacaaatctgagttttaatatatgtgttgctttgtagatgacacaataacaatgggcgctgagaagcgttttgggagagattaaggactaagagtatgtaagatgactaggacaagagtaggtggagtgtgatggtaaatgcaggatgccttcgtctttacaaaaatgcagtattatctatactcagactgaggtgctgggatggcgagcaggggaccccacagcactgtccccagggaattcaagtcctgtgaccgccagtgacttactccgtttccttggggcttttcccacctcaacctgtattgtttctttttcataaataaattcagcattatagtatcattaaaagaagccttaaagaggcgtatttttccttttggttgaaggaagggaatagttaataatagttttcacctcttctcccaaaaagtacagtccaaatttgtgcacagagattgctgtggtattcaagaggtacttgcattttagctccttaataattccctggccagtgttagctgtttagtgccccctcacccatcccatttaggcacatcccaatagacagagccaggctgagttacagggggagagtgtcatctctggccccgattaagatggccttgtcacagtgaccgctgagtaggcatggatgagtgggatatttagctgaggaaccctttcccttttccttctttttggggtctcttcttacagtgaacttccaaaatgtcaaatctagggctgtttcccaaattacactattctaggcatcattttgattcccatgtcactccttaactcacttccttgagcactacatgtatgttgtcagccacgagacaggacttcctaaatagtgtgtgcaccagcctaactctgccttacccagaaaccaaccacctaagaggaaaactcagaagatattaatgaaaactaattgaaagtacgcacacttctcatgtaggaacaaaattaaaattttacatttttattttacaaaattaaaaaattacattttgtaggaacaaaatgtaaattttgtaaatacaaaattctttttaaagtcctgtttaaagaacagtagaactaagtgaaaatattcagaacgagctccttagaagaaaggaataagaactttttactggaactattttccatctctagaaaaagtgcttcttcccctccccctccctctccatggtacgtttttgtgaaaatgcttttctgtcaggtttaaacaaacagtttgacatagctcgttgacaagaacatattgtaaaacaaatctaattaaagagtaatatgtggtctatttgtgttcctgttgtaataatttgataagtaaacttctgagggcaaaattactgtttaatattactcttaaaatgttgcatgtttggcgtcattcctaagagccatgtaattttaaacttttaattgcagttagtgaatatgaaaggatttctgaataaaaatctatccaca

SEQ ID NO: 171663 - DNA, 3654 bp, Homo sapiens
  Payload ID: 13747
  Gene Symbol: PTPN22
  Gene Name: protein tyrosine phosphatase, non-receptor type 22 (lymphoid)
  ENST ID: ENST00000359785
  CDS Start-End: 137-2560
gaagtcagtaaaccacagccttcagcatgctctgctcaggcggcagcagtggctttttggaggtgtctcggccatgacacacatttgacatgccctccctcaacctacttatagactatttttcttgctctgcagcatggaccaaagagaaattctgcagaagttcctggatgaggcccaaagcaagaaaattactaaagaggagtttgccaatgaatttctgaagctgaaaaggcaatctaccaagtacaaggcagacaaaacctatcctacaactgtggctgagaagcccaagaatatcaagaaaaacagatataaggatattttgccctatgattatagccgggtagaactatccctgataacctctgatgaggattccagctacatcaatgccaacttcattaagggagtttatggacccaaggcttatattgccacccagggtcctttatctacaaccctcctggacttctggaggatgatttgggaatatagtgtccttatcattgttatggcatgcatggagtatgaaatgggaaagaaaaagtgtgagcgctactgggctgagccaggagagatgcagctggaatttggccctttctctgtatcctgtgaagctgaaaaaaggaaatctgattatataatcaggactctaaaagttaagttcaatagtgaaactcgaactatctaccagtttcattacaagaattggccagaccatgatgtaccttcatctatagaccctattcttgagctcatctgggatgtacgttgttaccaagaggatgacagtgttcccatatgcattcactgcagtgctggctgtggaaggactggtgttatttgtgctattgattatacatggatgttgctaaaagatgggataattcctgagaacttcagtgttttcagtttgatccgggaaatgcggacacagaggccttcattagttcaaacgcaggaacaatatgaactggtctacaatgctgtattagaactatttaagagacagatggatgttatcagagataaacattctggaacagagagtcaagcaaagcattgtattcctgagaaaaatcacactctccaagcagactcttattctcctaatttaccaaaaagtaccacaaaagcagcaaaaatgatgaaccaacaaaggacaaaaatggaaatcaaagaatcttcttcctttgactttaggacttctgaaataagtgcaaaagaagagctagttttgcaccctgctaaatcaagcacttcttttgactttctggagctaaattacagttttgacaaaaatgctgacacaaccatgaaatggcagacaaaggcatttccaatagttggggagcctcttcagaagcatcaaagtttggatttgggctctcttttgtttgagggatgttctaattctaaacctgtaaatgcagcaggaagatattttaattcaaaggtgccaataacacggaccaaatcaactccttttgaattgatacagcagagagaaaccaaggaggtggacagcaaggaaaacttttcttatttggaatctcaaccacatgattcttgttttgtagagatgcaggctcaaaaagtaatgcatgtttcttcagcagaactgaattattcactgccatatgactctaaacaccaaatacgtaatgcctctaatgtaaagcaccatgactctagtgctcttggtgtatattcttacatacctttagtggaaaatccttatttttcatcatggcctccaagtggtaccagttctaagatgtctcttgatttacctgagaagcaagatggaactgtttttccttcttctctgttgccaacatcctctacatccctcttctcttattacaattcacatgattctttatcactgaattctccaaccaatatttcctcactattgaaccaggagtcagctgtactagcaactgctccaaggatagatgatgaaatcccccctccacttcctgtatggacacctgaatcatttattgtggttgaggaagctggagaattctcaccaaatgttcccaaatccttatcctcagctgtgaaggtaaaaattggaacatcactggaatggggtggaacatctgaaccaaagaaatttgatgactctgtgatacttagaccaagcaagagtgtaaaactccgaagtcctaaatcagaactacatcaagatcgttcttctcccccacctcctctcccagaaagaactctagagtccttctttcttgccgatgaagattgtatgcaggcccaatctatagaaacatattctactagctatcctgacaccatggaaaattcaacatcttcaaaacagacactgaagactcctggaaaaagtttcacaaggagtaagagtttgaaaattttgcgaaacatgaaaaagagtatctgtaattcttgcccaccaaacaagcctgcagaatctgttcagtcaaataactccagctcatttctgaattttggttttgcaaaccgtttttcaaaacccaaaggaccaaggaatccaccaccaacttggaatatttaataaaactccagatttataataatatgggctgcaagtacacctgcaaataaaactactagaatactgctagttaaaataagtgctctatatgcataatatcaaatatgaagatatgctaatgtgttaatagcttttaaaagaaaagcaaaatgccaataagtgccagttttgcattttcatatcatttgcattgagttgaaaactgcaaataaaagtttgtcacttgagcttatgtacagaatgctatatgagaaacacttttagaatggatttatttttcatttttgccagttatttttattttcttttacttttctacataaacataaacttcaaaaggtttgtaagatttggatctcaactaatttctacattgccagaatatactataaaaagttaaaaaaaaaacttactttgtgggttgcaatacaaactgctcttgacaatgactattccctgacagttatttttgcctaaatggagtataccttgtaaatcttcccaaatgttgtggaaaactggaatattaagaaaatgagaaattatatttattagaataaaatgtgcaaataatgacaattatttgaatgtaacaaggaattcaactgaaatcctgataagttttaaccaaagtcattaaattaccaattctagaaaagtaatcaatgaaatataatagctatcttttggtagcaaaagatataaattgtatatgtttatacaggatctttcagatcatgtgcaatttttatctaaccaatcagaaatactagtttaaaatgaatttctatatgaatatggatctgccataagaaaatctagttcaactctaattttatgtagtaaataaattggcaggtaattgtttttacaaagaatccacctgacttcccctaatgcattaaaaatatttttatttaaataactttatttataacttttagaaacatgtagtattgtttaaacatcatttgttcttcagtatttttcatttggaagtccaatagggcaaattgaatgaagtattattatctgtctcttgtagtacaatgtatccaacagacactcaataaactttttggttgttaaactga

SEQ ID NO: 171664 - DNA, 2726 bp, Homo sapiens
  Payload ID: 13747
  Gene Symbol: PTPN22
  Gene Name: protein tyrosine phosphatase, non-receptor type 22 (lymphoid)
  ENST ID: ENST00000420377
  CDS Start-End: 90-2477
agtggctttttggaggtgtctcggccatgacacacatttgacatgccctccctcaacctacttatagactatttttcttgctctgcagcatggaccaaagagaaattctgcagaagttcctggatgaggcccaaagcaagaaaattactaaagaggagtttgccaatgaatttctgaagctgaaaaggcaatctaccaagtacaaggcagacaaaacctatcctacaactgtggctgagaagcccaagaatatcaagaaaaacagatataaggatattttgccctatgattatagccgggtagaactatccctgataacctctgatgaggattccagctacatcaatgccaacttcattaagggagtttatggacccaaggcttatattgccacccagggtcctttatctacaaccctcctggacttctggaggatgatttgggaatatagtgtccttatcattgttatggcatgcatggagtatgaaatgggaaagaaaaagtgtgagcgctactgggctgagccaggagagatgcagctggaatttggccctttctctgtatcctgtgaagctgaaaaaaggaaatctgattatataatcaggactctaaaagttaagttcaatagtgaaactcgaactatctaccagtttcattacaagaattggccagaccatgatgtaccttcatctatagaccctattcttgagctcatctgggatgtacgttgttaccaagaggatgacagtgttcccatatgcattcactgcagtgctggctgtggaaggactggtgttatttgtgctattgattatacatggatgttgctaaaagatgggataattcctgagaacttcagtgttttcagtttgatccgggaaatgcggacacagaggccttcattagttcaaacgcaggaacaatatgaactggtctacaatgctgtattagaactatttaagagacagatggatgttatcagagataaacattctggaacagagagtcaagcaaagcattgtattcctgagaaaaatcacactctccaagcagactcttattctcctaatttaccaaaaagtaccacaaaagcagcaaaaatgatgaaccaacaaaggacaaaaatggaaatcaaagaatcttcttcctttgactttaggacttctgaaataagtgcaaaagaagagctagttttgcaccctgctaaatcaagcacttcttttgactttctggagctaaattacagttttgacaaaaatgctgacacaaccatgaaatggcagacaaaggcatttccaatagttggggagcctcttcagaagcatcaaagtttggatttgggctctcttttgtttgagggatgttctaattctaaacctgtaaatgcagcaggaagatattttaattcaaaggtgccaataacacggaccaaatcaactccttttgaattgatacagcagagagaaaccaaggaggtggacagcaaggaaaacttttcttatttggaatctcaaccacatgattcttgttttgtagagatgcaggctcaaaaagtaatgcatgtttcttcagcagaactgaattattcactgccatatgactctaaacaccaaatacgtaatgcctctaatgtaaagcaccatgactctagtgctcttggtgtatattcttacatacctttagtggaaaatccttatttttcatcatggcctccaagtggtaccagttctaagatgtctcttgatttacctgagaagcaagatggaactgtttttccttcttctctgttgccaacatcctctacatccctcttctcttattacaattcacatgattctttatcactgaattctccaaccaatatttcctcactattgaaccaggagtcagctgtactagcaactgctccaaggatagatgatgaaatcccccctccacttcctgtatggacacctgaatcatttattgtggttgaggaagctggagaattctcaccaaatgttcccaaatccttatcctcagctgtgaaggtaaaaattggaacatcactggaatggggtggaacatctgaaccaaagaaatttgatgactctgtgatacttagaccaagcaagagtgtaaaactccgaagtcctaaatcagaactacatcaagatcgttcttctcccccacctcctctcccagaaagaactctagagtccttctttcttgccgatgaagattgtatgcaggcccaatctatagaaacatattctactagctatcctgacaccatggaaaattcaacatcttcaaaacagacactgaagactcctggaaaaagtttcacaaggagtaagagtttgaaaattttgcgaaacatgaaaaagagtatctgtaattcttgcccaccaaacaagcctgcagaatctgttcagtcaaataactccagctcatttctgaattttggtatgtgtgttattttactgaagagttaaaaaaattacctaaattactcatttacagtataactgattcaactttaaatatgattttaggttgcatgtataggtccttatgtttatattcttttccatgcaatttatctttttatttttaaccttaactacctcttaacatctcacacagaactaaattatctagtatatgtggaaaataaagctaggtaaccaaattattgtgttggcatgtagtaaataaatatgactatccaaatggagaaattg

SEQ ID NO: 171665 - DNA, 2421 bp, Homo sapiens
  Payload ID: 13747
  Gene Symbol: PTPN22
  Gene Name: protein tyrosine phosphatase, non-receptor type 22 (lymphoid)
  ENST ID: ENST00000532224
  CDS Start-End: 86-493
gctttttggaggtgtctcggccatgacacacatttgacatgccctccctcaacctacttatagactatttttcttgctctgcagcatggaccaaagagaaattctgcagaagttcctggatgaggcccaaagcaagaaaattactaaagaggagtttgccaatgaatttctgaagctgaaaaggcaatctaccaagtacaaggcagacaaaacctatcctacaactgtggctgagaagcccaagaatatcaagaaaaacagatataaggatattttgccctatgattatagccgggtagaactatccctgataacctctgatgaggattccagctacatcaatgccaacttcattaagggagtttatggacccaaggcttatattgccacccagggtcctttatctacaaccctcctggacttctggaggatgatttgggaatatagtgtcctttgctggctgtggaaggactggtgttatttgtgctattgattatacatggatgttgctaaaagatgggataattcctgagaacttcagtgttttcagtttgatccgggaaatgcggacacagaggccttcattagttcaaacgcaggaacaatatgaactggtctacaatgctgtattagaactatttaagagacagatggatgttatcagagataaacattctggaacagagagtcaagcaaagcattgtattcctgagaaaaatcacactctccaagcagactcttattctcctaatttaccaaaaagtaccacaaaagcagcaaaaatgatgaaccaacaaaggacaaaaatggaaatcaaagaatcttcttcctttgactttaggacttctgaaataagtgcaaaagaagagctagttttgcaccctgctaaatcaagcacttcttttgactttctggagctaaattacagttttgacaaaaatgctgacacaaccatgaaatggcagacaaaggcatttccaatagttggggagcctcttcagaagcatcaaagtttggatttgggctctcttttgtttgagggatgttctaattctaaacctgtaaatgcagcaggaagatattttaattcaaaggtgccaataacacggaccaaatcaactccttttgaattgatacagcagagagaaaccaaggaggtggacagcaaggaaaacttttcttatttggaatctcaaccacatgattcttgttttgtagagatgcaggctcaaaaagtaatgcatgtttcttcagcagaactgaattattcactgccatatgactctaaacaccaaatacgtaatgcctctaatgtaaagcaccatgactctagtgctcttggtgtatattcttacatacctttagtggaaaatccttatttttcatcatggcctccaagtggtaccagttctaagatgtctcttgatttacctgagaagcaagatggaactgtttttccttcttctctgttgccaacatcctctacatccctcttctcttattacaattcacatgattctttatcactgaattctccaaccaatatttcctcactattgaaccaggagtcagctgtactagcaactgctccaaggatagatgatgaaatcccccctccacttcctgtatggacacctgaatcatttattgtggttgaggaagctggagaattctcaccaaatgttcccaaatccttatcctcagctgtgaaggtaaaaattggaacatcactggaatggggtggaacatctgaaccaaagaaatttgatgactctgtgatacttagaccaagcaagagtgtaaaactccgaagtcctaaatcagaactacatcaagatcgttcttctcccccacctcctctcccagaaagaactctagagtccttctttcttgccgatgaagattgtatgcaggcccaatctatagaaacatattctactagctatcctgacaccatggaaaattcaacatcttcaaaacagacactgaagactcctggaaaaagtttcacaaggagtaagagtttgaaaattttgcgaaacatgaaaaagagtatctgtaattcttgcccaccaaacaagcctgcagaatctgttcagtcaaataactccagctcatttctgaattttggttttgcaaaccgtttttcaaaacccaaaggaccaaggaatccaccaccaacttggaatatttaataaaactccagatttataataatatgggctgcaagtacacctgcaaataaaactactagaatactgctagttaaaataagtgctctatatgcataatatcaaatatgaagatatgctaatgtgttaatagcttttaaaagaaaagcaaaatgccaataagtgccagttttgcattttcatatcatttgcattgagttgaaaactgcaaataaaagtttgtcacttg

SEQ ID NO: 171666 - DNA, 2118 bp, Homo sapiens
  Payload ID: 13747
  Gene Symbol: PTPN22
  Gene Name: protein tyrosine phosphatase, non-receptor type 22 (lymphoid)
  ENST ID: ENST00000525799
  CDS Start-End: 90-2096
agtggctttttggaggtgtctcggccatgacacacatttgacatgccctccctcaacctacttatagactatttttcttgctctgcagcatggaccaaagagaaattctgcagaagttcctggatgaggcccaaagcaagaaaattactaaagaggagtttgccaatgaatttctgaagctgaaaaggcaatctaccaagtacaaggcagacaaaacctatcctacaactgtggctgagaagcccaagaatatcaagaaaaacagatataaggatattttgccctatgattatagccgggtagaactatccctgataacctctgatgaggattccagctacatcaatgccaacttcattaagggagtttatggacccaaggcttatattgccacccagggtcctttatctacaaccctcctggacttctggaggatgatttgggaatatagtgtccttataattcctgagaacttcagtgttttcagtttgatccgggaaatgcggacacagaggccttcattagttcaaacgcaggaacaatatgaactggtctacaatgctgtattagaactatttaagagacagatggatgttatcagagataaacattctggaacagagagtcaagcaaagcattgtattcctgagaaaaatcacactctccaagcagactcttattctcctaatttaccaaaaagtaccacaaaagcagcaaaaatgatgaaccaacaaaggacaaaaatggaaatcaaagaatcttcttcctttgactttaggacttctgaaataagtgcaaaagaagagctagttttgcaccctgctaaatcaagcacttcttttgactttctggagctaaattacagttttgacaaaaatgctgacacaaccatgaaatggcagacaaaggcatttccaatagttggggagcctcttcagaagcatcaaagtttggatttgggctctcttttgtttgagggatgttctaattctaaacctgtaaatgcagcaggaagatattttaattcaaaggtgccaataacacggaccaaatcaactccttttgaattgatacagcagagagaaaccaaggaggtggacagcaaggaaaacttttcttatttggaatctcaaccacatgattcttgttttgtagagatgcaggctcaaaaagtaatgcatgtttcttcagcagaactgaattattcactgccatatgactctaaacaccaaatacgtaatgcctctaatgtaaagcaccatgactctagtgctcttggtgtatattcttacatacctttagtggaaaatccttatttttcatcatggcctccaagtggtaccagttctaagatgtctcttgatttacctgagaagcaagatggaactgtttttccttcttctctgttgccaacatcctctacatccctcttctcttattacaattcacatgattctttatcactgaattctccaaccaatatttcctcactattgaaccaggagtcagctgtactagcaactgctccaaggatagatgatgaaatcccccctccacttcctgtatggacacctgaatcatttattgtggttgaggaagctggagaattctcaccaaatgttcccaaatccttatcctcagctgtgaaggtaaaaattggaacatcactggaatggggtggaacatctgaaccaaagaaatttgatgactctgtgatacttagaccaagcaagagtgtaaaactccgaagtcctaaatcagaactacatcaagatcgttcttctcccccacctcctctcccagaaagaactctagagtccttctttcttgccgatgaagattgtatgcaggcccaatctatagaaacatattctactagctatcctgacaccatggaaaattcaacatcttcaaaacagacactgaagactcctggaaaaagtttcacaaggagtaagagtttgaaaattttgcgaaacatgaaaaagagtatctgtaattcttgcccaccaaacaagcctgcagaatctgttcagtcaaataactccagctcatttctgaattttggtatgtgtgttattttactgaagagttaaaaaaattacctaaattactcat

SEQ ID NO: 171667 - DNA, 1794 bp, Homo sapiens
  Payload ID: 13747
  Gene Symbol: PTPN22
  Gene Name: protein tyrosine phosphatase, non-receptor type 22 (lymphoid)
  Uniprot ID: Q9Y2R2
  ENST ID: ENST00000460620
  CDS Start-End: 90-629
agtggctttttggaggtgtctcggccatgacacacatttgacatgccctccctcaacctacttatagactatttttcttgctctgcagcatggaccaaagagaaattctgcagaagttcctggatgaggcccaaagcaagaaaattactaaagaggagtttgccaatgaatttctgaagctgaaaaggcaatctaccaagtacaaggcagacaaaacctatcctacaactgtggctgagaagcccaagaatatcaagaaaaacagatataaggatattttgccctatgattatagccgggtagaactatccctgataacctctgatgaggattccagctacatcaatgccaacttcattaagggagtttatggacccaaggcttatattgccacccagggtcctttatctacaaccctcctggacttctggaggatgatttgggaatatagtgtccttatcattgttatggcatgcatggagtatgaaatgggaaaggaagctgaaaaaaggaaatctgattatataatcaggactctaaaagttaagttcaatagtgtatctgtaattcttgcccaccaaacaagcctgcagaatctgttcagtcaaataactccagctcatttctgaattttggttttgcaaaccgtttttcaaaacccaaaggaccaaggaatccaccaccaacttggaatatttaataaaactccagatttataataatatgggctgcaagtacacctgcaaataaaactactagaatactgctagttaaaataagtgctctatatgcataatatcaaatatgaagatatgctaatgtgttaatagcttttaaaagaaaagcaaaatgccaataagtgccagttttgcattttcatatcatttgcattgagttgaaaactgcaaataaaagtttgtcacttgagcttatgtacagaatgctatatgagaaacacttttagaatggatttatttttcatttttgccagttatttttattttcttttacttttctacataaacataaacttcaaaaggtttgtaagatttggatctcaactaatttctacattgccagaatatactataaaaagttaaaaaaaaaacttactttgtgggttgcaatacaaactgctcttgacaatgactattccctgacagttatttttgcctaaatggagtataccttgtaaatcttcccaaatgttgtggaaaactggaatattaagaaaatgagaaattatatttattagaataaaatgtgcaaataatgacaattatttgaatgtaacaaggaattcaactgaaatcctgataagttttaaccaaagtcattaaattaccaattctagaaaagtaatcaatgaaatataatagctatcttttggtagcaaaagatataaattgtatatgtttatacaggatctttcagatcatgtgcaatttttatctaaccaatcagaaatactagtttaaaatgaatttctatatgaatatggatctgccataagaaaatctagttcaactctaattttatgtagtaaataaattggcaggtaattgtttttacaaagaatccacctgacttcccctaatgcattaaaaatatttttatttaaataactttatttataacttttagaaacatgtagtattgtttaaacatcatttgttcttcagtatttttcatttggaagtccaatagggcaaattgaatgaagtattattatctgtctcttgtagtacaatgtatccaacagacactcaataaactttttggttgttaaactga

SEQ ID NO: 171668 - DNA, 527 bp, Homo sapiens
  Payload ID: 13747
  Gene Symbol: PTPN22
  Gene Name: protein tyrosine phosphatase, non-receptor type 22 (lymphoid)
  ENST ID: ENST00000529045
  CDS Start-End: 131-409
agtaaaccacagccttcagcatgctctgctcaggcggcagcagtggctttttggaggtgtctcggccatgacacacatttgacatgccctccctcaacctacttatagactatttttcttgctctgcagcatggaccaaagagaaattctgcagaagttcctggatgaggcccaaagcaagaaaattactaaagaggagtttgccaatgaatttctgggtcttgctctgtcacccaggctggagtgccgtggcttgatcatagctcactgcagacttgacttcctggactcaagtgatcctccagcctcagcctcccaaagtgctgagattacaaccatgagccaccacacctggccagagaaagctttctggacctctttgaatagatcaaatcttctattaagctgaaaaggcaatctaccaagtacaaggcagacaaaacctatcctacaactgtggctgagaagcccaagaatatcaagaaaaacagatataaggatattttgccctatgattatagccgggt

SEQ ID NO: 171669 - DNA, 3424 bp, Homo sapiens
  Payload ID: 13747
  Gene Symbol: PTPN22
  Gene Name: protein tyrosine phosphatase, non-receptor type 22 (lymphoid)
  ENST ID: ENST00000528414
  CDS Start-End: 76-2334
ggtgtctcggccatgacacacatttgacatgccctccctcaacctacttatagactatttttcttgctctgcagcatggaccaaagagaaattctgcagaagttcctggatgaggcccaaagcaagaaaattactaaagaggagtttgccaatgaatttctgaagctgaaaaggcaatctaccaagtacaaggcagacaaaacctatcctacaactgtggctgagaagcccaagaatatcaagaaaaacagatataaggatattttgccctatgattatagccgggtagaactatccctgataacctctgatgaggattccagctacatcaatgccaacttcattaagggagtttatggacccaaggcttatattgccacccagggtcctttatctacaaccctcctggacttctggaggatgatttgggaatatagtgtccttatcattgttatggcatgcatggagtatgaaatgggaaagaaaaagtgtgagcgctactgggctgagccaggagagatgcagctggaatttggccctttctctgtatcctgtgaagctgaaaaaaggaaatctgattatataatcaggactctaaaagttaagttcaatagtgaaactcgaactatctaccagtttcattacaagaattggccagaccatgatgtaccttcatctatagaccctattcttgagctcatctgggatgtacgttgttaccaagaggatgacagtgttcccatatgcattcactgcagtgctggctgtggaaggactggtgttatttgtgctattgattatacatggatgttgctaaaagatgggagtcaagcaaagcattgtattcctgagaaaaatcacactctccaagcagactcttattctcctaatttaccaaaaagtaccacaaaagcagcaaaaatgatgaaccaacaaaggacaaaaatggaaatcaaagaatcttcttcctttgactttaggacttctgaaataagtgcaaaagaagagctagttttgcaccctgctaaatcaagcacttcttttgactttctggagctaaattacagttttgacaaaaatgctgacacaaccatgaaatggcagacaaaggcatttccaatagttggggagcctcttcagaagcatcaaagtttggatttgggctctcttttgtttgagggatgttctaattctaaacctgtaaatgcagcaggaagatattttaattcaaaggtgccaataacacggaccaaatcaactccttttgaattgatacagcagagagaaaccaaggaggtggacagcaaggaaaacttttcttatttggaatctcaaccacatgattcttgttttgtagagatgcaggctcaaaaagtaatgcatgtttcttcagcagaactgaattattcactgccatatgactctaaacaccaaatacgtaatgcctctaatgtaaagcaccatgactctagtgctcttggtgtatattcttacatacctttagtggaaaatccttatttttcatcatggcctccaagtggtaccagttctaagatgtctcttgatttacctgagaagcaagatggaactgtttttccttcttctctgttgccaacatcctctacatccctcttctcttattacaattcacatgattctttatcactgaattctccaaccaatatttcctcactattgaaccaggagtcagctgtactagcaactgctccaaggatagatgatgaaatcccccctccacttcctgtatggacacctgaatcatttattgtggttgaggaagctggagaattctcaccaaatgttcccaaatccttatcctcagctgtgaaggtaaaaattggaacatcactggaatggggtggaacatctgaaccaaagaaatttgatgactctgtgatacttagaccaagcaagagtgtaaaactccgaagtcctaaatcagaactacatcaagatcgttcttctcccccacctcctctcccagaaagaactctagagtccttctttcttgccgatgaagattgtatgcaggcccaatctatagaaacatattctactagctatcctgacaccatggaaaattcaacatcttcaaaacagacactgaagactcctggaaaaagtttcacaaggagtaagagtttgaaaattttgcgaaacatgaaaaagagtatctgtaattcttgcccaccaaacaagcctgcagaatctgttcagtcaaataactccagctcatttctgaattttggttttgcaaaccgtttttcaaaacccaaaggaccaaggaatccaccaccaacttggaatatttaataaaactccagatttataataatatgggctgcaagtacacctgcaaataaaactactagaatactgctagttaaaataagtgctctatatgcataatatcaaatatgaagatatgctaatgtgttaatagcttttaaaagaaaagcaaaatgccaataagtgccagttttgcattttcatatcatttgcattgagttgaaaactgcaaataaaagtttgtcacttgagcttatgtacagaatgctatatgagaaacacttttagaatggatttatttttcatttttgccagttatttttattttcttttacttttctacataaacataaacttcaaaaggtttgtaagatttggatctcaactaatttctacattgccagaatatactataaaaagttaaaaaaaaaacttactttgtgggttgcaatacaaactgctcttgacaatgactattccctgacagttatttttgcctaaatggagtataccttgtaaatcttcccaaatgttgtggaaaactggaatattaagaaaatgagaaattatatttattagaataaaatgtgcaaataatgacaattatttgaatgtaacaaggaattcaactgaaatcctgataagttttaaccaaagtcattaaattaccaattctagaaaagtaatcaatgaaatataatagctatcttttggtagcaaaagatataaattgtatatgtttatacaggatctttcagatcatgtgcaatttttatctaaccaatcagaaatactagtttaaaatgaatttctatatgaatatggatctgccataagaaaatctagttcaactctaattttatgtagtaaataaattggcaggtaattgtttttacaaagaatccacctgacttcccctaatgcattaaaaatatttttatttaaataactttatttataacttttagaaacatgtagtattgtttaaacatcatttgttcttcagtatttttcatttggaagtccaatagggcaaattgaatgaagtattattatctgtctcttgtagtacaatgtatccaacagacactcaataaactttttggttgttaaa

SEQ ID NO: 171670 - DNA, 3575 bp, Homo sapiens
  Payload ID: 13747
  Gene Symbol: PTPN22
  Gene Name: protein tyrosine phosphatase, non-receptor type 22 (lymphoid)
  ENST ID: ENST00000538253
  CDS Start-End: 131-2482
agtaaaccacagccttcagcatgctctgctcaggcggcagcagtggctttttggaggtgtctcggccatgacacacatttgacatgccctccctcaacctacttatagactatttttcttgctctgcagcatggaccaaagagaaattctgcagaagttcctggatgaggcccaaagcaagaaaattactaaagaggagtttgccaatgaatttctgaagctgaaaaggcaatctaccaagtacaaggcagacaaaacctatcctacaactgtggctgagaagcccaagaatatcaagaaaaacagatataaggatattttgccctatgattatagccgggtagaactatccctgataacctctgatgaggattccagctacatcaatgccaacttcattaagggagtttatggacccaaggcttatattgccacccagggtcctttatctacaaccctcctggacttctggaggatgatttgggaatatagtgtccttatcattgttatggcatgcatggagtatgaaatgggaaaggaagctgaaaaaaggaaatctgattatataatcaggactctaaaagttaagttcaatagtgaaactcgaactatctaccagtttcattacaagaattggccagaccatgatgtaccttcatctatagaccctattcttgagctcatctgggatgtacgttgttaccaagaggatgacagtgttcccatatgcattcactgcagtgctggctgtggaaggactggtgttatttgtgctattgattatacatggatgttgctaaaagatgggataattcctgagaacttcagtgttttcagtttgatccgggaaatgcggacacagaggccttcattagttcaaacgcaggaacaatatgaactggtctacaatgctgtattagaactatttaagagacagatggatgttatcagagataaacattctggaacagagagtcaagcaaagcattgtattcctgagaaaaatcacactctccaagcagactcttattctcctaatttaccaaaaagtaccacaaaagcagcaaaaatgatgaaccaacaaaggacaaaaatggaaatcaaagaatcttcttcctttgactttaggacttctgaaataagtgcaaaagaagagctagttttgcaccctgctaaatcaagcacttcttttgactttctggagctaaattacagttttgacaaaaatgctgacacaaccatgaaatggcagacaaaggcatttccaatagttggggagcctcttcagaagcatcaaagtttggatttgggctctcttttgtttgagggatgttctaattctaaacctgtaaatgcagcaggaagatattttaattcaaaggtgccaataacacggaccaaatcaactccttttgaattgatacagcagagagaaaccaaggaggtggacagcaaggaaaacttttcttatttggaatctcaaccacatgattcttgttttgtagagatgcaggctcaaaaagtaatgcatgtttcttcagcagaactgaattattcactgccatatgactctaaacaccaaatacgtaatgcctctaatgtaaagcaccatgactctagtgctcttggtgtatattcttacatacctttagtggaaaatccttatttttcatcatggcctccaagtggtaccagttctaagatgtctcttgatttacctgagaagcaagatggaactgtttttccttcttctctgttgccaacatcctctacatccctcttctcttattacaattcacatgattctttatcactgaattctccaaccaatatttcctcactattgaaccaggagtcagctgtactagcaactgctccaaggatagatgatgaaatcccccctccacttcctgtatggacacctgaatcatttattgtggttgaggaagctggagaattctcaccaaatgttcccaaatccttatcctcagctgtgaaggtaaaaattggaacatcactggaatggggtggaacatctgaaccaaagaaatttgatgactctgtgatacttagaccaagcaagagtgtaaaactccgaagtcctaaatcagaactacatcaagatcgttcttctcccccacctcctctcccagaaagaactctagagtccttctttcttgccgatgaagattgtatgcaggcccaatctatagaaacatattctactagctatcctgacaccatggaaaattcaacatcttcaaaacagacactgaagactcctggaaaaagtttcacaaggagtaagagtttgaaaattttgcgaaacatgaaaaagagtatctgtaattcttgcccaccaaacaagcctgcagaatctgttcagtcaaataactccagctcatttctgaattttggttttgcaaaccgtttttcaaaacccaaaggaccaaggaatccaccaccaacttggaatatttaataaaactccagatttataataatatgggctgcaagtacacctgcaaataaaactactagaatactgctagttaaaataagtgctctatatgcataatatcaaatatgaagatatgctaatgtgttaatagcttttaaaagaaaagcaaaatgccaataagtgccagttttgcattttcatatcatttgcattgagttgaaaactgcaaataaaagtttgtcacttgagcttatgtacagaatgctatatgagaaacacttttagaatggatttatttttcatttttgccagttatttttattttcttttacttttctacataaacataaacttcaaaaggtttgtaagatttggatctcaactaatttctacattgccagaatatactataaaaagttaaaaaaaaaacttactttgtgggttgcaatacaaactgctcttgacaatgactattccctgacagttatttttgcctaaatggagtataccttgtaaatcttcccaaatgttgtggaaaactggaatattaagaaaatgagaaattatatttattagaataaaatgtgcaaataatgacaattatttgaatgtaacaaggaattcaactgaaatcctgataagttttaaccaaagtcattaaattaccaattctagaaaagtaatcaatgaaatataatagctatcttttggtagcaaaagatataaattgtatatgtttatacaggatctttcagatcatgtgcaatttttatctaaccaatcagaaatactagtttaaaatgaatttctatatgaatatggatctgccataagaaaatctagttcaactctaattttatgtagtaaataaattggcaggtaattgtttttacaaagaatccacctgacttcccctaatgcattaaaaatatttttatttaaataactttatttataacttttagaaacatgtagtattgtttaaacatcatttgttcttcagtatttttcatttggaagtccaatagggcaaattgaatgaagtattattatctgtctcttgtagtacaatgtatccaacagacactcaataaactttttggttgttaaactg

SEQ ID NO: 171671 - DNA, 5244 bp, Homo sapiens
  Payload ID: 13748
  Gene Symbol: PTPN23
  Gene Name: protein tyrosine phosphatase, non-receptor type 23
  Uniprot ID: Q9H3S7
  ENST ID: ENST00000265562
  CDS Start-End: 78-4988
cggggctgggctcgtggctgagccagcagctgcagcagctacgggagtggccgggtggccggcgggtgccagccgccatggaggccgtgccccgcatgcccatgatctggctggacctgaaggaggccggtgactttcacttccagccagctgtgaagaagtttgtcctgaagaattatggagagaacccagaagcctacaatgaagaactgaagaagctggagttgctcagacagaatgctgtccgtgtcccacgagactttgagggctgtagtgtcctccgcaagtacctcggccagcttcattacctgcagagtcgggtccccatgggctcgggccaggaggccgctgtccctgtcacctggacagagatcttctcaggcaagtctgtggcccatgaggacatcaagtacgagcaggcctgtattctctacaaccttggagcgctgcactccatgctgggggccatggacaagcgggtgtctgaggagggcatgaaggtctcctgtacccatttccagtgcgcagccggcgccttcgcctacctacgggagcacttccctcaagcctacagcgtcgacatgagccgccagatccttacgctcaacgtcaacctcatgctgggccaggctcaggagtgcctcctggagaagtcgatgttggacaacaggaagagctttctggtggcccgcatcagtgcacaggtggtagattactacaaggaggcatgccgggccttggagaaccccgacactgcctcactgctgggccggatccagaaggactggaagaaacttgtgcagatgaagatctactacttcgcagccgtggctcatctgcacatgggaaagcaggccgaggagcagcagaagttcggggagcgggttgcatacttccagagcgccctggacaagctcaatgaagccatcaagttggccaagggccagcctgacactgtgcaagacgcgcttcgcttcactatggatgtcattgggggaaagtacaattctgccaagaaggacaacgacttcatttaccatgaggctgtcccagcattggacactcttcagcctgtaaaaggagcccccttggtgaagcccttgccagtgaaccccacagacccagctgttacaggccctgacatctttgccaaactggtacccatggctgcccacgaggcctcgtcactgtacagtgaggagaaggccaagctgctccgggagatgatggccaagattgaggacaagaatgaggtcctggaccagttcatggattcaatgcagttggatcccgagacggtggacaaccttgatgcctacagccacatcccaccccagctcatggagaagtgcgcggctctcagcgtccggcccgacactgtcaggaaccttgtacagtccatgcaagtgctgtcaggtgtgttcacggatgtggaggcttccctgaaggacatcagagatctgttggaggaggatgagctgctagagcagaagtttcaggaggcggtgggccaggcaggggccatctccatcacctccaaggctgagctggcagaggtgaggcgagaatgggccaagtacatggaagtccatgagaaggcctccttcaccaacagtgagctgcaccgtgccatgaacctgcacgtcggcaacctgcgcctgctcagcgggccgcttgaccaggtccgggctgccctgcccacaccggccctctccccagaggacaaggccgtgctgcaaaacctaaagcgcatcctggctaaggtgcaggagatgcgggaccagcgcgtgtccctggagcagcagctgcgtgagcttatccagaaagatgacatcactgcctcgctggtcaccacagaccactcagagatgaagaagttgttcgaggagcagctgaaaaagtatgaccagctgaaggtgtacctggagcagaacctggccgcccaggaccgtgtcctctgtgcactgacagaggccaacgtgcagtacgcagccgtgcggcgggtactcagcgacttggaccaaaagtggaactccacgctgcagaccctggtggcctcgtatgaagcctatgaggacctgatgaagaagtcgcaggagggcagggacttctacgcagatctggagagcaaggtggctgctctgctggagcgcacgcagtccacctgccaggcccgcgaggctgcccgccagcagctcctggacagggagctgaagaagaagccgccgccacggcccacagccccaaagccgctgctgccccgcagggaggagagtgaggcagtggaagcaggagacccccctgaggagctgcgcagcctcccccctgacatggtggctggcccacgactgcctgacaccttcctgggaagtgccaccccgctccactttcctcccagccccttccccagctccacaggcccaggaccccactatctctcaggccccttgccccctggtacctactcgggccccacccagctgatacagcccagggccccagggccccatgcaatgcccgtagcacctgggcctgccctctacccagcccctgcctacacaccggagctgggccttgtgccccgatcctccccacagcatggcgtggtgagcagtccctatgtgggggtagggccggccccaccagttgcaggtctcccctcggccccacctcctcaattctcaggccccgagttggccatggcggttcggccagccaccaccacagtagatagcatccaggcgcccatccccagccacacagccccacggccaaaccccacccctgctcctcccccgccctgcttccctgtgcccccaccgcagccactgcccacgccttacacctaccctgcaggggctaagcaacccatcccggcacagcaccacttctcttctgggatccccgcaggttttccagccccaaggattgggccccagccccagccccatcctcagccccatccttcacaagcgtttgggcctcagcccccacagcagccccttccactccagcatccacatctcttcccaccccaggccccaggactcctacccccacaatccccctacccctatgcccctcagcctggggtcctggggcagccgccaccccccctacacacccagctctacccaggtcccgctcaagaccctctgccagcccactcaggggctctgcctttccccagccctgggccccctcagcctccccatcccccactggcatatggtcctgccccttctaccagacccatgggcccccaggcagcccctcttaccattcgagggccctcgtctgctggccagtccacccctagtccccacctggtgccttcacctgccccatctccagggcctggtccggtaccccctcgccccccagcagcagaaccacccccttgcctgcgccgaggcgccgcagctgcagacctgctctcctccagcccggagagccagcatggcggcactcagtctcctgggggtgggcagcccctgctgcagcccaccaaggtggatgcagctgagggtcgtcggccgcaggccctgcggctgattgagcgggacccctatgagcatcctgagaggctgcggcagttgcagcaggagctggaggcctttcggggtcagctgggggatgtgggagctctggacactgtctggcgagagctgcaagatgcgcaggaacatgatgcccgaggccgttccatcgccattgcccgctgctactcactgaagaaccggcaccaggatgtcatgccctatgacagtaaccgtgtggtgctgcgctcaggcaaggatgactacatcaatgccagctgcgtggaggggctctccccatactgccccccgctagtggcaacccaggccccactgcctggcacagctgctgacttctggctcatggtccatgagcagaaagtgtcagtcattgtcatgctggtttctgaggctgagatggagaagcaaaaagtggcacgctacttccccaccgagaggggccagcccatggtgcacggtgccctgagcctggcattgagcagcgtccgcagcaccgaaacccatgtggagcgcgtgctgagcctgcagttccgagaccagagcctcaagcgctctcttgtgcacctgcacttccccacttggcctgagttaggcctgcccgacagccccagcaacttgctgcgcttcatccaggaggtgcacgcacattacctgcatcagcggccgctgcacacgcccatcattgtgcactgcagctctggtgtgggccgcacgggagcctttgcactgctctatgcagctgtgcaggaggtggaggctgggaacggaatccctgagctgcctcagctggtgcggcgcatgcggcagcagagaaagcacatgctgcaggagaagctgcacctcaggttctgctatgaggcagtggtgagacacgtggagcaggtcctgcagcgccatggtgtgcctcctccatgcaaacccttggccagtgcaagcatcagccagaagaaccaccttcctcaggactcccaggacctggtcctcggtggggatgtgcccatcagctccatccaggccaccattgccaagctcagcattcggcctcctggggggttggagtccccggttgccagcttgccaggccctgcagagcccccaggcctcccgccagccagcctcccagagtctaccccaatcccatcttcctccccgccccccctttcctccccactacctgaggctccccagcctaaggaggagccgccagtgcctgaagcccccagctcggggcccccctcctcctccctggaattgctggcctccttgaccccagaggccttctccctggacagctccctgcggggcaaacagcggatgagcaagcataactttctgcaggcccataacgggcaagggctgcgggccacccggccctctgacgaccccctcagccttctggatccactctggacactcaacaagacctgaacaggttttgcctacctggtccttacactacatcatcatcatctcatgcccacctgcccacacccagcagagcttctcagtgggcacagtctcttactcccatttctgctgcctttggccctgcctggcccagcctgcacccctgtggggtggaaatgtactgcaggctctgggtcaggttctgctcctttatgggacccgacatttttcagctctttgctattgaaataataaaccaccctgttctgtggcccgt

SEQ ID NO: 171672 - DNA, 592 bp, Homo sapiens
  Payload ID: 13748
  Gene Symbol: PTPN23
  Gene Name: protein tyrosine phosphatase, non-receptor type 23
  ENST ID: ENST00000456221
  CDS Start-End: 84-592
aaggggcggggctgggctcgtggctgagccagcagctgcagcagctacgggagtggccgggtggccggcgggtgccagccgccatggaggccgtgccccgcatgcccatgatctggctggacctgaaggaggccggtgactttcacttccagccagctgtgaagaagaatgctgtccgtgtcccacgagactttgagggctgtagtgtcctccgcaagtacctcggccagcttcattacctgcagagtcgggtccccatgggctcgggccaggaggccgctgtccctgtcacctggacagagatcttctcaggcaagtctgtggcccatgaggacatcaagtacgagcaggcctgtattctctacaaccttggagcgctgcactccatgctgggggccatggacaagcgggtgtctgaggagtgcgcagccggcgccttcgcctacctacgggagcacttccctcaagcctacagcgtcgacatgagccgccagatccttacgctcaacgtcaacctcatgctgggccaggctcaggagtgcctcctggagaagtcgatgttggacaacaggaagagctttctggtggcccg

SEQ ID NO: 171673 - DNA, 5119 bp, Homo sapiens
  Payload ID: 13748
  Gene Symbol: PTPN23
  Gene Name: protein tyrosine phosphatase, non-receptor type 23
  ENST ID: ENST00000602307
  CDS Start-End: 87-281
acgaaggggcggggctgggctcgtggctgagccagcagctgcagcagctacgggagtggccgggtggccggcgggtgccagccgccatggaggccgtgccccgcatgcccatgatctggctggacctgaaggaggccggtgactttcacttccagccagctgtgaagaagtttgtcctgaagaattatggagagaacccagaagcctacaatgaagaactgaagaagctggagttgctcagacaggacagagatcttctcaggcaagtctgtggcccatgaggacatcaagtacgagcaggcctgtattctctacaaccttggagcgctgcactccatgctgggggccatggacaagcgggtgtctgaggagggcatgaaggtctcctgtacccatttccagtgcgcagccggcgccttcgcctacctacgggagcacttccctcaagcctacagcgtcgacatgagccgccagatccttacgctcaacgtcaacctcatgctgggccaggctcaggagtgcctcctggagaagtcgatgttggacaacaggaagagctttctggtggcccgcatcagtgcacaggtggtagattactacaaggaggcatgccgggccttggagaaccccgacactgcctcactgctgggccggatccagaaggactggaagaaacttgtgcagatgaagatctactacttcgcagccgtggctcatctgcacatgggaaagcaggccgaggagcagcagaagttcggggagcgggttgcatacttccagagcgccctggacaagctcaatgaagccatcaagttggccaagggccagcctgacactgtgcaagacgcgcttcgcttcactatggatgtcattgggggaaagtacaattctgccaagaaggacaacgacttcatttaccatgaggctgtcccagcattggacactcttcagcctgtaaaaggagcccccttggtgaagcccttgccagtgaaccccacagacccagctgttacaggccctgacatctttgccaaactggtacccatggctgcccacgaggcctcgtcactgtacagtgaggagaaggccaagctgctccgggagatgatggccaagattgaggacaagaatgaggtcctggaccagttcatggattcaatgcagttggatcccgagacggtggacaaccttgatgcctacagccacatcccaccccagctcatggagaagtgcgcggctctcagcgtccggcccgacactgtcaggaaccttgtacagtccatgcaagtgctgtcaggtgtgttcacggatgtggaggcttccctgaaggacatcagagatctgttggaggaggatgagctgctagagcagaagtttcaggaggcggtgggccaggcaggggccatctccatcacctccaaggctgagctggcagaggtgaggcgagaatgggccaagtacatggaagtccatgagaaggcctccttcaccaacagtgagctgcaccgtgccatgaacctgcacgtcggcaacctgcgcctgctcagcgggccgcttgaccaggtccgggctgccctgcccacaccggccctctccccagaggacaaggccgtgctgcaaaacctaaagcgcatcctggctaaggtgcaggagatgcgggaccagcgcgtgtccctggagcagcagctgcgtgagcttatccagaaagatgacatcactgcctcgctggtcaccacagaccactcagagatgaagaagttgttcgaggagcagctgaaaaagtatgaccagctgaaggtgtacctggagcagaacctggccgcccaggaccgtgtcctctgtgcactgacagaggccaacgtgcagtacgcagccgtgcggcgggtactcagcgacttggaccaaaagtggaactccacgctgcagaccctggtggcctcgtatgaagcctatgaggacctgatgaagaagtcgcaggagggcagggacttctacgcagatctggagagcaaggtggctgctctgctggagcgcacgcagtccacctgccaggcccgcgaggctgcccgccagcagctcctggacagggagctgaagaagaagccgccgccacggcccacagccccaaagccgctgctgccccgcagggaggagagtgaggcagtggaagcaggagacccccctgaggagctgcgcagcctcccccctgacatggtggctggcccacgactgcctgacaccttcctgggaagtgccaccccgctccactttcctcccagccccttccccagctccacaggcccaggaccccactatctctcaggccccttgccccctggtacctactcgggccccacccagctgatacagcccagggccccagggccccatgcaatgcccgtagcacctgggcctgccctctacccagcccctgcctacacaccggagctgggccttgtgccccgatcctccccacagcatggcgtggtgagcagtccctatgtgggggtagggccggccccaccagttgcaggtctcccctcggccccacctcctcaattctcaggccccgagttggccatggcggttcggccagccaccaccacagtagatagcatccaggcgcccatccccagccacacagccccacggccaaaccccacccctgctcctcccccgccctgcttccctgtgcccccaccgcagccactgcccacgccttacacctaccctgcaggggctaagcaacccatcccggcacagcaccacttctcttctgggatccccgcaggttttccagccccaaggattgggccccagccccagccccatcctcagccccatccttcacaagcgtttgggcctcagcccccacagcagccccttccactccagcatccacatctcttcccaccccaggccccaggactcctacccccacaatccccctacccctatgcccctcagcctggggtcctggggcagccgccaccccccctacacacccagctctacccaggtcccgctcaagaccctctgccagcccactcaggggctctgcctttccccagccctgggccccctcagcctccccatcccccactggcatatggtcctgccccttctaccagacccatgggcccccaggcagcccctcttaccattcgagggccctcgtctgctggccagtccacccctagtccccacctggtgccttcacctgccccatctccagggcctggtccggtaccccctcgccccccagcagcagaaccacccccttgcctgcgccgaggcgccgcagctgcagacctgctctcctccagcccggagagccagcatggcggcactcagtctcctgggggtgggcagcccctgctgcagcccaccaaggtggatgcagctgagggtcgtcggccgcaggccctgcggctgattgagcgggacccctatgagcatcctgagaggctgcggcagttgcagcaggagctggaggcctttcggggtcagctgggggatgtgggagctctggacactgtctggcgagagctgcaagatgcgcaggaacatgatgcccgaggccgttccatcgccattgcccgctgctactcactgaagaaccggcaccaggatgtcatgccctatgacagtaaccgtgtggtgctgcgctcaggcaaggatgactacatcaatgccagctgcgtggaggggctctccccatactgccccccgctagtggcaacccaggccccactgcctggcacagctgctgacttctggctcatggtccatgagcagaaagtgtcagtcattgtcatgctggtttctgaggctgagatggagaagcaaaaagtggcacgctacttccccaccgagaggggccagcccatggtgcacggtgccctgagcctggcattgagcagcgtccgcagcaccgaaacccatgtggagcgcgtgctgagcctgcagttccgagaccagagcctcaagcgctctcttgtgcacctgcacttccccacttggcctgagttaggcctgcccgacagccccagcaacttgctgcgcttcatccaggaggtgcacgcacattacctgcatcagcggccgctgcacacgcccatcattgtgcactgcagctctggtgtgggccgcacgggagcctttgcactgctctatgcagctgtgcaggaggtggaggctgggaacggaatccctgagctgcctcagctggtgcggcgcatgcggcagcagagaaagcacatgctgcaggagaagctgcacctcaggttctgctatgaggcagtggtgagacacgtggagcaggtcctgcagcgccatggtgtgcctcctccatgcaaacccttggccagtgcaagcatcagccagaagaaccaccttcctcaggactcccaggacctggtcctcggtggggatgtgcccatcagctccatccaggccaccattgccaagctcagcattcggcctcctggggggttggagtccccggttgccagcttgccaggccctgcagagcccccaggcctcccgccagccagcctcccagagtctaccccaatcccatcttcctccccgccccccctttcctccccactacctgaggctccccagcctaaggaggagccgccagtgcctgaagcccccagctcggggcccccctcctcctccctggaattgctggcctccttgaccccagaggccttctccctggacagctccctgcggggcaaacagcggatgagcaagcataactttctgcaggcccataacgggcaagggctgcgggccacccggccctctgacgaccccctcagccttctggatccactctggacactcaacaagacctgaacaggttttgcctacctggtccttacactacatcatcatcatctcatgcccacctgcccacacccagcagagcttctcagtgggcacagtctcttactcccatttctgctgcctttggccctgcctggcccagcctgcacccctgtggggtggaaatgtactgcaggctctgggtcaggttctgctcctttatgggacccgacatttttcagctctttgctattgaaataataaaccaccctgttctgtg

SEQ ID NO: 171674 - DNA, 6832 bp, Homo sapiens
  Payload ID: 13749
  Gene Symbol: PTPN3
  Gene Name: protein tyrosine phosphatase, non-receptor type 3
  ENST ID: ENST00000262539
  CDS Start-End: 113-2632
atgctcagacggcggccaggtcgcgccgcgagcgagcttccgcgccgcccgcacgcgcgacctacctgggcgctccgcgcccccggatgctgcaggttattcagcgatagttatgacctcccggttacgtgcgttgggtggaagaattaataatatacgcacctcggagttacccaaagagaaaactcgatcagaagtcatttgcagcatccactttttagatggcgtggtacagacctttaaagttactaaacaagacactggccaggttcttctggatatggtgcacaaccacctgggtgtgactgaaaaggaatattttggtttacagcatgatgacgactccgtggactctcctagatggctggaagcaagcaaagccatcaggaagcagttaaaaggaggtttcccctgtaccctgcattttcgagtaagattttttatacctgatcccaacacactgcagcaagaacaaaccaggcacttgtatttcttacaactgaagatggatatttgcgaaggaaggttaacctgccctcttaactcagcagtggttctagcgtcctatgccgtacaatctcattttggagactataattcttccatacatcatccaggctatctttccgatagtcactttatacccgatcaaaatgaggactttttaacaaaagtcgaatctctgcatgagcagcacagtgggctaaaacaatcagaagcagaatcctgctatatcaacatagcgcggaccctcgacttctatggagtagaactgcacagtggtagggatctgcacaatttagacctaatgattggaattgcttccgcgggtgttgctgtgtaccgaaaatacatttgcacaagtttctatccttgggtgaacattctcaaaatttctttcaaaaggaaaaagttcttcatacatcagcgacagaaacaggctgaatccagggaacatattgtggccttcaacatgctgaattaccgatcttgcaaaaacttgtggaaatcctgtgttgagcaccatacgttctttcaggcaaagaagctactacctcaggaaaagaatgttctgtctcagtactggactatgggctctcggaacaccaaaaagtcggtaaataaccaatattgcaaaaaggtgattggcgggatggtgtggaacccagccatgcggagatccttatcagtggagcacttagaaaccaagagtctgccttctcgttcccctcccattactcccaactggcgaagtcctcggctccggcacgaaatccgaaagccacgccactcttctgcagataaccttgcaaatgaaatgacctacatcacggaaacggaagatgtattttacacgtacaagggctctctggcccctcaagacagcgattctgaagtttctcagaaccgaagcccgcaccaagagagtttatccgagaacaatccggcacaaagctacctgacccagaagtcatccagttctgtgtctccatcttcaaatgctccaggctcctgctcacctgacggcgttgatcagcagctcttagatgacttccacagggtgaccaaagggggctccaccgaggacgccagccagtactactgtgacaagaatgataatggtgacagctacttagtcttgatccgtatcacaccagatgaagatggaaaatttggatttaatcttaagggaggagtggatcaaaagatgcctcttgtggtatcaaggataaacccagagtcacctgcggacacctgcattcctaagctgaacgaaggggatcaaatcgtgttaatcaatggccgggacatctcagaacacacgcatgaccaagtggtgatgttcatcaaagccagccgggagtcccactcacgggagctggccctggtgatcaggaggagagctgtccgctcatttgctgacttcaagtctgaagatgaactgaaccagcttttccccgaagccattttccccatgtgtccggagggtggggacactttggagggatccatggcacagctaaagaagggcctcgaaagcgggacggtgctgatccagtttgagcaactctacagaaaaaagccaggtttggccatcacgtttgcaaagctgcctcaaaatttggacaaaaaccgatataaagatgtgctgccttatgacaccacccgggtattattgcagggaaatgaagattatattaatgcaagttacgtgaacatggaaattcctgctgctaaccttgtgaacaagtacatcgccactcaggggcccctgccgcatacctgtgcacagttttggcaggttgtctgggatcagaagttgtcactcattgtcatgttgacgactctcacagaacgagggcggaccaaatgtcaccagtactggccagatccccccgacgtcatgaaccacggcggctttcacatccagtgtcagtcagaggactgcaccatcgcctatgtgtcccgagaaatgctggtcacaaacacccaggtgagccgcagcctgaggggcacggtggaggggcaggtgctgaatcagcggccactgtcatcccaggtggtcacgcttctaggtgtgcactctgtttgcacctggcaagcgtgtcaaccggggaagaacacacagtgacacatctccagtacgtcgcatggcctgaccacggtgtgcccgatgactcctccgactttctggaatttgtaaactatgtgaggtctctgagagtggacagcgagcccgtcctagttcactgcagtgctggaataggtcgaaccggtgtgttggtcactatggaaacagccatgtgcctaactgagaggaacctgcccatttacccactggatattgtccgaaaaatgcgagaccagcgcgccatgatggtgcagacatcaagccagtacaagtttgtgtgtgaagcgattcttcgtgtgtatgaagaaggtttagtccaaatgctggatcctagttaagacaactgtgaaaaagttcattcctctttcccaagggcatcctccttgaaagaggaggacagacctctctggaagcagcaagaggaaccagtagctgtgggaaaggaatgggcacctctgaacccaggcactttaaacttctatagaaaagatatcgtgtacataggaactggtgtagataagcatgcaattatggcatcatttaggcctgtatttctatggaaagatacaaaaaggatctcagtttggggcctgtcctaatgccttcttccctaacatcaccacacacacccctgtcggcatcctggagcaattgagaccggacacccacagagctgttgtcctcccagcaacaagatggtgtggttatcttgggtcatttggatgttttgtttgtttctgtgtgtcagactgtaagggctgagctttctgtgcttctaggtggagctggaacaattcagattcacccgccctgatgctaaggaaaccctgacgtatgtactagatggcagggcactgggggtcaggctgaaggctgagcaacacctctctgccctccctccctttgtcccatctcccagcgacttccaatattcatgtttctgagaattgtgtccctcttcaggttccctcttggtgcctaacctggattagtaatgtgcattcaggtgaattttcagctgaggctctgagaactggtactctcagtgtgttctggtcatcttgtggcttagttgtagaagcaggtgtgtctcttgcctctgcttgcctcctactgcacactcagcacccaggactggaatcaccgactactgaatctcctacatgtattgctgctacttcaagctcctccacttgaaaccttatgattttcccaaggggagatgggacagtgtcatctaaatattccgaatgtttggccttctgagaaaagagcttctagtaattgaaccatgggaaacccagcttctggagggttggccgtggggctgtgtacatgtgtgtgcccaggggtgagtgtttctcaggattcctaacgattcaaattaccgttgagtatatataaagaatgagtctctgtatggaagaacaaatgtgtgcattcacccccagtcacaatggtctccattgcatttcaaaggagaggatcagactatctgaatataaacacaatctgatgttaatttattctaagaacaccatcattttgattgtcctaaagaattctgcctttgtgaataccgtgttaaatttttttaaatttgtgacaggattgtagcaaattattatttaaggaaaataaattgtgtaaacatttaatgtggtatttttgaacagcggtttttatgtactcagaagaggaagtaaagccaggttcttaatggtatttatagaaaagatgttttcatattataatgcacataaatgaagccattttgatattcagcaaattcggtgccaattgaatagtttgctggtagcaagacggatgaagacctatatgggagattctttatctctagagctagcatatttacttgcatactttgtttcttttccacatggatattttactgctaaatggcagaggtgggagggagatgtcacacagtaccataaccccatattgaaaacaagaaaccaccagaaagtttgcagctaaggggcaggggattcagttcctacgcccactcagcactaactacttgcgggcctggttgcttagaagctctacctctctttcattatctgtaaaatagaaacaatacttaggactttagttggaacatgaggattgaataagatcacgctattcatgtgactttttatcggctagaacagcaacagacactgctgtgggtgagttacttagaaaagtttagttatcagtgattagcccaaaaacacatcagtcaaaaatagaatccactggatttttgtctctctttttagagacagggtctcactgtcgcccaggctggagtacagtggcatgatcattgttcactgcagcctcaaattcctgggctcaagcaatcctcgcacctcagcctcctgagtagccgggactataggcacatgccacctcacctggcttgtgtgtgtgtgtgtgtgtgtgtgtgtgtgtgtgtgtgtgtgtgtgtgtgtgtgtgtgtgtgtagagacaggatcttgatgtgttgcctaggctggtctcaaactcctggcctcaagtgatcttcccacctcagcctccaaaactgttgggattataggcgtgagccactgtgcccagcctaactgggtttttatgagaggaaaatagaaaatgctcttctagaagagagagaacaagagcacaaaataatctggactcacaaaaattcagcaagctccaagaaagggggatggagggaacgctggcaaaaatttaaatgccattaggatatttagcaagttattactgtttggtaaaaatgcatcatcaccctgtgtgcaaaatgcttgcaaagtagtctaaatgtctttggagatgggtgttttactgcttttttccaaaaacaaattgtttattatggttgcagaaatgcagccattacggtcacataaatttctaaaaagcctaccaaaggttgcaagcagtcttctgccactgggcaggccagcagttcagacccagcgaggttgccaggaacaaatccaggaaatactgggaagaacaagacaagagaattacctaaaagagcaaacaattcaagtaaatcctgtagctattaccacttaaaatccgtagctcaagattcctgtttcaccaccttatacacttaagcaattatacttaagcctttttttagtcctaagtgaagaactacatcagaatcaggataagtattttgcctgggaaatttggctgcatatgaatggagaagacatttacatcctatgttctggcactttctgaaagatctaattaaacatgttgatgtgccaatttaatcaagatgagagatccctgctggtgtcaccctctagaacctgcacttggtgttttgactttccagaagaaaaaaatgcaactttggttagggggcagtggttggatcacacagttgtctttcgtttcctaccacagtaattcatatttaaatatgcttttagattagtgtggatactattgctgctgtgttgctacctgacctttttctggggggggtacctcagaaatgagcatttgagggcaagcgaaaaagccctcttcatcctccagaggcaacaaagaggcagcagaaatggggaaagattgtgagaggcagggcttgggtctagacctggacttaggcaagatatgttgccctcaaccctgagttttcttatatgtaaaaagggaaggttgggctggactagatgaggtcaagatttgccattctgggaggctgatattccagagaatcaaaattaatcctaaaccaaagctttatggctgctacagagacatgtcacatttctgagacttgtcaccaagagtttgtccctcagactttggcgctgttgaatgcaaagacaaggatggccaccttctggttcttgcctgttgtcctcagctgagagcagtctcggtaaaggtggcaaagattctgtgacctcagaccggggaccaaatgcttgggagtctgatggccgggctgggccaccattctcatagctctcattctgtttggagcaaccaaaggatttgtgtgaagttatttggaaaaggaccttaactgagcagtaatcttttttctgtatatttggaatgtttttcattctgacctgttctgtcagtgattctactgaaaaacaatttaatcaatataaaaatgttcaagctatgcaacactgt

SEQ ID NO: 171675 - DNA, 6703 bp, Homo sapiens
  Payload ID: 13749
  Gene Symbol: PTPN3
  Gene Name: protein tyrosine phosphatase, non-receptor type 3
  Uniprot ID: P26045
  ENST ID: ENST00000374541
  CDS Start-End: 106-2847
gacggcggccaggtcgcgccgcgagcgagcttccgcgccgcccgcacgcgcgacctacctgggcgctccgcgcccccggatgctgcaggttattcagcgatagttatgacctcccggttacgtgcgttgggtggaagaattaataatatacgcacctcggagttacccaaagagaaaactcgatcagaagtcatttgcagcatccactttttagatggcgtggtacagacctttaaagttactaaacaagacactggccaggttcttctggatatggtgcacaaccacctgggtgtgactgaaaaggaatattttggtttacagcatgatgacgactccgtggactctcctagatggctggaagcaagcaaagccatcaggaagcagttaaaaggaggtttcccctgtaccctgcattttcgagtaagattttttatacctgatcccaacacactgcagcaagaacaaaccaggcacttgtatttcttacaactgaagatggatatttgcgaaggaaggttaacctgccctcttaactcagcagtggttctagcgtcctatgccgtacaatctcattttggagactataattcttccatacatcatccaggctatctttccgatagtcactttatacccgatcaaaatgaggactttttaacaaaagtcgaatctctgcatgagcagcacagtgggctaaaacaatcagaagcagaatcctgctatatcaacatagcgcggaccctcgacttctatggagtagaactgcacagtggtagggatctgcacaatttagacctaatgattggaattgcttccgcgggtgttgctgtgtaccgaaaatacatttgcacaagtttctatccttgggtgaacattctcaaaatttctttcaaaaggaaaaagttcttcatacatcagcgacagaaacaggctgaatccagggaacatattgtggccttcaacatgctgaattaccgatcttgcaaaaacttgtggaaatcctgtgttgagcaccatacgttctttcaggcaaagaagctactacctcaggaaaagaatgttctgtctcagtactggactatgggctctcggaacaccaaaaagtcggtaaataaccaatattgcaaaaaggtgattggcgggatggtgtggaacccagccatgcggagatccttatcagtggagcacttagaaaccaagagtctgccttctcgttcccctcccattactcccaactggcgaagtcctcggctccggcacgaaatccgaaagccacgccactcttctgcagataaccttgcaaatgaaatgacctacatcacggaaacggaagatgtattttacacgtacaagggctctctggcccctcaagacagcgattctgaagtttctcagaaccgaagcccgcaccaagagagtttatccgagaacaatccggcacaaagctacctgacccagaagtcatccagttctgtgtctccatcttcaaatgctccaggctcctgctcacctgacggcgttgatcagcagctcttagatgacttccacagggtgaccaaagggggctccaccgaggacgccagccagtactactgtgacaagaatgataatggtgacagctacttagtcttgatccgtatcacaccagatgaagatggaaaatttggatttaatcttaagggaggagtggatcaaaagatgcctcttgtggtatcaaggataaacccagagtcacctgcggacacctgcattcctaagctgaacgaaggggatcaaatcgtgttaatcaatggccgggacatctcagaacacacgcatgaccaagtggtgatgttcatcaaagccagccgggagtcccactcacgggagctggccctggtgatcaggaggagagctgtccgctcatttgctgacttcaagtctgaagatgaactgaaccagcttttccccgaagccattttccccatgtgtccggagggtggggacactttggagggatccatggcacagctaaagaagggcctcgaaagcgggacggtgctgatccagtttgagcaactctacagaaaaaagccaggtttggccatcacgtttgcaaagctgcctcaaaatttggacaaaaaccgatataaagatgtgctgccttatgacaccacccgggtattattgcagggaaatgaagattatattaatgcaagttacgtgaacatggaaattcctgctgctaaccttgtgaacaagtacatcgccactcaggggcccctgccgcatacctgtgcacagttttggcaggttgtctgggatcagaagttgtcactcattgtcatgttgacgactctcacagaacgagggcggaccaaatgtcaccagtactggccagatccccccgacgtcatgaaccacggcggctttcacatccagtgtcagtcagaggactgcaccatcgcctatgtgtcccgagaaatgctggtcacaaacacccagaccggggaagaacacacagtgacacatctccagtacgtcgcatggcctgaccacggtgtgcccgatgactcctccgactttctggaatttgtaaactatgtgaggtctctgagagtggacagcgagcccgtcctagttcactgcagtgctggaataggtcgaaccggtgtgttggtcactatggaaacagccatgtgcctaactgagaggaacctgcccatttacccactggatattgtccgaaaaatgcgagaccagcgcgccatgatggtgcagacatcaagccagtacaagtttgtgtgtgaagcgattcttcgtgtgtatgaagaaggtttagtccaaatgctggatcctagttaagacaactgtgaaaaagttcattcctctttcccaagggcatcctccttgaaagaggaggacagacctctctggaagcagcaagaggaaccagtagctgtgggaaaggaatgggcacctctgaacccaggcactttaaacttctatagaaaagatatcgtgtacataggaactggtgtagataagcatgcaattatggcatcatttaggcctgtatttctatggaaagatacaaaaaggatctcagtttggggcctgtcctaatgccttcttccctaacatcaccacacacacccctgtcggcatcctggagcaattgagaccggacacccacagagctgttgtcctcccagcaacaagatggtgtggttatcttgggtcatttggatgttttgtttgtttctgtgtgtcagactgtaagggctgagctttctgtgcttctaggtggagctggaacaattcagattcacccgccctgatgctaaggaaaccctgacgtatgtactagatggcagggcactgggggtcaggctgaaggctgagcaacacctctctgccctccctccctttgtcccatctcccagcgacttccaatattcatgtttctgagaattgtgtccctcttcaggttccctcttggtgcctaacctggattagtaatgtgcattcaggtgaattttcagctgaggctctgagaactggtactctcagtgtgttctggtcatcttgtggcttagttgtagaagcaggtgtgtctcttgcctctgcttgcctcctactgcacactcagcacccaggactggaatcaccgactactgaatctcctacatgtattgctgctacttcaagctcctccacttgaaaccttatgattttcccaaggggagatgggacagtgtcatctaaatattccgaatgtttggccttctgagaaaagagcttctagtaattgaaccatgggaaacccagcttctggagggttggccgtggggctgtgtacatgtgtgtgcccaggggtgagtgtttctcaggattcctaacgattcaaattaccgttgagtatatataaagaatgagtctctgtatggaagaacaaatgtgtgcattcacccccagtcacaatggtctccattgcatttcaaaggagaggatcagactatctgaatataaacacaatctgatgttaatttattctaagaacaccatcattttgattgtcctaaagaattctgcctttgtgaataccgtgttaaatttttttaaatttgtgacaggattgtagcaaattattatttaaggaaaataaattgtgtaaacatttaatgtggtatttttgaacagcggtttttatgtactcagaagaggaagtaaagccaggttcttaatggtatttatagaaaagatgttttcatattataatgcacataaatgaagccattttgatattcagcaaattcggtgccaattgaatagtttgctggtagcaagacggatgaagacctatatgggagattctttatctctagagctagcatatttacttgcatactttgtttcttttccacatggatattttactgctaaatggcagaggtgggagggagatgtcacacagtaccataaccccatattgaaaacaagaaaccaccagaaagtttgcagctaaggggcaggggattcagttcctacgcccactcagcactaactacttgcgggcctggttgcttagaagctctacctctctttcattatctgtaaaatagaaacaatacttaggactttagttggaacatgaggattgaataagatcacgctattcatgtgactttttatcggctagaacagcaacagacactgctgtgggtgagttacttagaaaagtttagttatcagtgattagcccaaaaacacatcagtcaaaaatagaatccactggatttttgtctctctttttagagacagggtctcactgtcgcccaggctggagtacagtggcatgatcattgttcactgcagcctcaaattcctgggctcaagcaatcctcgcacctcagcctcctgagtagccgggactataggcacatgccacctcacctggcttgtgtgtgtgtgtgtgtgtgtgtgtgtgtgtgtgtgtgtgtgtgtgtgtgtgtgtgtgtgtgtagagacaggatcttgatgtgttgcctaggctggtctcaaactcctggcctcaagtgatcttcccacctcagcctccaaaactgttgggattataggcgtgagccactgtgcccagcctaactgggtttttatgagaggaaaatagaaaatgctcttctagaagagagagaacaagagcacaaaataatctggactcacaaaaattcagcaagctccaagaaagggggatggagggaacgctggcaaaaatttaaatgccattaggatatttagcaagttattactgtttggtaaaaatgcatcatcaccctgtgtgcaaaatgcttgcaaagtagtctaaatgtctttggagatgggtgttttactgcttttttccaaaaacaaattgtttattatggttgcagaaatgcagccattacggtcacataaatttctaaaaagcctaccaaaggttgcaagcagtcttctgccactgggcaggccagcagttcagacccagcgaggttgccaggaacaaatccaggaaatactgggaagaacaagacaagagaattacctaaaagagcaaacaattcaagtaaatcctgtagctattaccacttaaaatccgtagctcaagattcctgtttcaccaccttatacacttaagcaattatacttaagcctttttttagtcctaagtgaagaactacatcagaatcaggataagtattttgcctgggaaatttggctgcatatgaatggagaagacatttacatcctatgttctggcactttctgaaagatctaattaaacatgttgatgtgccaatttaatcaagatgagagatccctgctggtgtcaccctctagaacctgcacttggtgttttgactttccagaagaaaaaaatgcaactttggttagggggcagtggttggatcacacagttgtctttcgtttcctaccacagtaattcatatttaaatatgcttttagattagtgtggatactattgctgctgtgttgctacctgacctttttctggggggggtacctcagaaatgagcatttgagggcaagcgaaaaagccctcttcatcctccagaggcaacaaagaggcagcagaaatggggaaagattgtgagaggcagggcttgggtctagacctggacttaggcaagatatgttgccctcaaccctgagttttcttatatgtaaaaagggaaggttgggctggactagatgaggtcaagatttgccattctgggaggctgatattccagagaatcaaaattaatcctaaaccaaagctttatggctgctacagagacatgtcacatttctgagacttgtcaccaagagtttgtccctcagactttggcgctgttgaatgcaaagacaaggatggccaccttctggttcttgcctgttgtcctcagctgagagcagtctcggtaaaggtggcaaagattctgtgacctcagaccggggaccaaatgcttgggagtctgatggccgggctgggccaccattctcatagctctcattctgtttggagcaaccaaaggatttgtgtgaagttatttggaaaaggaccttaactgagcagtaatcttttttctgtatatttggaatgtttttcattctgacctgttctgtcagtgattctactgaaaaacaatttaatcaatataaaaatgttcaagctatgcaa

SEQ ID NO: 171676 - DNA, 8630 bp, Homo sapiens
  Payload ID: 13749
  Gene Symbol: PTPN3
  Gene Name: protein tyrosine phosphatase, non-receptor type 3
  Uniprot ID: P26045
  ENST ID: ENST00000446349
  CDS Start-End: 2555-4768
gaagggtggtatcccgttgtggagtagaatgtaactatgaccttctgggatttgggcaccagatttatcttactgcaacaggagccatggtgggagccacccccataactcttatagagctggtgggccaccaggactgccagatatatatatatattttttgaaacagggtcttgctatgttgcccagactggcctcaaactcctggactcaaaggatcctccctcagcctcctgagtagctgggattataggcacataccaccacgactagctgccagatcatcttatcttggaccaggcttctaccattaattcacatgctttaaaaaaattaaaaattaaaaaaatgaaaaataaaaaaacttaaaagattttacctatattcctggaacatagttatcttaccccagctttgtagttcctgtttaaggaaattccctctgaaggaaattttagctctcaagagtcaaagaagatgtatagaggtggtatctgttagtttttgtttgtttgttaaggatctaggcagagaggtcattacatttttctgaagttgaggtcacaggtggggtacccacaagagaggtcattacatttctgaagttaggcatcccaggcatctcttctaaagaactatcctgtattctaattgttaaataaatatcttcttcattgtgagcctccacaactgctgtttctgataaatttagatcattctttgcagaattttatatactggcaatctcaaaactaggctccttcaagattcctaggaagtctcccaagctcgggttgggttccactattctagtttctttgtgtatgatgccatggggttgactcagaaactttgctcaatatatgacaaggcagcatttggtgagtggtgatctccacgtttatcttctcatttatatccctaggaagacatactgattagctgagcttgtcaatgaaagcccgggttcaccattggattatctataactctcctttctctttttttctctcagtagcattgtaggaggagagaacacttaattctggttgaatgtcagcttggataaacatagaaacaaactagaaagaactgatgatgttctcctaggtggaaaagatggagattccaataccaaataggtgtgaatcagcaaatgtatgttatactgtctctcaaggccaggtgttcaatacattgtgggtagttaattataatcaaagtaataatattagagttacgacatggatcctaagctttttagccattaaacatataagaaatttgtagcatagtgagtttttttataacatgatcatccaggttaaaataagacacaattgacctcacatatcctatctgagctccgattttgtcatctgtaaaaatggagatagtggtacctaccttacagagttatgaggctgagataagagggaaagttacaaagtagtaccatgtacaaagcccggaactgtgcaaataggaggttgtaatactgtttgaagcattcccatctcaaaaagccagttccttggcctttataaatttgaaggaataatgaaactgatttgtttcaattgtgaaaattatttctctcctgcccctgtgcacttctgccctgtctatattagatttcaagaggtttcccttttgtcatcttggccagacaatggaatgtctatcccgtttgaatctgggtttaaaaaagcatgggagctagtggccaagtgtcacatgtatgccgcatccctaaatagaagtctccccagggcgcttcctgacctgcgcaatgctgccgaaggcctcctttccccgctccccaggcagaggagcaaagtcacaggctgaggggcctgccacgacttgcccacaaaacaggtctggagtttggaagttacatttgctggttgcccagagatgagtgcagaattcagcttggaggtcctggaaacttctagtttactgatgtttatgcttttgctcatgcacccacagttcctgggacacagaatgctcacctgggggtttgtaccccagccaagaaggtgtcttcacagactcccctccttttagcaacttcatgcagatggagcttgggtggatggatcctggcacagtgttcagaacagtggccctgccagtgtgtgggcgccgcttgtgcagagcccctgtgggttctggtcctcaagggcaggggcgctcactgacagcggaacccatagtaccagcccatctttggtgggctgtttccaccccattcatccctgctcagctcttcataggacagcctgtgctggcagaaaattgcccccaccagtcaagacgtagggcatcaacatgagccatcagtaatgacagggcagctttgcagagcgtaaggtagcacctgataccttggaccaaaaccgtatttttatgtatctttcacatgtacagctcttgtctttgactcatcaaactttcttttttttttttttttgcttatttcagtttgagtatgaattaatgaaaacaattgtttcataggcacttgtatttcttacaactgaagatggatatttgcgaaggaaggttaacctgccctcttaactcagcagtggttctagcgtcctatgccgtacaatctcattttggagactataattcttccatacatcatccaggctatctttccgatagtcactttatacccgatcaaaatgaggactttttaacaaaagtcgaatctctgcatgagcagcacagtgggctaaaacaatcagaagcagaatcctgctatatcaacatagcgcggaccctcgacttctatggagtagaactgcacagtggtagggatctgcacaatttagacctaatgattggaattgcttccgcgggtgttgctgtgtaccgaaaatacatttgcacaagtttctatccttgggtgaacattctcaaaatttctttcaaaaggaaaaagttcttcatacatcagcgacagaaacaggctgaatccagggaacatattgtggccttcaacatgctgaattaccgatcttgcaaaaacttgtggaaatcctgtgttgagcaccatacgttctttcaggcaaagaagctactacctcaggaaaagaatgttctgtctcagtactggactatgggctctcggaacaccaaaaagcgaagtcctcggctccggcacgaaatccgaaagccacgccactcttctgcagataaccttgcaaatgaaatgacctacatcacggaaacggaagatgtattttacacgtacaagggctctctggcccctcaagacagcgattctgaagtttctcagaaccgaagcccgcaccaagagagtttatccgagaacaatccggcacaaagctacctgacccagaagtcatccagttctgtgtctccatcttcaaatgctccaggctcctgctcacctgacggcgttgatcagcagctcttagatgacttccacagggtgaccaaagggggctccaccgaggacgccagccagtactactgtgacaagaatgataatggtgacagctacttagtcttgatccgtatcacaccagatgaagatggaaaatttggatttaatcttaagggaggagtggatcaaaagatgcctcttgtggtatcaaggataaacccagagtcacctgcggacacctgcattcctaagctgaacgaaggggatcaaatcgtgttaatcaatggccgggacatctcagaacacacgcatgaccaagtggtgatgttcatcaaagccagccgggagtcccactcacgggagctggccctggtgatcaggaggagagctgtccgctcatttgctgacttcaagtctgaagatgaactgaaccagcttttccccgaagccattttccccatgtgtccggagggtggggacactttggagggatccatggcacagctaaagaagggcctcgaaagcgggacggtgctgatccagtttgagcaactctacagaaaaaagccaggtttggccatcacgtttgcaaagctgcctcaaaatttggacaaaaaccgatataaagatgtgctgccttatgacaccacccgggtattattgcagggaaatgaagattatattaatgcaagttacgtgaacatggaaattcctgctgctaaccttgtgaacaagtacatcgccactcaggggcccctgccgcatacctgtgcacagttttggcaggttgtctgggatcagaagttgtcactcattgtcatgttgacgactctcacagaacgagggcggaccaaatgtcaccagtactggccagatccccccgacgtcatgaaccacggcggctttcacatccagtgtcagtcagaggactgcaccatcgcctatgtgtcccgagaaatgctggtcacaaacacccagaccggggaagaacacacagtgacacatctccagtacgtcgcatggcctgaccacggtgtgcccgatgactcctccgactttctggaatttgtaaactatgtgaggtctctgagagtggacagcgagcccgtcctagttcactgcagtgctggaataggtcgaaccggtgtgttggtcactatggaaacagccatgtgcctaactgagaggaacctgcccatttacccactggatattgtccgaaaaatgcgagaccagcgcgccatgatggtgcagacatcaagccagtacaagtttgtgtgtgaagcgattcttcgtgtgtatgaagaaggtttagtccaaatgctggatcctagttaagacaactgtgaaaaagttcattcctctttcccaagggcatcctccttgaaagaggaggacagacctctctggaagcagcaagaggaaccagtagctgtgggaaaggaatgggcacctctgaacccaggcactttaaacttctatagaaaagatatcgtgtacataggaactggtgtagataagcatgcaattatggcatcatttaggcctgtatttctatggaaagatacaaaaaggatctcagtttggggcctgtcctaatgccttcttccctaacatcaccacacacacccctgtcggcatcctggagcaattgagaccggacacccacagagctgttgtcctcccagcaacaagatggtgtggttatcttgggtcatttggatgttttgtttgtttctgtgtgtcagactgtaagggctgagctttctgtgcttctaggtggagctggaacaattcagattcacccgccctgatgctaaggaaaccctgacgtatgtactagatggcagggcactgggggtcaggctgaaggctgagcaacacctctctgccctccctccctttgtcccatctcccagcgacttccaatattcatgtttctgagaattgtgtccctcttcaggttccctcttggtgcctaacctggattagtaatgtgcattcaggtgaattttcagctgaggctctgagaactggtactctcagtgtgttctggtcatcttgtggcttagttgtagaagcaggtgtgtctcttgcctctgcttgcctcctactgcacactcagcacccaggactggaatcaccgactactgaatctcctacatgtattgctgctacttcaagctcctccacttgaaaccttatgattttcccaaggggagatgggacagtgtcatctaaatattccgaatgtttggccttctgagaaaagagcttctagtaattgaaccatgggaaacccagcttctggagggttggccgtggggctgtgtacatgtgtgtgcccaggggtgagtgtttctcaggattcctaacgattcaaattaccgttgagtatatataaagaatgagtctctgtatggaagaacaaatgtgtgcattcacccccagtcacaatggtctccattgcatttcaaaggagaggatcagactatctgaatataaacacaatctgatgttaatttattctaagaacaccatcattttgattgtcctaaagaattctgcctttgtgaataccgtgttaaatttttttaaatttgtgacaggattgtagcaaattattatttaaggaaaataaattgtgtaaacatttaatgtggtatttttgaacagcggtttttatgtactcagaagaggaagtaaagccaggttcttaatggtatttatagaaaagatgttttcatattataatgcacataaatgaagccattttgatattcagcaaattcggtgccaattgaatagtttgctggtagcaagacggatgaagacctatatgggagattctttatctctagagctagcatatttacttgcatactttgtttcttttccacatggatattttactgctaaatggcagaggtgggagggagatgtcacacagtaccataaccccatattgaaaacaagaaaccaccagaaagtttgcagctaaggggcaggggattcagttcctacgcccactcagcactaactacttgcgggcctggttgcttagaagctctacctctctttcattatctgtaaaatagaaacaatacttaggactttagttggaacatgaggattgaataagatcacgctattcatgtgactttttatcggctagaacagcaacagacactgctgtgggtgagttacttagaaaagtttagttatcagtgattagcccaaaaacacatcagtcaaaaatagaatccactggatttttgtctctctttttagagacagggtctcactgtcgcccaggctggagtacagtggcatgatcattgttcactgcagcctcaaattcctgggctcaagcaatcctcgcacctcagcctcctgagtagccgggactataggcacatgccacctcacctggcttgtgtgtgtgtgtgtgtgtgtgtgtgtgtgtgtgtgtgtgtgtgtgtgtgtgtgtgtgtgtgtagagacaggatcttgatgtgttgcctaggctggtctcaaactcctggcctcaagtgatcttcccacctcagcctccaaaactgttgggattataggcgtgagccactgtgcccagcctaactgggtttttatgagaggaaaatagaaaatgctcttctagaagagagagaacaagagcacaaaataatctggactcacaaaaattcagcaagctccaagaaagggggatggagggaacgctggcaaaaatttaaatgccattaggatatttagcaagttattactgtttggtaaaaatgcatcatcaccctgtgtgcaaaatgcttgcaaagtagtctaaatgtctttggagatgggtgttttactgcttttttccaaaaacaaattgtttattatggttgcagaaatgcagccattacggtcacataaatttctaaaaagcctaccaaaggttgcaagcagtcttctgccactgggcaggccagcagttcagacccagcgaggttgccaggaacaaatccaggaaatactgggaagaacaagacaagagaattacctaaaagagcaaacaattcaagtaaatcctgtagctattaccacttaaaatccgtagctcaagattcctgtttcaccaccttatacacttaagcaattatacttaagcctttttttagtcctaagtgaagaactacatcagaatcaggataagtattttgcctgggaaatttggctgcatatgaatggagaagacatttacatcctatgttctggcactttctgaaagatctaattaaacatgttgatgtgccaatttaatcaagatgagagatccctgctggtgtcaccctctagaacctgcacttggtgttttgactttccagaagaaaaaaatgcaactttggttagggggcagtggttggatcacacagttgtctttcgtttcctaccacagtaattcatatttaaatatgcttttagattagtgtggatactattgctgctgtgttgctacctgacctttttctggggggggtacctcagaaatgagcatttgagggcaagcgaaaaagccctcttcatcctccagaggcaacaaagaggcagcagaaatggggaaagattgtgagaggcagggcttgggtctagacctggacttaggcaagatatgttgccctcaaccctgagttttcttatatgtaaaaagggaaggttgggctggactagatgaggtcaagatttgccattctgggaggctgatattccagagaatcaaaattaatcctaaaccaaagctttatggctgctacagagacatgtcacatttctgagacttgtcaccaagagtttgtccctcagactttggcgctgttgaatgcaaagacaaggatggccaccttctggttcttgcctgttgtcctcagctgagagcagtctcggtaaaggtggcaaagattctgtgacctcagaccggggaccaaatgcttgggagtctgatggccgggctgggccaccattctcatagctctcattctgtttggagcaaccaaaggatttgtgtgaagttatttggaaaaggaccttaactgagcagtaatcttttttctgtatatttggaatgtttttcattctgacctgttctgtcagtgattctactgaaaaacaatttaatcaatataaaaatgttcaagctatgcaacactgt

SEQ ID NO: 171677 - DNA, 8765 bp, Homo sapiens
  Payload ID: 13749
  Gene Symbol: PTPN3
  Gene Name: protein tyrosine phosphatase, non-receptor type 3
  Uniprot ID: P26045
  ENST ID: ENST00000412145
  CDS Start-End: 2555-4903
gaagggtggtatcccgttgtggagtagaatgtaactatgaccttctgggatttgggcaccagatttatcttactgcaacaggagccatggtgggagccacccccataactcttatagagctggtgggccaccaggactgccagatatatatatatattttttgaaacagggtcttgctatgttgcccagactggcctcaaactcctggactcaaaggatcctccctcagcctcctgagtagctgggattataggcacataccaccacgactagctgccagatcatcttatcttggaccaggcttctaccattaattcacatgctttaaaaaaattaaaaattaaaaaaatgaaaaataaaaaaacttaaaagattttacctatattcctggaacatagttatcttaccccagctttgtagttcctgtttaaggaaattccctctgaaggaaattttagctctcaagagtcaaagaagatgtatagaggtggtatctgttagtttttgtttgtttgttaaggatctaggcagagaggtcattacatttttctgaagttgaggtcacaggtggggtacccacaagagaggtcattacatttctgaagttaggcatcccaggcatctcttctaaagaactatcctgtattctaattgttaaataaatatcttcttcattgtgagcctccacaactgctgtttctgataaatttagatcattctttgcagaattttatatactggcaatctcaaaactaggctccttcaagattcctaggaagtctcccaagctcgggttgggttccactattctagtttctttgtgtatgatgccatggggttgactcagaaactttgctcaatatatgacaaggcagcatttggtgagtggtgatctccacgtttatcttctcatttatatccctaggaagacatactgattagctgagcttgtcaatgaaagcccgggttcaccattggattatctataactctcctttctctttttttctctcagtagcattgtaggaggagagaacacttaattctggttgaatgtcagcttggataaacatagaaacaaactagaaagaactgatgatgttctcctaggtggaaaagatggagattccaataccaaataggtgtgaatcagcaaatgtatgttatactgtctctcaaggccaggtgttcaatacattgtgggtagttaattataatcaaagtaataatattagagttacgacatggatcctaagctttttagccattaaacatataagaaatttgtagcatagtgagtttttttataacatgatcatccaggttaaaataagacacaattgacctcacatatcctatctgagctccgattttgtcatctgtaaaaatggagatagtggtacctaccttacagagttatgaggctgagataagagggaaagttacaaagtagtaccatgtacaaagcccggaactgtgcaaataggaggttgtaatactgtttgaagcattcccatctcaaaaagccagttccttggcctttataaatttgaaggaataatgaaactgatttgtttcaattgtgaaaattatttctctcctgcccctgtgcacttctgccctgtctatattagatttcaagaggtttcccttttgtcatcttggccagacaatggaatgtctatcccgtttgaatctgggtttaaaaaagcatgggagctagtggccaagtgtcacatgtatgccgcatccctaaatagaagtctccccagggcgcttcctgacctgcgcaatgctgccgaaggcctcctttccccgctccccaggcagaggagcaaagtcacaggctgaggggcctgccacgacttgcccacaaaacaggtctggagtttggaagttacatttgctggttgcccagagatgagtgcagaattcagcttggaggtcctggaaacttctagtttactgatgtttatgcttttgctcatgcacccacagttcctgggacacagaatgctcacctgggggtttgtaccccagccaagaaggtgtcttcacagactcccctccttttagcaacttcatgcagatggagcttgggtggatggatcctggcacagtgttcagaacagtggccctgccagtgtgtgggcgccgcttgtgcagagcccctgtgggttctggtcctcaagggcaggggcgctcactgacagcggaacccatagtaccagcccatctttggtgggctgtttccaccccattcatccctgctcagctcttcataggacagcctgtgctggcagaaaattgcccccaccagtcaagacgtagggcatcaacatgagccatcagtaatgacagggcagctttgcagagcgtaaggtagcacctgataccttggaccaaaaccgtatttttatgtatctttcacatgtacagctcttgtctttgactcatcaaactttcttttttttttttttttgcttatttcagtttgagtatgaattaatgaaaacaattgtttcataggcacttgtatttcttacaactgaagatggatatttgcgaaggaaggttaacctgccctcttaactcagcagtggttctagcgtcctatgccgtacaatctcattttggagactataattcttccatacatcatccaggctatctttccgatagtcactttatacccgatcaaaatgaggactttttaacaaaagtcgaatctctgcatgagcagcacagtgggctaaaacaatcagaagcagaatcctgctatatcaacatagcgcggaccctcgacttctatggagtagaactgcacagtggtagggatctgcacaatttagacctaatgattggaattgcttccgcgggtgttgctgtgtaccgaaaatacatttgcacaagtttctatccttgggtgaacattctcaaaatttctttcaaaaggaaaaagttcttcatacatcagcgacagaaacaggctgaatccagggaacatattgtggccttcaacatgctgaattaccgatcttgcaaaaacttgtggaaatcctgtgttgagcaccatacgttctttcaggcaaagaagctactacctcaggaaaagaatgttctgtctcagtactggactatgggctctcggaacaccaaaaagtcggtaaataaccaatattgcaaaaaggtgattggcgggatggtgtggaacccagccatgcggagatccttatcagtggagcacttagaaaccaagagtctgccttctcgttcccctcccattactcccaactggcgaagtcctcggctccggcacgaaatccgaaagccacgccactcttctgcagataaccttgcaaatgaaatgacctacatcacggaaacggaagatgtattttacacgtacaagggctctctggcccctcaagacagcgattctgaagtttctcagaaccgaagcccgcaccaagagagtttatccgagaacaatccggcacaaagctacctgacccagaagtcatccagttctgtgtctccatcttcaaatgctccaggctcctgctcacctgacggcgttgatcagcagctcttagatgacttccacagggtgaccaaagggggctccaccgaggacgccagccagtactactgtgacaagaatgataatggtgacagctacttagtcttgatccgtatcacaccagatgaagatggaaaatttggatttaatcttaagggaggagtggatcaaaagatgcctcttgtggtatcaaggataaacccagagtcacctgcggacacctgcattcctaagctgaacgaaggggatcaaatcgtgttaatcaatggccgggacatctcagaacacacgcatgaccaagtggtgatgttcatcaaagccagccgggagtcccactcacgggagctggccctggtgatcaggaggagagctgtccgctcatttgctgacttcaagtctgaagatgaactgaaccagcttttccccgaagccattttccccatgtgtccggagggtggggacactttggagggatccatggcacagctaaagaagggcctcgaaagcgggacggtgctgatccagtttgagcaactctacagaaaaaagccaggtttggccatcacgtttgcaaagctgcctcaaaatttggacaaaaaccgatataaagatgtgctgccttatgacaccacccgggtattattgcagggaaatgaagattatattaatgcaagttacgtgaacatggaaattcctgctgctaaccttgtgaacaagtacatcgccactcaggggcccctgccgcatacctgtgcacagttttggcaggttgtctgggatcagaagttgtcactcattgtcatgttgacgactctcacagaacgagggcggaccaaatgtcaccagtactggccagatccccccgacgtcatgaaccacggcggctttcacatccagtgtcagtcagaggactgcaccatcgcctatgtgtcccgagaaatgctggtcacaaacacccagaccggggaagaacacacagtgacacatctccagtacgtcgcatggcctgaccacggtgtgcccgatgactcctccgactttctggaatttgtaaactatgtgaggtctctgagagtggacagcgagcccgtcctagttcactgcagtgctggaataggtcgaaccggtgtgttggtcactatggaaacagccatgtgcctaactgagaggaacctgcccatttacccactggatattgtccgaaaaatgcgagaccagcgcgccatgatggtgcagacatcaagccagtacaagtttgtgtgtgaagcgattcttcgtgtgtatgaagaaggtttagtccaaatgctggatcctagttaagacaactgtgaaaaagttcattcctctttcccaagggcatcctccttgaaagaggaggacagacctctctggaagcagcaagaggaaccagtagctgtgggaaaggaatgggcacctctgaacccaggcactttaaacttctatagaaaagatatcgtgtacataggaactggtgtagataagcatgcaattatggcatcatttaggcctgtatttctatggaaagatacaaaaaggatctcagtttggggcctgtcctaatgccttcttccctaacatcaccacacacacccctgtcggcatcctggagcaattgagaccggacacccacagagctgttgtcctcccagcaacaagatggtgtggttatcttgggtcatttggatgttttgtttgtttctgtgtgtcagactgtaagggctgagctttctgtgcttctaggtggagctggaacaattcagattcacccgccctgatgctaaggaaaccctgacgtatgtactagatggcagggcactgggggtcaggctgaaggctgagcaacacctctctgccctccctccctttgtcccatctcccagcgacttccaatattcatgtttctgagaattgtgtccctcttcaggttccctcttggtgcctaacctggattagtaatgtgcattcaggtgaattttcagctgaggctctgagaactggtactctcagtgtgttctggtcatcttgtggcttagttgtagaagcaggtgtgtctcttgcctctgcttgcctcctactgcacactcagcacccaggactggaatcaccgactactgaatctcctacatgtattgctgctacttcaagctcctccacttgaaaccttatgattttcccaaggggagatgggacagtgtcatctaaatattccgaatgtttggccttctgagaaaagagcttctagtaattgaaccatgggaaacccagcttctggagggttggccgtggggctgtgtacatgtgtgtgcccaggggtgagtgtttctcaggattcctaacgattcaaattaccgttgagtatatataaagaatgagtctctgtatggaagaacaaatgtgtgcattcacccccagtcacaatggtctccattgcatttcaaaggagaggatcagactatctgaatataaacacaatctgatgttaatttattctaagaacaccatcattttgattgtcctaaagaattctgcctttgtgaataccgtgttaaatttttttaaatttgtgacaggattgtagcaaattattatttaaggaaaataaattgtgtaaacatttaatgtggtatttttgaacagcggtttttatgtactcagaagaggaagtaaagccaggttcttaatggtatttatagaaaagatgttttcatattataatgcacataaatgaagccattttgatattcagcaaattcggtgccaattgaatagtttgctggtagcaagacggatgaagacctatatgggagattctttatctctagagctagcatatttacttgcatactttgtttcttttccacatggatattttactgctaaatggcagaggtgggagggagatgtcacacagtaccataaccccatattgaaaacaagaaaccaccagaaagtttgcagctaaggggcaggggattcagttcctacgcccactcagcactaactacttgcgggcctggttgcttagaagctctacctctctttcattatctgtaaaatagaaacaatacttaggactttagttggaacatgaggattgaataagatcacgctattcatgtgactttttatcggctagaacagcaacagacactgctgtgggtgagttacttagaaaagtttagttatcagtgattagcccaaaaacacatcagtcaaaaatagaatccactggatttttgtctctctttttagagacagggtctcactgtcgcccaggctggagtacagtggcatgatcattgttcactgcagcctcaaattcctgggctcaagcaatcctcgcacctcagcctcctgagtagccgggactataggcacatgccacctcacctggcttgtgtgtgtgtgtgtgtgtgtgtgtgtgtgtgtgtgtgtgtgtgtgtgtgtgtgtgtgtgtgtagagacaggatcttgatgtgttgcctaggctggtctcaaactcctggcctcaagtgatcttcccacctcagcctccaaaactgttgggattataggcgtgagccactgtgcccagcctaactgggtttttatgagaggaaaatagaaaatgctcttctagaagagagagaacaagagcacaaaataatctggactcacaaaaattcagcaagctccaagaaagggggatggagggaacgctggcaaaaatttaaatgccattaggatatttagcaagttattactgtttggtaaaaatgcatcatcaccctgtgtgcaaaatgcttgcaaagtagtctaaatgtctttggagatgggtgttttactgcttttttccaaaaacaaattgtttattatggttgcagaaatgcagccattacggtcacataaatttctaaaaagcctaccaaaggttgcaagcagtcttctgccactgggcaggccagcagttcagacccagcgaggttgccaggaacaaatccaggaaatactgggaagaacaagacaagagaattacctaaaagagcaaacaattcaagtaaatcctgtagctattaccacttaaaatccgtagctcaagattcctgtttcaccaccttatacacttaagcaattatacttaagcctttttttagtcctaagtgaagaactacatcagaatcaggataagtattttgcctgggaaatttggctgcatatgaatggagaagacatttacatcctatgttctggcactttctgaaagatctaattaaacatgttgatgtgccaatttaatcaagatgagagatccctgctggtgtcaccctctagaacctgcacttggtgttttgactttccagaagaaaaaaatgcaactttggttagggggcagtggttggatcacacagttgtctttcgtttcctaccacagtaattcatatttaaatatgcttttagattagtgtggatactattgctgctgtgttgctacctgacctttttctggggggggtacctcagaaatgagcatttgagggcaagcgaaaaagccctcttcatcctccagaggcaacaaagaggcagcagaaatggggaaagattgtgagaggcagggcttgggtctagacctggacttaggcaagatatgttgccctcaaccctgagttttcttatatgtaaaaagggaaggttgggctggactagatgaggtcaagatttgccattctgggaggctgatattccagagaatcaaaattaatcctaaaccaaagctttatggctgctacagagacatgtcacatttctgagacttgtcaccaagagtttgtccctcagactttggcgctgttgaatgcaaagacaaggatggccaccttctggttcttgcctgttgtcctcagctgagagcagtctcggtaaaggtggcaaagattctgtgacctcagaccggggaccaaatgcttgggagtctgatggccgggctgggccaccattctcatagctctcattctgtttggagcaaccaaaggatttgtgtgaagttatttggaaaaggaccttaactgagcagtaatcttttttctgtatatttggaatgtttttcattctgacctgttctgtcagtgattctactgaaaaacaatttaatcaatataaaaatgttcaagctatgcaacactgt

SEQ ID NO: 171678 - DNA, 10300 bp, Homo sapiens
  Payload ID: 13750
  Gene Symbol: PTPN4
  Gene Name: protein tyrosine phosphatase, non-receptor type 4 (megakaryocyte)
  Uniprot ID: P29074
  ENST ID: ENST00000263708
  CDS Start-End: 772-3552
cctgcgtgtccctctgcgctccgactggtgcgacttctccctgcgctagcgaggcagggttttggcctcgcctctcgcgagatcgcctcctgttgctgccgccgccgctcctggccactgactggcggcgcctgcgcagccgccatgttcggttgctatgctgcggcctaggagagggggtgtgcttgagggaggaggaagagatagaggaggaggagggggaggaagaggaggtggagaaggaggggggtgactgagctcctcttgcactctcacacacaaacgctgcccaggattacccgccagctcacgccgcgcagtgcgcttttccgctcctcgcgccccaccaccaacattgttctctcaggactcctgggtcccaggggccggaattgggcctgagcgggagaggaaagagacttggctttggccgcggggtcggaggattggggccaggccccctcccccacgcacttttgggggtgtggattatctcatccctgcagggaggtaggagaggtcgccggctgcccgcctccctgccacctccccagcggcgccggcccgcggctgcccagcagcatgaggtggtgctggcggctccgggtcgtggcgcgaccgctgcggcggcggctgctcggggggcgctgaggtagccccccggagcggcacggaggacgcgcttctcctctgcgcgccggggcctcgaggctttttttctccagccgagaggacgcggctgtgatatacgaagactttgtgtggacagtaatgacctcacgtttccgattgcctgctggcagaacctacaatgtacgagcatcagagttggcccgagacagacagcatactgaagtggtttgcaacatccttcttctggataacactgtacaagctttcaaagtcaataaacatgatcaggggcaagtcttgttggatgtcgtcttcaagcatctagatttgactgagcaggactattttggtttacagttggctgatgattccacagataacccaaggtggctggatccaaacaaaccaataaggaagcagctaaagagaggatctccttacagtttgaactttagagtcaaattttttgtaagtgaccccaacaagttacaagaagaatatacaaggtaccagtattttttgcaaattaaacaagacattcttactggaagattaccctgtccttctaatactgctgcccttttagcttcatttgctgttcagtctgaacttggagactacgatcagtcagagaacttgtcaggctacctctcagattattctttcattcctaatcaacctcaagattttgaaaaagaaattgcaaaattacatcagcaacacataggcttatctcctgcagaagcagaatttaattacctaaacacagcacgtaccttagaactctatggagttgaattccactatgcaagggatcagagtaacaatgaaattatgattggagtgatgtcaggaggaattctgatttataagaacagggtacgaatgaatacctttccatggttgaagattgtaaaaatttcttttaagtgcaaacagttttttattcaacttagaaaagaattgcatgaatctagagaaacattattgggatttaatatggtgaattacagagcatgtaaaaatttgtggaaagcatgtgtagaacatcacacattcttccgtttggacagaccacttccacctcaaaagaatttttttgcacattattttacattaggttcaaaattccggtactgtgggagaactgaagtccaatcagttcagtatggcaaagaaaaggcaaataaagacagggtatttgcaagatccccaagtaagcccttggcacggaaattaatggattgggaagtagtaagcagaaattcaatatctgatgacaggttagaaacacaaagtcttccatcacgatctccaccgggaactcctaatcatcgaaattctacattcacgcaggaaggaacccggttacgaccatcttcagttggtcatttggtagaccatatggttcatacttccccaagcgaagtgtttgtaaatcagagatctccgtcatcaacacaagctaatagcattgttctggaatcatcaccatcacaagagacccctggagatgggaagcctccagctttaccacccaaacagtcaaagaaaaacagttggaaccaaattcattattcacattcgcaacaagatctagaaagtcatattaatgaaacatttgatattccatcttctcctgaaaaacccactcctaatggtggtattccacatgataatcttgtcctaatcagaatgaaacctgatgaaaatgggaggtttggattcaatgtaaagggaggatatgatcagaagatgcctgtgattgtgtctcgagtagcaccaggaacacctgctgacctctgtgtccctagactgaatgaaggggaccaagttgtactgatcaatggtcgggacattgcagaacacactcatgatcaggttgtgctgtttattaaagctagttgtgagagacattctggggaactcatgcttctagttcgacctaatgctgtatatgatgtagtggaagaaaagctagaaaatgagccagatttccagtatattcctgagaaagccccactagatagtgtgcatcaggatgaccattccctgcgggagtcaatgatccagctagctgaggggcttatcactggaacagtcctgacacagtttgatcaactgtatcggaaaaaacctggaatgacaatgtcctgtgccaaattacctcagaatatttccaaaaatagatacagagatatttcgccttatgatgccacacgggtcattttaaaaggtaatgaagactacatcaatgcgaactatataaatatggaaattccttcttccagcattataaatcagtacattgcttgtcaagggccattaccacacacttgtacagatttttggcagatgacttgggaacaaggctcctctatggttgtaatgttgaccacacaagttgaacgtggcagagttaaatgtcaccaatattggccagaacccacaggcagttcatcttatggatgctaccaagttacctgccactctgaagaaggaaacactgcctatatcttcaggaagatgaccctatttaaccaagagaaaaatgaaagtcgtccactcactcagatccagtacatagcctggcctgaccatggagtccctgatgattcgagtgactttctagattttgtttgtcatgtacgaaacaagagggctggcaaggaagaacccgttgttgtccattgcagtgctggaatcggaagaactggggttcttattactatggaaacagccatgtgtctcattgaatgcaatcagccagtttatccactagatattgtaagaacaatgagagatcagcgagccatgatgatccaaacacctagtcaatacagatttgtatgtgaagctattttgaaagtttatgaagaaggctttgttaaacccttaacaacatcaacaaataaataagaaagcaaaaagatctgggatatgtgttggaaaactgctttcccttatgttcactgtgccataatgctgctcgcaggaaatggcattttacaaaaaaaaaatgaagaactcaaaaaaactttgaaaacttcagcactgttgcactttatgttttaaaaaatgtcactctttcaaaatctataactcatgtatttgaagactgtttcatgctttgctccgaacaaatagtaaataactgagtatgttcagggtaatttatgaaattttgtggtggtgccatgcaatccccttttggtagaattgccacaaacaaggctcaaaattctcatcatctctgttatacacctgtatcatgaaagcaaaaagaagtaaacatcaggagtcagctctggtcttttgcagtggtttgcgtacttactatactgattaccagattttatttttaaaattttagcaatatcgttcttaatattagccaatacactgcctatggatgcagcacatttttccctgcacaccccctgtagagacctgcctgctgctcagaagaagaaagatggaatttgctgttcccaggaaatgctgcacattgtccatttaccagcatcttatagaaaatataaatatgaatctacaaattctcttggatttaataatgtaacttatatttatcataaggttggcttattccaaatcatgtgatttcacatacttgatgtaaaggaatgcatgcattgtgtcttaaccccttaagtgccttgagacgtccttgtatgtctaacgaaaaggcactcatttgaccccactaggaggtatatatgtatattgtacattcgtatatttttatgcattttgaataagttcacattttaaaaaacagctatattgagtgttatacagtcaaagaagggtaaggaaattctgtttcttactcagtactcgtgatttgctataagaagcaaagataatttgtgttctactgagtgcacactgctgctatggaattgttcaaaatctgcacattcctttacttgagggactgaggggttacggtttagcagctcaactttaaaagatgcttttatgcttcaaatttcatatttatttcatccctaactttaggaagacatctaacatgcagattaatgttaaacatattgataatctaagctaaagttagagcaaataattgtgatttattcatgtccataactaaaatattattctttagcactcatttcagttaatatcaagctttgttcacactgatatattgattgggattcttcaaacgaagaatgaaacattattgacttatttctaagtgtaataactcaataactaaattgagaattttcttgtttttttgtgtacaattaaattattccattttatatatacttattaagttataagcatgttaataaggagacttttgactgtccagcctaatggaggatctgattcccattaaggatgtgggaattcccgtattttcctcttcaggtttttttgtttttaagtctacagagagatagaaccttaacattgcccagtttgataaaagtgaaaatttgctcacctatacaaatgttattttacacaattattttatgtggattggggttttaaaagattcatttcctagcagtttctgaatatttctgtaagatcttgataaagtttagagtcaaatggcagatattttggaaagccatttagtatgaggggaagagtacacattttaaatctttggtataatctaaacgatgtcatttcagacattcaaaactcataataataaatttcaggaaatcaagctcctaaacattaatagccaagataccaaataaattatcatattaaaatatttaagtttatttaaagagagaagtaaacataaacttatgtcaaagagaaattctcttaatctatttcctgacttcacagtcaaaacagtataagatagtgaagtaacttataatcttatttggtcattctgttctataaacagacaaatataatttaggctgctatatgacatgataaattaaaaactgagaaagtaaaattatgtcggggtctacacattaaatgactgttttggcagtttttcacctgaatttaaaaataaaatttgtctgttctatctgtatggacagaatatgacaaccatagaccaaaagatatcattgtatagatgtaaagagacaaaagtcatggttggcatgttctttaatttagggccttgtttatacttgtgagtttaataatttcttggcaatgagcactgctgcctttttaaatcatcaatgcctgtctttaaatgccaatcattagaagtttagaattacatttaaatttctcatatatgaatttttcatctgggaactacccactgtcgtcatttttatgtgcagaaaagatcctttttgaaaaccatatttattgggatcttatttaaatttaaattatcctttacaacttcttaaaatgaatatgctaatagataagactttatccattacatctaagaactttttaacctgtatatcaatctaaataggtttctagaaataatcctagctttcatacaccatgtagttctagactccgtccatatcagtgtaacattgtgtgataaaatgccaaatgtcttgtatctaagctacgctcccactcttccagccacccctacctcccaccttgacacccttaagaaagcaatgctgacttttattctgacaagtggaaatcaatagtggttaatcaagtggattttgtaaatgctaagaagtgtttgtgaaaaccttccctttctgagttaggattgttttttcctgttcatttcaggtgttttattgagcatctgatttgtgtcagcaccatgtaaatatgatgaggagtatttggaatagactttacattcaccagaaaattgatagtatttgttaaaccaatgcatccattcaaaatagaggcagagtaaacagcctaagaaatgatttcctttctacagtctgctaggagaaagaggtgagaggggagtggttgatgattttaatcaagagtaaagggaacatttattacatgaaatctgacttcagttgtgcaaaggtatgttaagacattaagacaattgctggaaggtttcaaatatgtgtacacacacatagagctacttttgtgtgtttatttatatgtatatttcacaaaggctaatgcccacagaggaaaatgattattttaacttctgggttatcatctgctggcagggtctgatcaggtctagagtatttaaggaaaagtctcctgtcttctatctccactagaagtactgcagcttgagagctgaaaggaacttgaaaaatgttatccagtcttcacttagcccatttttatcggcattaggaaatagggttcagcaatggttattgatttagcagtctggtcttatatgatctgctttctaattatctatctagtattcctatattatactggaacttcaataaattataacctatgtgaatatcataaattcttgtgaatttttgtctatttccagtagagaagcatactcagccaatgttttcacttaataactatgacaaccttaaaggatgtcacttaagttagaaaataagcaggcttaagaagtgattctaattaggacccccactcagtttgctagtcatgcctgcctgacagaacataagcttttgtaaagtatttagactgataacacatgcagtatgaaaacattatagactgcagttagaagactaattttttaaaagcactcaaaacatagaactaagatttagaatatatgtccatttataatgaaataatttgtgttcataatgtgaacatgtaagataagtaaataaagcattacttgttttataatatcaggaagagagaaggaaacattagtttataacaatgtgctatttaatatctgtattttgaacatttaaaatactctgatggtaaggttgccaaagtaattttgaattcataaaaattgtttataccacaataatgtgggatatgtttacaggctcttttattttgtggtagttactttatagttcagatgaatttgcatttcagtcacttatagtaaataaagtatattaaatatttgttggaataaaaatctcaatgtaataggacatagataaattatgcaacagcctgctttgatgaaagctggtgcattatgtgagctgccacagttaatactttgtattaacattgcttacttcccccatttgcttcacctatctgactacaattgctggaatcattctttttgtggtgcttcctccaagtgaaataactatgttattaaaacctactggattaattttatcaaatatcagacttactgatctcttggcagagatttattggtgtctcagtgtgatcacaatacaagttgtagcaaccattttataaaactcttagagaattatgtagataaaatggaaattacataatcctaaaacatttttgagggctaattgataataatttcagcaattttattaagaacccagtaaattaatccctaatttgtatgttttttgttcaacttaccgtgtctgcaaccattatatagacttcattgatactcagcaattactacagtgtgtcttacaatgttataaaaaacaaacagcaatctctgtttctgccagaagttagatatttttttatagtcctgatgaatttgttgtgagtagacaccacatagttatttctgtttgcatataaatttgctgctatttatttgtatgtttttctactgtagtatgctattgatttctgaagttataatcataatttttattttagtaatccaagctaaatgggcaaccagaagtaatatctgctagggtgcaatccatcagcattggttcagtgcatatacataagtaaaccagtttaaaaaaattttactaagcaaaaggtagtagcaatattgctagttaaagattaccattttaggggaaagttcaaaggtttaacttcctgaaaccttttaaacttttcagtgcaagaatgaaaatgtttgaaagccttgttaagctcataaaagtttcatttaaacactgtagagtttcctacctttgttgtgtaaaggatatagaaaatatttttctatggacagaaggttgaaactgttaacttctttaatttcattgtttaaaggagataaaatgttatttgtgtgtctttcatgctgtaaagaaaatgaatgtatctttcaaatgtcattagaattatggcttgattctaaggatactctatttgttttaaagtctacacgggattgaaaagaaagggaagagtattacacttcattgtacaaaatgtaattttagaagaaaaacattttcattataaacaagagcaatcattgaagcattttcagatataatgtacattctttttcattttgctttgcctctagaatagaaacttttcagaaaatttgcacatactgtttgtaagtataaaataattgaattctagacttttggagtgtggaagggtgtttgtgtgtgaaggtaataaatgtgttgctgcatgtgtttaccatagagaacgttgccaggctttgtcaaatgaggacattgttgtgagggtgtgacttttgtgaagccagaaaactgtgcctaagattcattacagtgagtatgtgcagaggcccctgacccagtaaatgctttttgcctttttattcccaatgtcttggacagttgagacaacttggcccaactctgaattgtagcagtgatgtcttatatgcttacgagtttatattaattcagctgaacaagaactacatcttaaaccacctttgtaggtatgattaatacgtgcaacagctgctttaaaaggtggtatttattattcatcactcatgaaacttgactcagtgaggacttcattatttttatttctctttccacgtctccaactttttaaaaatcactaatttaactctttgttaagtactcaagtacaaagtgatctcttctttcatgaactttgctataactgttgaaaggattggtgtcaggctctctcaaccctgggagtttccaaaatttagcaaatattacttgtgataagcttaaatgccacatcgctaagtacaattattaccaggaatccgtcaagggggagatagccccgctcacacccttagacccaaacaggtgctggttcatgctttctccacaaattggcagttgggtacttccccactgtcatcacagttgagctcattttaacatatattcaaagaagctttttagtttctactcctgaattgtagtgttcaagttatttgccttcctgggtaagaaaattttaacccaagtctgggattctctggcacctgtcttttcccatcttttaatgagttggcaagattaggtcaaatttcaatgctaaatttgattttttgaattttaaatagttgcactttatttcatgctgaccaccaacttaatttatacattttaaaataaaattatcctagaagtgttgtaaacgtgggaaaattttaattagtgttggaggtcattagattggacccaggtttaaatataatgatctcttcacagcttatttgatgtttaagagcaacttgtgtgatcttagctttgcaggttttctgtaatttatgtagcacaataaaggataaccagttgactgtgttactgga

SEQ ID NO: 171679 - DNA, 630 bp, Homo sapiens
  Payload ID: 13750
  Gene Symbol: PTPN4
  Gene Name: protein tyrosine phosphatase, non-receptor type 4 (megakaryocyte)
  ENST ID: ENST00000431283
  CDS Start-End: 1-594
agaaattcaatatctgatgacaggttagaaacacaaagtcttccatcacgatctccaccgggaactcctaatcatcgaaattctacattcacgcaggaaggaacccggttacgaccatcttcagttggtcatttggtagaccatatggttcatacttccccaagcgaagtgtttgtaaatcagagatctccgtcatcaacacaagctaatagcattgttctggaatcatcaccatcacaagagacccctggagatgggaagcctccagctttaccacccaaacagtcaaagaaaaacagttggaaccaaattcattattcacattcgcaacaagatctagaaagtcatattaatgaaacatttgatattccatcttctcctgaaaaacccactcctaatggtggtattccacatgataatcttgtcctaatcagaatgaaacctgatgaaaatgggaggtttggattcaatgtaaagggaggatatgatcagaagatgcctgtgattgtgtctcgagtagcaccaggaacacctgtgagttatctaaatgtttcaaataaatcctgttttcaagaatatgtacttattttataattcttactagtttaaataaaacaaggaatttcatca

SEQ ID NO: 171680 - DNA, 671 bp, Homo sapiens
  Payload ID: 13750
  Gene Symbol: PTPN4
  Gene Name: protein tyrosine phosphatase, non-receptor type 4 (megakaryocyte)
  ENST ID: ENST00000441089
  CDS Start-End: 1-658
cagcattataaatcagtacattgcttgtcaagggccattaccacacacttgtacagatttttggcagatgacttgggaacaaggctcctctatggttgtaatgttgaccacacaagttgaacgtggcagagttaaatgtcaccaatattggccagaacccacaggcagttcatcttatggatgctaccaagttacctgccactctgaagaaggaaacactgcctatatcttcaggaagatgaccctatttaaccaagagaaaaatgaaagtcgtccactcactcagatccagtacatagcctggcctgaccatggagtccctgatgattcgagtgactttctagattttgtttgtcatgtacgaaacaagagggctggcaaggaagaacccgttgttgtccattgcagtgctggaatcggaagaactggggttcttattactatggaaacagccatgtgtctcattgaatgcaatcagccagtttatccactagatattgtaagaacaatgagagatcagcgagccatgatgatccaaacacctttctgttttttatattttatttttcagagtcaatacagatttgtatgtgaagctattttgaaagtttatgaagaaggctttgttaaacccttaacaacatcaacaaataaataagaaagcaaaaaga

SEQ ID NO: 171681 - DNA, 4154 bp, Homo sapiens
  Payload ID: 13750
  Gene Symbol: PTPN4
  Gene Name: protein tyrosine phosphatase, non-receptor type 4 (megakaryocyte)
  ENST ID: ENST00000430976
  CDS Start-End: 1-407
ctgaacttggagactacgatcagtcagagaacttgtcaggctacctctcagattattctttcattcctaatcaacctcaagattttgaaaaagaaattgcaaaattacatcagcaacacataggcttatctcctgcagaagcagaatttaattacctaaacacagcacgtaccttagaactctatggagttgaattccactatgcaagggatcagagtaacaatgaaattatgattggagtgatgtcaggaggaattctgatttataagaacagggtacgaatgaatacctttccatggttgaagattgtaaaaatttcttttaagtgcaaacagttttttattcaacttagaaaagaattggtgagtacggatttaataattattgacataaatgaagccttttaagaaatacccattcatgacagaacttttctattattagtacaagtgaaagtgcaattaatactgtggataactgcccgctgaggtaatgaattcacttgttataacaaaatgtacttgtttttccagtgtgtatgtggttctaatttaaagttcttctagatattcctcttgctgtttctcgagcttagaaactgatttctcacacatgatgttcattgaaaacctcagggtccatttttgaagggcagcaaatgagcatttcatatatccctttttccctactaaatctatagtacttactttcgtatataagttcattttattttaggggagctgagtgttacaagttcatgaacttataacacattgcctccctttgttggagtggtaatggctttatatattataaataacaaattgagttgtcatggaaagtacagtgttggaaataatttcatcttgttaatgattttgtctgtttcattaaatcaaactaaccttatcctttgatgtacattatttcttagaaatctgagaagtcttggcaaattcatgcagatttcaagatggttgtgtgtgtatgtgtgtaaaatgtatttgaaaccataaaaatgtctttggggctgtcctcagtggctcaatcctgtaatcccagcactttgagaggctgaggtgggaggatcccttgaggccaggagttccagaccagccttggccacatagtgagacactgtctctacaaaaaaaaaatggaaaaaaaaaattggccaggtgtgatgatgtgtgcctctagtcccagctactcaggaggctgaggtgggaggctctctggagcccaggaattcaaggctgcaatgagctatcatcacaccattgcactccagcctggatgacatagggaggccctgtctcaaaaaaaaaaaaaaaaaaagcctttgggtacagtggtggcttctacctgttatcccagctacttggaaggctgaggtgggtggataggttgagcccaggagttcaaggctgcaatgagctgattgtgccactgtagtccagcatgggcaacagagcaggacaccactgcctcttgaaaaataaagaaagtctttgaatcagctctgttgtattggtctactacgtgattataaactatggtttatcgtttatgttcataaaatacagagggatttttttcaagagaatttttattgaaataaaacataataccaaaaatgtgcatattttaagtacacaacttgatgaagtgaacatatccatatcagcacctccaagatatgtagtatatgtaccgccttctaatatgtagaactttaccagcaccccagatgcttgaaatgttgctgctggagctgatgcccacttccagtcattaagcctcctggaagcatgaatctagagaaacattattgggatttaatatggtgaattacagagcatgtaaaaatttgtggaaagcatgtgtagaacatcacacattcttccgtttggacagaccacttccacctcaaaagaatttttttgcacattattttacattaggttcaaaattccggtactgtgggagaactgaagtccaatcagttcagtatggcaaagaaaaggcaaataaagacagggtatttgcaagatccccaagtaagcccttggcacggaaattaatggattgggaagtagtaagcagaaattcaatatctgatgacaggttagaaacacaaagtcttccatcacgatctccaccgggaactcctaatcatcgaaattctacattcacgcaggaaggaacccggttacgaccatcttcagttggtcatttggtagaccatatggttcatacttccccaagcgaagtgtttgtaaatcagagatctccgtcatcaacacaagctaatagcattgttctggaatcatcaccatcacaagagacccctggagatgggaagcctccagctttaccacccaaacagtcaaagaaaaacagttggaaccaaattcattattcacattcgcaacaagatctagaaagtcatattaatgaaacatttgatattccatcttctcctgaaaaacccactcctaatggtggtattccacatgataatcttgtcctaatcagaatgaaacctgatgaaaatgggaggtttggattcaatgtaaagggaggatatgatcagaagatgcctgtgattgtgtctcgagtagcaccaggaacacctgctgacctctgtgtccctagactgaatgaaggggaccaagttgtactgatcaatggtcgggacattgcagaacacactcatgatcaggttgtgctgtttattaaagctagttgtgagagacattctggggaactcatgcttctagttcgacctaatgctgtatatgatgtagtggaagaaaagctagaaaatgagccagatttccagtatattcctgagaaagccccactagatagtgtgcatcaggatgaccattccctgcgggagtcaatgatccagctagctgaggggcttatcactggaacagtcctgacacagtttgatcaactgtatcggaaaaaacctggaatgacaatgtcctgtgccaaattacctcagaatatttccaaaaatagatacagagatatttcgccttatgatgccacacgggtcattttaaaaggtaatgaagactacatcaatgcgaactatataaatatggaaattccttcttccagcattataaatcagtacattgcttgtcaagggccattaccacacacttgtacagatttttggcagatgacttgggaacaaggctcctctatggttgtaatgttgaccacacaagttgaacgtggcagagttaaatgtcaccaatattggccagaacccacaggcagttcatcttatggatgctaccaagttacctgccactctgaagaaggaaacactgcctatatcttcaggaagatgaccctatttaaccaagagaaaaatgaaagtcgtccactcactcagatccagtacatagcctggcctgaccatggagtccctgatgattcgagtgactttctagattttgtttgtcatgtacgaaacaagagggctggcaaggaagaacccgttgttgtccattgcagtgctggaatcggaagaactggggttcttattactatggaaacagccatgtgtctcattgaatgcaatcagccagtttatccactagatattgtaagaacaatgagagatcagcgagccatgatgatccaaacacctagtcaatacagatttgtatgtgaagctattttgaaagtttatgaagaaggctttgttaaacccttaacaacatcaacaaataaataagaaagcaaaaagatctgggatatgtgttggaaaactgctttcccttatgttcactgtgccataatgctgctcgcaggaaatggcattttacaaaaaaaaaatgaagaactcaaaaaaactttgaaaacttcagcactgttgcactttatgttttaaaaaatgtcactctttcaaaatctataactcatgtatttgaagactgtttcatgctttgctccgaacaaatagtaaataactgagtatgttcagggtaatttatgaaattttgtggtggtgccatgcaatccccttttggtagaattgccacaaacaaggctcaaaattctcatcatctctgttatacacctgtatcatgaaagcaaaaagaagtaaacatcaggagtcagctctg

SEQ ID NO: 171682 - DNA, 568 bp, Homo sapiens
  Payload ID: 13750
  Gene Symbol: PTPN4
  Gene Name: protein tyrosine phosphatase, non-receptor type 4 (megakaryocyte)
  ENST ID: ENST00000420482
  CDS Start-End: 344-568
ctccccagcggcgccggcccgcggctgcccagcagcatgaggtggtgctggcggctccgggtcgtggcgcgaccgctgcggcggcggctgctcggggggcgctgaggtagccccccggagcggcacggaggacgcgcttctcctctgcgcgccggggcctcgaggctttttttctccagccgagaggacgcggctgtgatatacgaagagtcttgctgtgtcgtctgggttggagtgcagtggcacaatctcagctcattgcaacttctgcctcctgggttcaagcgattctcctgcctcagcctcccgagtagctgggactacagactttgtgtggacagtaatgacctcacgtttccgattgcctgctggcagaacctacaatgtacgagcatcagagttggcccgagacagacagcatactgaagtggtttgcaacatccttcttctggataacactgtacaagctttcaaagtcaataaacatgatcaggggcaagtcttgttggatgtcgtcttcaagcatctagatttgactgagcaggactattttggtttacagttggct

SEQ ID NO: 171683 - DNA, 954 bp, Homo sapiens
  Payload ID: 13750
  Gene Symbol: PTPN4
  Gene Name: protein tyrosine phosphatase, non-receptor type 4 (megakaryocyte)
  ENST ID: ENST00000433888
  CDS Start-End: 1-366
aggtggctggatccaaacaaaccaataaggaagcagctaaagagaggatctccttacagtttgaactttagagtcaaattttttgtaagtgaccccaacaagttacaagaagaatatacaaggtaccagtattttttgcaaattaaacaagacattcttactggaagattaccctgtccttctaatactgctgcccttttagcttcatttgctgttcagtctgaacttggagactacgatcagtcagagaacttgtcaggctacctctcagattattctttcattcctaatcaacctcaagattttgaaaaagaaattgcaaaattacatcagcaacacatgatcagagtaacaatgaaattatgattggagtgatgtcaggaggaattctgatttataagaacagggtacgaatgaatacctttccatggttgaagattgtaaaaatttcttttaagtgcaaacagttttttattcaacttagaaaagaattgcatgaatctagagaaacattattgggatttaatatggtgaattacagagcatgtaaaaatttgtggaaagcatgtgtagaacatcacacattcttccgtttggacagaccacttccacctcaaaagaatttttttgcacattattttacattaggttcaaaattccggtactgatccccaagtaagcccttggcacggaaattaatggattgggaagtagtaagcagaaattcaatatctgatgacaggttagaaacacaaagtcttccatcacgatctccaccgggaactcctaatcatcgaaattctacattcacgcaggaaggaacccggttacgaccatcttcagttggtcatttggtagaccatatggttcatacttccccaagcgaagtgtttgtaaatcagagatctccgtcatcaacacaagctaatagcattgttctggaatcatcaccgt

SEQ ID NO: 171684 - DNA, 662 bp, Homo sapiens
  Payload ID: 13750
  Gene Symbol: PTPN4
  Gene Name: protein tyrosine phosphatase, non-receptor type 4 (megakaryocyte)
  ENST ID: ENST00000488279
  CDS Start-End: 179-662
ctggcggctccgggtcgtggcgcgaccgctgcggcggcggctgctcggggggcgctgaggtagccccccggagcggcacggaggacgcgcttctcctctgcgcgccggggcctcgaggctttttttctccagccgagaggacgcggctgtgatatacgaagactttgtgtggacagtaatgacctcacgtttccgattgcctgctggcagaacctacaatgtacgagcatcagagttggcccgagacagacagcatactgaagtggtttgcaacatccttcttctggataacactgtacaagctttcaaagtcaataaacatgatcaggggcaagtcttgttggatgtcgtcttcaagcatctagatttgactgagcaggactattttggtttacagttggctgatgattccacagataacccaaggtggctggatccaaacaaaccaataaggaagcagctaaagaaactacttttattaattctaggaggatctccttacagtttgaactttagagtcaaattttttgtaagtgaccccaacaagttacaagaagaatatacaaggtaccagtattttttgcaaattaaacaagacattcttactggaagattaccctgtccttctaatactgctgcccttttagcttcatttgctgttc

SEQ ID NO: 171685 - DNA, 3135 bp, Homo sapiens
  Payload ID: 13751
  Gene Symbol: PTPN5
  Gene Name: protein tyrosine phosphatase, non-receptor type 5 (striatum-enriched)
  Uniprot ID: P54829
  ENST ID: ENST00000358540
  CDS Start-End: 432-2129
gccggggctggggggtgccaaacccacccggcggctgcgccagcgactctgcagctgaagcgcatttggtgaggcggtcgggcgagggagcgcgcacggagcgcgggacggagcgccaggcggacggaccgaaggacggaggcaccgaaggacggacgcccccgcacacgcagacgcacagagctcggcgcggcccccgtcgcatacacactggcacagacacaagcagggacacacgcagacacacgcacactcgcgcgcgcatcctcccgccagcctgcccgcctgctcgccggcgcccggagcccgctctggccgctggatgatctgaagctgccctctctccttcatttatatcaccagcttgctttttgctgagaaagcttcctgccctggaagatggcacccttccccatccagacaccttgggaatgaattatgagggagccaggagtgagagagagaaccacgctgctgatgactccgagggaggggccctggacatgtgctgcagtgagaggctaccgggtctcccccagccgatagtgatggaggcactggacgaggctgaagggctccaggactcacagagagagatgccgccaccccctcctccctcgccgccctcagatccagctcagaagccaccacctcgaggcgctgggagccactccctcactgtcaggagcagcctgtgcctgttcgctgcctcacagttcctgcttgcctgtggggtgctctggttcagcggttatggccacatctggtcacagaacgccacaaacctcgtctcctctttgctgacgctcctgaaacagctggaacccacggcctggcttgactctgggacgtggggagtccccagtctgctgctggtctttctgtccgtgggcctggtcctcgttaccaccctggtgtggcacctcctgaggacacccccagagccacccaccccactgccccctgaggacaggcgccagtcagtgagccgccagccctccttcacctactcagagtggatggaggagaagatcgaggatgacttcctggacctcgacccggtgcccgagactcctgtgtttgattgtgtgatggacatcaagcctgaggctgaccccacctcactcaccgtcaagtccatgggtctgcaggagaggaggggttccaatgtctccctgaccctggacatgtgcactccgggctgcaacgaggagggctttggctatctcatgtccccacgtgaggagtccgcccgcgagtacctgctcagcgcctcccgtgtcctccaagcagaagagcttcatgaaaaggccctggaccctttcctgctgcaggcggaattctttgaaatccccatgaactttgtggatccgaaagagtacgacatccctgggctggtgcggaagaaccggtacaaaaccatacttcccaaccctcacagcagagtgtgtctgacctcaccagaccctgacgaccctctgagttcctacatcaatgccaactacatccggggctatggtggggaggagaaggtgtacatcgccactcagggacccatcgtcagcacggtcgccgacttctggcgcatggtgtggcaggagcacacgcccatcattgtcatgatcaccaacatcgaggagatgaacgagaaatgcaccgagtattggccggaggagcaggtggcgtacgacggtgttgagatcactgtgcagaaagtcattcacacggaggattaccggctgcgactcatctccctcaagagtgggactgaggagcgaggcctgaagcattactggttcacatcctggcccgaccagaagaccccagaccgggcccccccactcctgcacctggtgcgggaggtggaggaggcagcccagcaggaggggccccactgtgcccccatcatcgtccactgcagtgcagggattgggaggaccggctgcttcattgccaccagcatctgctgccagcagctgcggcaggagggtgtggtggacatcctgaagaccacgtgccagctccgtcaggacaggggcggcatgatccagacatgcgagcagtaccagtttgtgcaccacgtcatgagcctctacgaaaagcagctgtcccaccagtccccagaatgactgcgcttctcctacaaggttctctgggcactgcccagcctgagtctcggccctcacccagggccctgcctcgggtcctgggcctgctccccgcttcctccccttcagtcagctccctctgtcctctgtcagcctggcctgacccctaccctccagcattgctcttcctactgtacatattggggagtggggggcagggtcgggaagggacatgccaggccaggcctggggccccggggcctgacccacaccacgcagaccccgggctccagtttttaacgatggttccatcaatacctgatccagaatgtttccgtgctacactttgtgtcctgctgcaatgtgttctgtctgtccatccatctctgccctctgtaccggacactgtgtctcctcagccaggaaggggtaatgagctccagcccctaagcaaccggacttgcctgcctcggcctcacccgcacttctcccaaaaggcagatgacggggagttaggcatggggagctccagaaggtcaccagagagctttcagctgagggagagttctctaggttggagtgggcatcacagccagggtggcctctgggtgtcagatgctctcaggagggtgcccagcctgtgaggcactggcaaggtagggggcagatggggcatggagaacccagaggatctaggccctgttggggaggggaggggagctcaaggtttgggtggggactcagcccagatctacgtgagacatttttctgtgtcactgtgggaaagccttcccagaagtctcactgcgtgttgctctgcgtgtgttcccatgtccatgcgtgtgttgagagcccatcaggagggcatgcatgactctttggcaacatgtattatcttggagccacgtgtttttattgctgactttaaatatttatcccacggcagacagagacatttggtgtctttttataattcgctcgtggtcattgaatagagcaataaacggagcattttgagcaaaactaa

SEQ ID NO: 171686 - DNA, 2299 bp, Homo sapiens
  Payload ID: 13751
  Gene Symbol: PTPN5
  Gene Name: protein tyrosine phosphatase, non-receptor type 5 (striatum-enriched)
  ENST ID: ENST00000396166
  CDS Start-End: 780-1295
tgtggtctgctcaggctgctataacaaaataccatagaccaggtagcttgtaagcaacaggtttatttttcacagttctggagactgggaagtccaagatcaaggcaccgtgaccctggtgaggacccacttccagggtcatgtcctcacgtggcagaaggagtgaaagctccttttgtaagagcactgatcccattcgtgagggctccgttctcatgacttcatcacctcgcaaaggccctcccttcaaataccaccatgttgggatttggtttcaacatgtgaacttaaggggacacacacattcagtccaaagccacaggttttcagcaggagagcagcatgtccagatgtgtgttgtacacagactattttgactctgtggatctgagacagttggggatgaggcagaaatctcccacactcgagcaatgataaaggtcaaggtggcagtgaagcggggagtgtgaagaggtggtaaaacttgcagcactaattgcagcactaagatagaggcgagtcacgcaggcgcaggcgaggcacagcaagaggcgaagaagagtcccggggctgggttatgtgacaaagggatgactgggggaccatttgttaagataaggaaccctggagatagtaataaattggagaaggggctcttggcccctcttggatgatcctgaagttgttggggcaggaccaaaggcaagatccatgccaacgctgctgaccaacccccaaaaccaagctggctttgggtctgtgtctggtgccactgggcaatgtggcctagatggaagggtgaaggggtcccactctcagtgttcttcctgtgttcttcctccttccatctcatctctatctctgggctggtttgtgagctgaaagagttcacacatacctggggtgggcctctgtctcctcgacagagtgggactgaggagcgaggcctgaagcattactggttcacatcctggcccgaccagaagaccccagaccgggcccccccactcctgcacctggtgcgggaggtggaggaggcagcccagcaggaggggccccactgtgcccccatcatcgtccactgcagtgcagggattgggaggaccggctgcttcattgccaccagcatctgctgccagcagctgcggcaggagggtgtggtggacatcctgaagaccacgtgccagctccgtcaggacaggggcggcatgatccagacatgcgagcagtaccagtttgtgcaccacgtcatgagcctctacgaaaagcagctgtcccaccagtccccagaatgactgcgcttctcctacaaggttctctgggcactgcccagcctgagtctcggccctcacccagggccctgcctcgggtcctgggcctgctccccgcttcctccccttcagtcagctccctctgtcctctgtcagcctggcctgacccctaccctccagcattgctcttcctactgtacatattggggagtggggggcagggtcgggaagggacatgccaggccaggcctggggccccggggcctgacccacaccacgcagaccccgggctccagtttttaacgatggttccatcaatacctgatccagaatgtttccgtgctacactttgtgtcctgctgcaatgtgttctgtctgtccatccatctctgccctctgtaccggacactgtgtctcctcagccaggaaggggtaatgagctccagcccctaagcaaccggacttgcctgcctcggcctcacccgcacttctcccaaaaggcagatgacggggagttaggcatggggagctccagaaggtcaccagagagctttcagctgagggagagttctctaggttggagtgggcatcacagccagggtggcctctgggtgtcagatgctctcaggagggtgcccagcctgtgaggcactggcaaggtagggggcagatggggcatggagaacccagaggatctaggccctgttggggaggggaggggagctcaaggtttgggtggggactcagcccagatctacgtgagacatttttctgtgtcactgtgggaaagccttcccagaagtctcactgcgtgttgctctgcgtgtgttcccatgtccatgcgtgtgttgagagcccatcaggagggcatgcatgactctttggcaacatgtattatcttggagccacgtgtttttattgctgactttaaatatttatcccacggcagacagagacatttggtgtctttttataattcgctcgtggtcattgaatagagcaataaacggagcattttgagcaaaact

SEQ ID NO: 171687 - DNA, 2796 bp, Homo sapiens
  Payload ID: 13751
  Gene Symbol: PTPN5
  Gene Name: protein tyrosine phosphatase, non-receptor type 5 (striatum-enriched)
  Uniprot ID: P54829
  ENST ID: ENST00000396168
  CDS Start-End: 169-1794
catacacactggcacagacacaagcagggacacacgcagacacacgcacactcgcgcgcgcatcctcccgccagcctgcccgcctgctcgccggcgcccggagcccgctctggccggagtgagagagagaaccacgctgctgatgactccgagggaggggccctggacatgtgctgcagtgagaggctaccgggtctcccccagccgatagtgatggaggcactggacgaggctgaagggctccaggactcacagagagagatgccgccaccccctcctccctcgccgccctcagatccagctcagaagccaccacctcgaggcgctgggagccactccctcactgtcaggagcagcctgtgcctgttcgctgcctcacagttcctgcttgcctgtggggtgctctggttcagcggttatggccacatctggtcacagaacgccacaaacctcgtctcctctttgctgacgctcctgaaacagctggaacccacggcctggcttgactctgggacgtggggagtccccagtctgctgctggtctttctgtccgtgggcctggtcctcgttaccaccctggtgtggcacctcctgaggacacccccagagccacccaccccactgccccctgaggacaggcgccagtcagtgagccgccagccctccttcacctactcagagtggatggaggagaagatcgaggatgacttcctggacctcgacccggtgcccgagactcctgtgtttgattgtgtgatggacatcaagcctgaggctgaccccacctcactcaccgtcaagtccatgggtctgcaggagaggaggggttccaatgtctccctgaccctggacatgtgcactccgggctgcaacgaggagggctttggctatctcatgtccccacgtgaggagtccgcccgcgagtacctgctcagcgcctcccgtgtcctccaagcagaagagcttcatgaaaaggccctggaccctttcctgctgcaggcggaattctttgaaatccccatgaactttgtggatccgaaagagtacgacatccctgggctggtgcggaagaaccggtacaaaaccatacttcccaaccctcacagcagagtgtgtctgacctcaccagaccctgacgaccctctgagttcctacatcaatgccaactacatccggggctatggtggggaggagaaggtgtacatcgccactcagggacccatcgtcagcacggtcgccgacttctggcgcatggtgtggcaggagcacacgcccatcattgtcatgatcaccaacatcgaggagatgaacgagaaatgcaccgagtattggccggaggagcaggtggcgtacgacggtgttgagatcactgtgcagaaagtcattcacacggaggattaccggctgcgactcatctccctcaagagtgggactgaggagcgaggcctgaagcattactggttcacatcctggcccgaccagaagaccccagaccgggcccccccactcctgcacctggtgcgggaggtggaggaggcagcccagcaggaggggccccactgtgcccccatcatcgtccactgcagtgcagggattgggaggaccggctgcttcattgccaccagcatctgctgccagcagctgcggcaggagggtgtggtggacatcctgaagaccacgtgccagctccgtcaggacaggggcggcatgatccagacatgcgagcagtaccagtttgtgcaccacgtcatgagcctctacgaaaagcagctgtcccaccagtccccagaatgactgcgcttctcctacaaggttctctgggcactgcccagcctgagtctcggccctcacccagggccctgcctcgggtcctgggcctgctccccgcttcctccccttcagtcagctccctctgtcctctgtcagcctggcctgacccctaccctccagcattgctcttcctactgtacatattggggagtggggggcagggtcgggaagggacatgccaggccaggcctggggccccggggcctgacccacaccacgcagaccccgggctccagtttttaacgatggttccatcaatacctgatccagaatgtttccgtgctacactttgtgtcctgctgcaatgtgttctgtctgtccatccatctctgccctctgtaccggacactgtgtctcctcagccaggaaggggtaatgagctccagcccctaagcaaccggacttgcctgcctcggcctcacccgcacttctcccaaaaggcagatgacggggagttaggcatggggagctccagaaggtcaccagagagctttcagctgagggagagttctctaggttggagtgggcatcacagccagggtggcctctgggtgtcagatgctctcaggagggtgcccagcctgtgaggcactggcaaggtagggggcagatggggcatggagaacccagaggatctaggccctgttggggaggggaggggagctcaaggtttgggtggggactcagcccagatctacgtgagacatttttctgtgtcactgtgggaaagccttcccagaagtctcactgcgtgttgctctgcgtgtgttcccatgtccatgcgtgtgttgagagcccatcaggagggcatgcatgactctttggcaacatgtattatcttggagccacgtgtttttattgctgactttaaatatttatcccacggcagacagagacatttggtgtctttttataattcgctcgtggtcattgaatagagcaataaacggagcattttgagcaaaa

SEQ ID NO: 171688 - DNA, 3871 bp, Homo sapiens
  Payload ID: 13751
  Gene Symbol: PTPN5
  Gene Name: protein tyrosine phosphatase, non-receptor type 5 (striatum-enriched)
  Uniprot ID: P54829
  ENST ID: ENST00000396170
  CDS Start-End: 1266-2867
agctacgtggtggctcgcctctgattccccgtgtaaaaaatggagtttaggatccctgccctgtgtgcagcccacagcctcaagcccccatggggatggaatgccggaaacctctggccagcgcactagcagcctggagaatacggaagattgtggcaggattgtggggcacatgggcagctccctgctcgtccgggcccctggtgcccacgagaaaaccaaaacaggtgcgtgccccgcgccgcacgtcaggagggcaagactcagtggagggaggggctgtccactcgctctagctccccagaggctgaacagggagaactgggaaaaaggacgcctcctcagcgtcctagaacgagtcctcggcacctggtattgcatgcgccctagtatggggccgctccacttgcgcaggtgttggcaacatgcggggagcgccacggcatgcccccaatgagccgactccctcccccaactctgccccctttgtctcgctggcccctactccttctgtctgcctgtctgtcccgtcccaggttcagcgcgcacggccctgccggggtccctctggcagttgccgtagccgcgcggcccgacccggggctcccaagaggagaaaaaatcatgaatgaaatggatgcgctgctcccactcctccgccctccttgtccaagcaaccttggcatgggggcgacgactgcggagactccgcgcagagttgctcgggagagggaggcacctgagatgaggtcaggggttaagggtctgtgatccggcccccttcgtgccccgggagcaggccgctctcccggtcccccgccccgccagccctgcgcaattcccggcgagcggcggaagcccgcccgggggcggggcggagccggggctggggggtgccaaacccacccggcggctgcgccagcgactctgcagctgaagcgcatttggtgaggcggtcgggcgagggagcgcgcacggagcgcgggacggagcgccaggcggacggaccgaaggacggaggcaccgaaggacggacgcccccgcacacgcagacgcacagagctcggcgcggcccccgtcgcatacacactggcacagacacaagcagggacacacgcagacacacgcacactcgcgcgcgcatcctcccgccagcctgcccgcctgctcgccggcgcccggagcccgctctggccgcttgctttttgctgagaaagcttcctgccctggaagatggcacccttccccatccagacaccttgggaatgaattatgagggagccaggagtgagagagagaaccacgctgctgatgactccgagggaggggccctggacatgtgctgcagtgagaggctaccgggtctcccccagccgatagtgatggaggcactggacgaggctgaagggctccaggactcacagagagagatgccgccaccccctcctccctcgccgccctcagatccagctcagaagccaccacctcgaggcgctgggagccactccctcactgtcaggagcagcctgtgcctgttcgctgcctcacagttcctgctggaacccacggcctggcttgactctgggacgtggggagtccccagtctgctgctggtctttctgtccgtgggcctggtcctcgttaccaccctggtgtggcacctcctgaggacacccccagagccacccaccccactgccccctgaggacaggcgccagtcagtgagccgccagccctccttcacctactcagagtggatggaggagaagatcgaggatgacttcctggacctcgacccggtgcccgagactcctgtgtttgattgtgtgatggacatcaagcctgaggctgaccccacctcactcaccgtcaagtccatgggtctgcaggagaggaggggttccaatgtctccctgaccctggacatgtgcactccgggctgcaacgaggagggctttggctatctcatgtccccacgtgaggagtccgcccgcgagtacctgctcagcgcctcccgtgtcctccaagcagaagagcttcatgaaaaggccctggaccctttcctgctgcaggcggaattctttgaaatccccatgaactttgtggatccgaaagagtacgacatccctgggctggtgcggaagaaccggtacaaaaccatacttcccaaccctcacagcagagtgtgtctgacctcaccagaccctgacgaccctctgagttcctacatcaatgccaactacatccggggctatggtggggaggagaaggtgtacatcgccactcagggacccatcgtcagcacggtcgccgacttctggcgcatggtgtggcaggagcacacgcccatcattgtcatgatcaccaacatcgaggagatgaacgagaaatgcaccgagtattggccggaggagcaggtggcgtacgacggtgttgagatcactgtgcagaaagtcattcacacggaggattaccggctgcgactcatctccctcaagagtgggactgaggagcgaggcctgaagcattactggttcacatcctggcccgaccagaagaccccagaccgggcccccccactcctgcacctggtgcgggaggtggaggaggcagcccagcaggaggggccccactgtgcccccatcatcgtccactgcagtgcagggattgggaggaccggctgcttcattgccaccagcatctgctgccagcagctgcggcaggagggtgtggtggacatcctgaagaccacgtgccagctccgtcaggacaggggcggcatgatccagacatgcgagcagtaccagtttgtgcaccacgtcatgagcctctacgaaaagcagctgtcccaccagtccccagaatgactgcgcttctcctacaaggttctctgggcactgcccagcctgagtctcggccctcacccagggccctgcctcgggtcctgggcctgctccccgcttcctccccttcagtcagctccctctgtcctctgtcagcctggcctgacccctaccctccagcattgctcttcctactgtacatattggggagtggggggcagggtcgggaagggacatgccaggccaggcctggggccccggggcctgacccacaccacgcagaccccgggctccagtttttaacgatggttccatcaatacctgatccagaatgtttccgtgctacactttgtgtcctgctgcaatgtgttctgtctgtccatccatctctgccctctgtaccggacactgtgtctcctcagccaggaaggggtaatgagctccagcccctaagcaaccggacttgcctgcctcggcctcacccgcacttctcccaaaaggcagatgacggggagttaggcatggggagctccagaaggtcaccagagagctttcagctgagggagagttctctaggttggagtgggcatcacagccagggtggcctctgggtgtcagatgctctcaggagggtgcccagcctgtgaggcactggcaaggtagggggcagatggggcatggagaacccagaggatctaggccctgttggggaggggaggggagctcaaggtttgggtggggactcagcccagatctacgtgagacatttttctgtgtcactgtgggaaagccttcccagaagtctcactgcgtgttgctctgcgtgtgttcccatgtccatgcgtgtgttgagagcccatcaggagggcatgcatgactctttggcaacatgtattatcttggagccacgtgtttttattgctgactttaaatatttatcccacggcagacagagacatttggtgtctttttataattcgctcgtggtcattgaatagagcaataaacggagcattttgagcaaaact

SEQ ID NO: 171689 - DNA, 2826 bp, Homo sapiens
  Payload ID: 13751
  Gene Symbol: PTPN5
  Gene Name: protein tyrosine phosphatase, non-receptor type 5 (striatum-enriched)
  ENST ID: ENST00000477854
  CDS Start-End: 711-1820
ggaattctgagctaccgcaccagcatctgagacctcacaccctgcctccctaacctaagaatccagaacacagggcctccccgacccctgagctcccagccgtacagggttctcctgagaactcctgtctgtggaggcctttctaggagactactcttttgatgtacatatttgtgaggtcctctctggaaagggctttctcttggttcccttcagtcagcttttctccaaggagagtcctgaggcctccccgggcacgcagcaccggggccctgctctcagctgcccggtctggaccttagaggttcaggagcctccatgcagggccaggttgaggctgcaggtgagctctgctgggggaacacgggggaagggggccggctccatactcagcctgctcccctgtgccccagcttgcctgtggggtgctctggttcagcggttatggccacatctggtcacagaacgccacaaacctcgtctcctctttgctgacgctcctgaaacagctggaacccacggcctggcttgactctgggacgtggggagtccccagtctgctgctggtctttctgtccgtgggcctggtcctcgttaccaccctggtgtggcacctcctgaggacacccccagagccacccaccccactgccccctgaggacaggcgccagtcagtgagccgccagccctccttcacctactcagagtggatggaggagaagatcgaggatgacttcctggacctcgacccggtgcccgagactcctgtgtttgattgtgtgatggacatcaagcctgaggctgaccccacctcactcaccgtcaagtccatgggtctgcaggagaggaggggttccaatgtctccctgaccctggacatgtgcactccgggctgcaacgaggagggctttggctatctcatgtccccacgtgaggagtccgcccgcgagtacctgctcagcgcctcccgtgtcctccaagcagaagagcttcatgaaaaggccctggaccctttcctgctgcaggcggaattctttgaaatccccatgaactttgtggatccgaaagagtacgacatccctgggctggtgcggaagaaccggtacaaaaccatacttcccaaccctcacagcagagtgtgtctgacctcaccagaccctgacgaccctctgagttcctacatcaatgccaactacatccggggctatggtggggaggagaaggtgtacatcgccactcagggacccatcgtcagcacggtcgccgacttctggcgcatggtgtggcaggagcacacgcccatcattgtcatgatcaccaacatcgaggagatgaacgagaaatgcaccgagtattggccggaggagcaggtggcgtacgacggtgttgagatcactgtgcagaaagtcattcacacggaggattaccggctgcgactcatctccctcaagagtgggactgaggagcgaggcctgaagcattactggttcacatcctggcccgaccagaagaccccagaccgggcccccccactcctgcacctggtgcgggaggtggaggaggcagcccagcaggaggggccccactgtgcccccatcatcgtccactgcagtgcagggattgggaggaccggctgcttcattgccaccagcatctgctgccagcagctgcggcaggagggtgtggtggacatcctgaagaccacgtgccagctccgtcaggacaggggcggcatgatccagacatgcgagcagtaccagtttgtgcaccacgtcatgagcctctacgaaaagcagctgtcccaccagtccccagaatgactgcgcttctcctacaaggttctctgggcactgcccagcctgagtctcggccctcacccagggccctgcctcgggtcctgggcctgctccccgcttcctccccttcagtcagctccctctgtcctctgtcagcctggcctgacccctaccctccagcattgctcttcctactgtacatattggggagtggggggcagggtcgggaagggacatgccaggccaggcctggggccccggggcctgacccacaccacgcagaccccgggctccagtttttaacgatggttccatcaatacctgatccagaatgtttccgtgctacactttgtgtcctgctgcaatgtgttctgtctgtccatccatctctgccctctgtaccggacactgtgtctcctcagccaggaaggggtaatgagctccagcccctaagcaaccggacttgcctgcctcggcctcacccgcacttctcccaaaaggcagatgacggggagttaggcatggggagctccagaaggtcaccagagagctttcagctgagggagagttctctaggttggagtgggcatcacagccagggtggcctctgggtgtcagatgctctcaggagggtgcccagcctgtgaggcactggcaaggtagggggcagatggggcatggagaacccagaggatctaggccctgttggggaggggaggggagctcaaggtttgggtggggactcagcccagatctacgtgagacatttttctgtgtcactgtgggaaagccttcccagaagtctcactgcgtgttgctctgcgtgtgttcccatgtccatgcgtgtgttgagagcccatcaggagggcatgcatgactctttggcaacatgtattatcttggagccacgtgtttttattgctgactttaaatatttatcccacggcagacagagacatttggtgtctttttataattcgctcgtggtcattgaatagagcaataaacggagcattttgagcaaaactaa

SEQ ID NO: 171690 - DNA, 2245 bp, Homo sapiens
  Payload ID: 13752
  Gene Symbol: PTPN6
  Gene Name: protein tyrosine phosphatase, non-receptor type 6
  Uniprot ID: P29350
  ENST ID: ENST00000318974
  CDS Start-End: 245-2032
gtgctctaaaacgagaagtacaagtgagttcccccaaggggtcggccgcgcctcttcctgtccccgccctgccggctgccccaggccagtggagtggcagccccagaactgggaccaccgggggtggtgaggcggcccggcactgggagctgcatctgaggcttagtccctgagctctctgcctgcccagactagctgcacctcctcattccctgcgcccccttcctctccggaagcccccaggatggtgaggtggtttcaccgagacctcagtgggctggatgcagagaccctgctcaagggccgaggtgtccacggtagcttcctggctcggcccagtcgcaagaaccagggtgacttctcgctctccgtcagggtgggggatcaggtgacccatattcggatccagaactcaggggatttctatgacctgtatggaggggagaagtttgcgactctgacagagctggtggagtactacactcagcagcagggtgtcctgcaggaccgcgacggcaccatcatccacctcaagtacccgctgaactgctccgatcccactagtgagaggtggtaccatggccacatgtctggcgggcaggcagagacgctgctgcaggccaagggcgagccctggacgtttcttgtgcgtgagagcctcagccagcctggagacttcgtgctttctgtgctcagtgaccagcccaaggctggcccaggctccccgctcagggtcacccacatcaaggtcatgtgcgagggtggacgctacacagtgggtggtttggagaccttcgacagcctcacggacctggtggagcatttcaagaagacggggattgaggaggcctcaggcgcctttgtctacctgcggcagccgtactatgccacgagggtgaatgcggctgacattgagaaccgagtgttggaactgaacaagaagcaggagtccgaggatacagccaaggctggcttctgggaggagtttgagagtttgcagaagcaggaggtgaagaacttgcaccagcgtctggaagggcagcggccagagaacaagggcaagaaccgctacaagaacattctcccctttgaccacagccgagtgatcctgcagggacgggacagtaacatccccgggtccgactacatcaatgccaactacatcaagaaccagctgctaggccctgatgagaacgctaagacctacatcgccagccagggttgtctggaggccacggtcaatgacttctggcagatggcgtggcaggagaacagccgtgtcatcgtcatgaccacccgagaggtggagaaaggccggaacaaatgcgtcccatactggcccgaggtgggcatgcagcgtgcttatgggccctactctgtgaccaactgcggggagcatgacacaaccgaatacaaactccgtaccttacaggtctccccgctggacaatggagacctgattcgggagatctggcattaccagtacctgagctggcccgaccatggggtccccagtgagcctgggggtgtcctcagcttcctggaccagatcaaccagcggcaggaaagtctgcctcacgcagggcccatcatcgtgcactgcagcgccggcatcggccgcacaggcaccatcattgtcatcgacatgctcatggagaacatctccaccaagggcctggactgtgacattgacatccagaagaccatccagatggtgcgggcgcagcgctcgggcatggtgcagacggaggcgcagtacaagttcatctacgtggccatcgcccagttcattgaaaccactaagaagaagctggaggtcctgcagtcgcagaagggccaggagtcggagtacgggaacatcacctatcccccagccatgaagaatgcccatgccaaggcctcccgcacctcgtccaaacacaaggaggatgtgtatgagaacctgcacactaagaacaagagggaggagaaagtgaagaagcagcggtcagcagacaaggagaagagcaagggttccctcaagaggaagtgagcggtgctgtcctcaggtggccatgcctcagccctgaccctgtggaagcatttcgcgatggacagactcacaacctgaacctaggagtgccccattcttttgtaatttaaatggctgcatcccccccacctctccctgaccctgtatatagcccagccaggccccaggcagggccaacccttctcctcttgtaaataaagccctgggatcact

SEQ ID NO: 171691 - DNA, 2159 bp, Homo sapiens
  Payload ID: 13752
  Gene Symbol: PTPN6
  Gene Name: protein tyrosine phosphatase, non-receptor type 6
  Uniprot ID: P29350
  ENST ID: ENST00000399448
  CDS Start-End: 150-1943
attggcctggcaggcaggatcgaggaggaagtggctgattactgagcggttcttcctcacctggcttgggccactgtgcacagctgtgccgctggctcagccccgccccctgcggccctctgccgtggcttccccctccctacagagagatgctgtcccgtgggtggtttcaccgagacctcagtgggctggatgcagagaccctgctcaagggccgaggtgtccacggtagcttcctggctcggcccagtcgcaagaaccagggtgacttctcgctctccgtcagggtgggggatcaggtgacccatattcggatccagaactcaggggatttctatgacctgtatggaggggagaagtttgcgactctgacagagctggtggagtactacactcagcagcagggtgtcctgcaggaccgcgacggcaccatcatccacctcaagtacccgctgaactgctccgatcccactagtgagaggtggtaccatggccacatgtctggcgggcaggcagagacgctgctgcaggccaagggcgagccctggacgtttcttgtgcgtgagagcctcagccagcctggagacttcgtgctttctgtgctcagtgaccagcccaaggctggcccaggctccccgctcagggtcacccacatcaaggtcatgtgcgagggtggacgctacacagtgggtggtttggagaccttcgacagcctcacggacctggtggagcatttcaagaagacggggattgaggaggcctcaggcgcctttgtctacctgcggcagccgtactatgccacgagggtgaatgcggctgacattgagaaccgagtgttggaactgaacaagaagcaggagtccgaggatacagccaaggctggcttctgggaggagtttgagagtttgcagaagcaggaggtgaagaacttgcaccagcgtctggaagggcagcggccagagaacaagggcaagaaccgctacaagaacattctcccctttgaccacagccgagtgatcctgcagggacgggacagtaacatccccgggtccgactacatcaatgccaactacatcaagaaccagctgctaggccctgatgagaacgctaagacctacatcgccagccagggttgtctggaggccacggtcaatgacttctggcagatggcgtggcaggagaacagccgtgtcatcgtcatgaccacccgagaggtggagaaaggccggaacaaatgcgtcccatactggcccgaggtgggcatgcagcgtgcttatgggccctactctgtgaccaactgcggggagcatgacacaaccgaatacaaactccgtaccttacaggtctccccgctggacaatggagacctgattcgggagatctggcattaccagtacctgagctggcccgaccatggggtccccagtgagcctgggggtgtcctcagcttcctggaccagatcaaccagcggcaggaaagtctgcctcacgcagggcccatcatcgtgcactgcagcgccggcatcggccgcacaggcaccatcattgtcatcgacatgctcatggagaacatctccaccaagggcctggactgtgacattgacatccagaagaccatccagatggtgcgggcgcagcgctcgggcatggtgcagacggaggcgcagtacaagttcatctacgtggccatcgcccagttcattgaaaccactaagaagaagctggaggtcctgcagtcgcagaagggccaggagtcggagtacgggaacatcacctatcccccagccatgaagaatgcccatgccaaggcctcccgcacctcgtccaaacacaaggaggatgtgtatgagaacctgcacactaagaacaagagggaggagaaagtgaagaagcagcggtcagcagacaaggagaagagcaagggttccctcaagaggaagtgagcggtgctgtcctcaggtggccatgcctcagccctgaccctgtggaagcatttcgcgatggacagactcacaacctgaacctaggagtgccccattcttttgtaatttaaatggctgcatcccccccacctctccctgaccctgtatatagcccagccaggccccaggcagggccaacccttctcctcttgtaaataaagccctgggatcactgtg

SEQ ID NO: 171692 - DNA, 2389 bp, Homo sapiens
  Payload ID: 13752
  Gene Symbol: PTPN6
  Gene Name: protein tyrosine phosphatase, non-receptor type 6
  Uniprot ID: P29350
  ENST ID: ENST00000456013
  CDS Start-End: 243-2117
gctctaaaacgagaagtacaagtgagttcccccaaggggtcggccgcgcctcttcctgtccccgccctgccggctgccccaggccagtggagtggcagccccagaactgggaccaccgggggtggtgaggcggcccggcactgggagctgcatctgaggcttagtccctgagctctctgcctgcccagactagctgcacctcctcattccctgcgcccccttcctctccggaagcccccaggatggtgaggtggtttcaccgagacctcagtgggctggatgcagagaccctgctcaagggccgaggtgtccacggtagcttcctggctcggcccagtcgcaagaaccagggtgacttctcgctctccgtcagggtgggggatcaggtgacccatattcggatccagaactcaggggatttctatgacctgtatggaggggagaagtttgcgactctgacagagctggtggagtactacactcagcagcagggtgtcctgcaggaccgcgacggcaccatcatccacctcaagtacccgctgaactgctccgatcccactagtgagaggtggtaccatggccacatgtctggcgggcaggcagagacgctgctgcaggccaagggcgagccctggacgtttcttgtgcgtgagagcctcagccagcctggagacttcgtgctttctgtgctcagtgaccagcccaaggctggcccaggctccccgctcagggtcacccacatcaaggtcatgtgcgagggtggacgctacacagtgggtggtttggagaccttcgacagcctcacggacctggtggagcatttcaagaagacggggattgaggaggcctcaggcgcctttgtctacctgcggcagccgtactatgccacgagggtgaatgcggctgacattgagaaccgagtgttggaactgaacaagaagcaggagtccgaggatacagccaaggctggcttctgggaggagtttgagagtttgcagaagcaggaggtgaagaacttgcaccagcgtctggaagggcagcggccagagaacaagggcaagaaccgctacaagaacattctcccctttgaccacagccgagtgatcctgcagggacgggacagtaacatccccgggtccgactacatcaatgccaactacatcaagaaccagctgctaggccctgatgagaacgctaagacctacatcgccagccagggttgtctggaggccacggtcaatgacttctggcagatggcgtggcaggagaacagccgtgtcatcgtcatgaccacccgagaggtggagaaaggccggaacaaatgcgtcccatactggcccgaggtgggcatgcagcgtgcttatgggccctactctgtgaccaactgcggggagcatgacacaaccgaatacaaactccgtaccttacaggtctccccgctggacaatggagacctgattcgggagatctggcattaccagtacctgagctggcccgaccatggggtccccagtgagcctgggggtgtcctcagcttcctggaccagatcaaccagcggcaggaaagtctgcctcacgcagggcccatcatcgtgcactgcagcgccggcatcggccgcacaggcaccatcattgtcatcgacatgctcatggagaacatctccaccaagggcctggactgtgacattgacatccagaagaccatccagatggtgcgggcgcagcgctcgggcatggtgcagacggaggcgcagtacaagttcatctacgtggccatcgcccagttcattgaaaccactaagaagaagctggaggtcctgcagtcgcagaagggccaggagtcggagtacgggaacatcacctatcccccagccatgaagaatgcccatgccaaggcctcccgcacctcgtccaagagcttggagtctagtgcagggaccgtggctgcgtcacctgtgagacggggtggccagaggggactgccagtgccgggtccccctgtgctgtctcctgacctgcaccaactgcctgtacttgcccccctgcacccggctgcagacacaaggaggatgtgtatgagaacctgcacactaagaacaagagggaggagaaagtgaagaagcagcggtcagcagacaaggagaagagcaagggttccctcaagaggaagtgagcggtgctgtcctcaggtggccatgcctcagccctgaccctgtggaagcatttcgcgatggacagactcacaacctgaacctaggagtgccccattcttttgtaatttaaatggctgcatcccccccacctctccctgaccctgtatatagcccagccaggccccaggcagggccaacccttctcctcttgtaaataaagccctgggatcactgtg

SEQ ID NO: 171693 - DNA, 579 bp, Homo sapiens
  Payload ID: 13752
  Gene Symbol: PTPN6
  Gene Name: protein tyrosine phosphatase, non-receptor type 6
  ENST ID: ENST00000538715
  CDS Start-End: 85-579
ccttgctgtgctctaaaacgagaagtacaaactagctgcacctcctcattccctgcgcccccttcctctccggaagcccccaggatggtgaggtggtttcaccgagacctcagtgggctggatgcagagaccctgctcaagggccgaggtgtccacggtagcttcctggctcggcccagtcgcaagaaccagggtgacttctcgctctccgtcagggtgggggatcaggtgacccatattcggatccagaactcaggggatttctatgacctgtatggaggggagaagtttgcgactctgacagagctggtggagtactacactcagcagcagggtgtcctgcaggaccgcgacggcaccatcatccacctcaagtacccgctgaactgctccgatcccactagtgagaggtggtaccatggccacatgtctggcgggcaggcagagacgctgctgcaggccaagggcgagccctggacgtttcttgtgcgtgagagcctcagccagcctggagacttcgtgctttctgtgctcagtgaccagcccaaggctggcccaggctccccgctcagggtcacc

SEQ ID NO: 171694 - DNA, 570 bp, Homo sapiens
  Payload ID: 13752
  Gene Symbol: PTPN6
  Gene Name: protein tyrosine phosphatase, non-receptor type 6
  ENST ID: ENST00000542462
  CDS Start-End: 139-570
aactgggaccaccgggggtggtgaggcggcccggcactgggagctgcatctgaggcttagtccctgagctctctgcctgcccagactagctgcacctcctcattccctgcgcccccttcctctccggaagcccccaggatggtgagggtgggggatcaggtgacccatattcggatccagaactcaggggatttctatgacctgtatggaggggagaagtttgcgactctgacagagctggtggagtactacactcagcagcagggtgtcctgcaggaccgcgacggcaccatcatccacctcaagtacccgctgaactgctccgatcccactagtgagaggtggtaccatggccacatgtctggcgggcaggcagagacgctgctgcaggccaagggcgagccctggacgtttcttgtgcgtgagagcctcagccagcctggagacttcgtgctttctgtgctcagtgaccagcccaaggctggcccaggctccccgctcagggtcacccacatcaaggtcatgtgcgagggtggacgctacacagtgggtggtttggagaccttcgac

SEQ ID NO: 171695 - DNA, 543 bp, Homo sapiens
  Payload ID: 13752
  Gene Symbol: PTPN6
  Gene Name: protein tyrosine phosphatase, non-receptor type 6
  ENST ID: ENST00000535462
  CDS Start-End: 141-323
agaactgggaccaccgggggtggtgaggcggcccggcactgggagctgcatctgaggcttagtccctgagctctctgcctgcccagactagctgcacctcctcattccctgcgcccccttcctctccggaagcccccaggatggtgaggtggtttcaccgagacctcagtgggctggatgcagagaccctgctcaagggccgaggtgtccacggtagcttcctggctcggcccagtcgcaagaaccagggtgacttctcgctctccgtcagaactcaggggatttctatgacctgtatggaggggagaagtttgcgactctgacagagctggtggagtactacactcagcagcagggtgtcctgcaggaccgcgacggcaccatcatccacctcaagtacccgctgaactgctccgatcccactagtgagaggtggtaccatggccacatgtctggcgggcaggcagagacgctgctgcaggccaagggcgagccctggacgtttcttgtgcgtgagagcctcagccagcctggagacttcgt

SEQ ID NO: 171696 - DNA, 650 bp, Homo sapiens
  Payload ID: 13752
  Gene Symbol: PTPN6
  Gene Name: protein tyrosine phosphatase, non-receptor type 6
  ENST ID: ENST00000543115
  CDS Start-End: 259-650
cgctttggggctgcagggaagctggccgctgtgggcggtctcgggccagccccgccccacctgtccttttcctggagactattagtccagggtttgtccctgcagtgccattggcctggcaggcaggatcgaggaggaagtggctgattactgagcggttcttcctcacctggcttgggccactgtgcacagctgtgccgctggctcagccccgccccctgcggccctctgccgtggcttccccctccctacagagagatgctgtcccgtggctgcacctcctcattccctgcgcccccttcctctccggaagcccccaggatggtgaggtggtttcaccgagacctcagtgggctggatgcagagaccctgctcaagggccgaggtgtccacggtagcttcctggctcggcccagtcgcaagaaccagggtgacttctcgctctccgtcagggtgggggatcaggtgacccatattcggatccagaactcaggggatttctatgacctgtatggaggggagaagtttgcgactctgacagagctggtggagtactacactcagcagcagggtgtcctgcaggaccgcgacggcaccatcatccacctcaagtacccgctgaactgctccgatcccactagtgagaggtg

SEQ ID NO: 171697 - DNA, 656 bp, Homo sapiens
  Payload ID: 13752
  Gene Symbol: PTPN6
  Gene Name: protein tyrosine phosphatase, non-receptor type 6
  ENST ID: ENST00000542848
  CDS Start-End: 153-329
gccattggcctggcaggcaggatcgaggaggaagtggctgattactgagcggttcttcctcacctggcttgggccactgtgcacagctgtgccgctggctcagccccgccccctgcggccctctgccgtggcttccccctccctacagagagatgctgtcccgtgggtggtttcaccgagacctcagtgggctggatgcagagaccctgctcaagggccgaggtgtccacggtagcttcctggctcggcccagtcgcaagaaccagggtgacttctcgctctccgtcaggaccgcgacggcaccatcatccacctcaagtacccgctgaactgctccgatcccactagtgagaggtggtaccatggccacatgtctggcgggcaggcagagacgctgctgcaggccaagggcgagccctggacgtttcttgtgcgtgagagcctcagccagcctggagacttcgtgctttctgtgctcagtgaccagcccaaggctggcccaggctccccgctcagggtcacccacatcaaggtcatgtgcgagggtggacgctacacagtgggtggtttggagaccttcgacagcctcacggacctggtggagcatttcaagaagacggggattgaggaggcctcaggcgcctttgtctacctgc

SEQ ID NO: 171698 - DNA, 592 bp, Homo sapiens
  Payload ID: 13752
  Gene Symbol: PTPN6
  Gene Name: protein tyrosine phosphatase, non-receptor type 6
  ENST ID: ENST00000541698
  CDS Start-End: 141-592
agaactgggaccaccgggggtggtgaggcggcccggcactgggagctgcatctgaggcttagtccctgagctctctgcctgcccagactagctgcacctcctcattccctgcgcccccttcctctccggaagcccccaggatggtgaggtggtttcaccgagacctcagtgggctggatgcagagaccctgctcaagggccgaggtgtccacggtagcttcctggctcggcccagtcgcaagaaccagggtgacttctcgctctccgtcagggtgggggatcaggtgacccatattcggatccagaactcaggggatttctatgacctgtatggaggggagaagtttgcgactctgacagagctggtggagtactacactcagcagcagggtgtcctgcaggaccgcgacggcaccatcatccacctcaagtacccgctgaactgctccgatcccactagtgagaggtggtaccatggccacatgtctggcgggcaggcagagacgctgctgcaggctccccgctcagggtcacccacatcaaggtcatgtgcgagggtggacgctacacagtgggtggtttggagaccttc

SEQ ID NO: 171699 - DNA, 602 bp, Homo sapiens
  Payload ID: 13752
  Gene Symbol: PTPN6
  Gene Name: protein tyrosine phosphatase, non-receptor type 6
  ENST ID: ENST00000536013
  CDS Start-End: 77-247
cctgagctctctgcctgcccagactagctgcacctcctcattccctgcgcccccttcctctccggaagcccccaggatggtgaggtggtttcaccgagacctcagtgggctggatgcagagaccctgctcaagggccgaggtgtccacggtagcttcctggctcggcccagtcgcaagaaccagggtgacttctcgctctccgtcaggaccgcgacggcaccatcatccacctcaagtacccgctgaactgctccgatcccactagtgagaggtggtaccatggccacatgtctggcgggcaggcagagacgctgctgcaggccaagggcgagccctggacgtttcttgtgcgtgagagcctcagccagcctggagacttcgtgctttctgtgctcagtgaccagcccaaggctggcccaggctccccgctcagggtcacccacatcaaggtcatgtgcgagggtggacgctacacagtgggtggtttggagaccttcgacagcctcacggacctggtggagcatttcaagaagacggggattgaggaggcctcaggcgcctttgtctacctgcggcagccgtactatgccacgagggtgaa

SEQ ID NO: 171700 - DNA, 959 bp, Homo sapiens
  Payload ID: 13752
  Gene Symbol: PTPN6
  Gene Name: protein tyrosine phosphatase, non-receptor type 6
  ENST ID: ENST00000545153
  CDS Start-End: 142-360
cagaactgggaccaccgggggtggtgaggcggcccggcactgggagctgcatctgaggcttagtccctgagctctctgcctgcccagactagctgcacctcctcattccctgcgcccccttcctctccggaagcccccaggatggtgaggtggtttcaccgagacctcagtgggctggatgcagagaccctgctcaagggccgaggtgtccacggtagcttcctggctcggcccagtcgcaagaaccagggtgacttctcgctctccgtcaggacctcagccgatccctgccctcctgcctctactcctgcaccgactggcctcaccgcctggtgccctgcagggtgggggatcaggtgacccatattcggatccagaactcaggggatttctatgacctgtatggaggggagaagtttgcgactctgacagagctggtggagtactacactcagcagcagggtgtcctgcaggaccgcgacggcaccatcatccacctcaagtacccgctgaactgctccgatcccactagtgagaggtggtaccatggccacatgtctggcgggcaggcagagacgctgctgcaggccaagggcgagccctggacgtttcttgtgcgtgagagcctcagccagcctggagacttcgtgctttctgtgctcagtgaccagcccaaggctggcccaggctccccgctcagggtcacccacatcaaggtcatgtgcgagggtggacgctacacagtgggtggtttggagaccttcgacagcctcacggacctggtggagcatttcaagaagacggggattgaggaggcctcaggcgcctttgtctacctgcggcagccgtactatgccacgagggtgaatgcggctgacattgagaaccgagtgttggaactgaacaagaagcaggagtccgaggatacagccaaggctggcttctgggaggagtttgag

SEQ ID NO: 171701 - DNA, 3765 bp, Homo sapiens
  Payload ID: 13753
  Gene Symbol: PTPN7
  Gene Name: protein tyrosine phosphatase, non-receptor type 7
  Uniprot ID: P35236
  ENST ID: ENST00000309017
  CDS Start-End: 775-2172
aaaaggaggcgtgcagcgagcatgaaccggctgggctgctggcccgcaaggagcctgccaaggtcaggcaggggcagtgggcagaggagtcttggacttgggggccacccttcaggtcccaggcatccaggcaccccagcagcgaagaggacatgggagtcccctggtgtgagggccagagactgtccactgtctgtaagtcttctaagtagatgtcagggttctgggaggaggcctgcagggggctgagggcccaggggaagcccctcggactccctcccacaagtggactctgctatctgcttcctgctgggctggcctacactcaggccgtgggctgtggagagctgggccgtggcacaggcgtggagacgacctttttggcctggccccggccctttccttcacattgtgaggcatggattcttgcttcttctttttccccaccccgagtctgtgccacatctgctctgggaagatgtggtctgtgcttggccatgaattcccaaggcttgaagcagcaagggctttgagggagagggccttgagggagagggccttgagggagagggctgtggggcagaagcagagaaggagaaataagcctccggccaaggtcaggttgagcaggagagccttgggttctttgtgggacagcacagagctgggggtcaggcgagctgtgcccagcaagtaggcagcggctggatgtgacaaagacccagaggagaaacacagaagaggggagagggtctggaagctggggaaagcaggatggtcgggaaggcctggcccctcacccattcccagggaacggggccttgggccccagaagggcacaggcgggaggcagccgacccctggtggcagcggcagcaggcacaggagggcagaatgcagctggggtgtgcgtgggtggcagcaaggaggggcggagggaggaagctggcttcctggagccttctcagccctcaaagacagaccgacagacagacagacagctggcaagaggcagcctgggggccacagctgcttcagcagacctcatggctgagtgagcctcccctgggcccagcaccccacctcagcatggtccaagcccatggggggcgctccagagcacagccgttgaccttgtctttgggggcagccatgacccagcctccgcctgaaaaaacgccagccaagaagcatgtgcgactgcaggagaggcggggctccaatgtggctctgatgctggacgttcggtccctgggggccgtagaacccatctgctctgtgaacacaccccgggaggtcaccctacactttctgcgcactgctggacacccccttacccgctgggcccttcagcgccagccacccagccccaagcaactggaagaagaattcttgaagatcccttcaaactttgtcagccccgaagacctggacatccctggccacgcctccaaggaccgatacaagaccatcttgccaaatccccagagccgtgtctgtctaggccgggcacagagccaggaggacggagattacatcaatgccaactacatccgaggctatgacgggaaggagaaggtctacattgccacccagggccccatgcccaacactgtgtcggacttctgggagatggtgtggcaagaggaagtgtccctcattgtcatgctcactcagctccgagagggcaaggagaaatgtgtccactactggcccacagaagaggaaacctatggacccttccagatccgcatccaggacatgaaagagtgcccagaatacactgtgcggcagctcaccatccagtaccaggaagagcgccggtcagtaaagcacatcctcttttcggcctggccagaccatcagacaccagaatcagctgggcccctgctgcgcctagtggcagaggtggaggagagcccggagacagccgcccaccccgggcctatcgtagtccactgcagtgcagggattggccggacgggctgcttcatcgccacgcgaattggctgtcaacagctgaaagcccgaggagaagtggacattctgggtattgtgtgccaactgcggctagacagaggggggatgatccagacggcagagcagtaccagttcctgcaccacactttggccctgtatgcaggccagctgcctgaggaacccagcccctgacccctgccaccctccggtggcccaggtgcctacctccctcaagcctgggaaggtgggtctggggaaagtgggccgagtgatctgggggtaccccttgggttggtgtggggaaggagtgcctccttagtggtgcttgcagtcacaggaagcagcagcagtaaggacaaggggccggattccaggtcttcaacactggccactcctctgcttcctctgttggccccagatggacagtaaggggaacctccaatgtctctctgaacttaaagacaggagctggcatttatgacagacaaagaaagaagcccaggtgtcctggtgttctctgagacactctttgtgagcttcagtttcctgttctataacatgaacataagtgcttagctgccatgagggaaaagtaatgagagaagtttctagaagccactccagccactccttcctggggctgacaaaagggtgattccaagatcatccttcacccgaggtcctgcccaagcacaggccagatgcaagaatggggaaaagtctggtcctgatctccaagtctcaacatcctatcagtgactctgctccctgaccacacatcggaagggctggatgaccccaatcaaaagaaagaacaaggactctggttacccttgcctccacccatgtgtcataagagtaggctacagaggtgaccaggcctggcagttgaaatctctggaagagggaacatgtggggactactcagaggcaaagaggagctgctcctgcctccatggttgctggccactcccaccaactactcttagggaggctaagcagtctctgttttgcttccatggctcaaataataccctgggtatgcaggacccactataccttgcatttgctgagtacacctagagagcttggctgtttccaaaaacaatcagggtcataaccatccatgcagacatggaggctcggctgaaccaggactcctcactgtctacctgagagaatgagcacccctcatccatctcagcatcaacacaatttccaggggacctcaggtctacctcaggactgaacgccacacctcaggattcctcctccttgaatctgagactggctgcccattctgagatggggatgaaggtaagatgccgcatcaccaggcacgccgcccctgacagctgccttgataccagctctctgtggaaacccccgaggagttggatctggagaacagctgggcctcctcactcaggacttctctcctgaagaacacgcagtgctaaaactgaggatgatttccctaatgcttctgcttggccttatggaggagctgctccttccttacagccttggggatggacttgcccacacctccacctcccctgagccctgtgagaggcacgactgtctatgccaatgaggctcggtggggggctctcaagtgcctgatcctgccctgggctcagagccagcccagagggaagcaactgcacagccccacaggccctccctggcactgtccccccaaccccatctcagagctcagagggtacaagctccagaacagtaaccaagtgggaaaataaagacttcttggatgactgactc

SEQ ID NO: 171702 - DNA, 3265 bp, Homo sapiens
  Payload ID: 13753
  Gene Symbol: PTPN7
  Gene Name: protein tyrosine phosphatase, non-receptor type 7
  Uniprot ID: P35236
  ENST ID: ENST00000367279
  CDS Start-End: 473-1672
ccagaaacagacctgggagtggaacagcagcagttaggagaggaccctgctggggtccaggagcccgcctgcctggctgcccaaccagctccaacactgctggaggcctccattctctgttcaggggaaggcccactggttagctcagagatggcttctgcgtgctttctcccttccgtcctagagaacacatattttctgtttcctcccttgccttctcccacttggacctgctcagagccctgtgtactctggtgtgtggcctctctcccctctctcttttcctccttctggattctttcctatcttcatccacaatctctaccctttatcttgccgttactctaccccgagactgccttctgccctgggtcccaccaaatagatcctgtccttcccttagtgaaaatgaggccacctcttggggaacagaagacgccccagtgaaaacagagtgcaaacctggcctggcatgggagcctccttctggccaatcaggcaggccagagaacagcagcggagggccctgtctttcaggcagacctcatggctgagtgagcctcccctgggcccagcaccccacctcagcatggtccaagcccatggggggcgctccagagcacagccgttgaccttgtctttgggggcagccatgacccagcctccgcctgaaaaaacgccagccaagaagcatgtgcgactgcaggagaggcggggctccaatgtggctctgatgctggacgttcggtccctgggggccgtagaacccatctgctctgtgaacacaccccgggaggtcaccctacactttctgcgcactgctggacacccccttacccgctgggcccttcagcgccagccacccagccccaagcaactggaagaagaattcttgaagatcccttcaaactttgtcagccccgaagacctggacatccctggccacgcctccaaggaccgatacaagaccatcttgccaaatccccagagccgtgtctgtctaggccgggcacagagccaggaggacggagattacatcaatgccaactacatccgaggctatgacgggaaggagaaggtctacattgccacccagggccccatgcccaacactgtgtcggacttctgggagatggtgtggcaagaggaagtgtccctcattgtcatgctcactcagctccgagagggcaaggagaaatgtgtccactactggcccacagaagaggaaacctatggacccttccagatccgcatccaggacatgaaagagtgcccagaatacactgtgcggcagctcaccatccagtaccaggaagagcgccggtcagtaaagcacatcctcttttcggcctggccagaccatcagacaccagaatcagctgggcccctgctgcgcctagtggcagaggtggaggagagcccggagacagccgcccaccccgggcctatcgtagtccactgcagtgcagggattggccggacgggctgcttcatcgccacgcgaattggctgtcaacagctgaaagcccgaggagaagtggacattctgggtattgtgtgccaactgcggctagacagaggggggatgatccagacggcagagcagtaccagttcctgcaccacactttggccctgtatgcaggccagctgcctgaggaacccagcccctgacccctgccaccctccggtggcccaggtgcctacctccctcaagcctgggaaggtgggtctggggaaagtgggccgagtgatctgggggtaccccttgggttggtgtggggaaggagtgcctccttagtggtgcttgcagtcacaggaagcagcagcagtaaggacaaggggccggattccaggtcttcaacactggccactcctctgcttcctctgttggccccagatggacagtaaggggaacctccaatgtctctctgaacttaaagacaggagctggcatttatgacagacaaagaaagaagcccaggtgtcctggtgttctctgagacactctttgtgagcttcagtttcctgttctataacatgaacataagtgcttagctgccatgagggaaaagtaatgagagaagtttctagaagccactccagccactccttcctggggctgacaaaagggtgattccaagatcatccttcacccgaggtcctgcccaagcacaggccagatgcaagaatggggaaaagtctggtcctgatctccaagtctcaacatcctatcagtgactctgctccctgaccacacatcggaagggctggatgaccccaatcaaaagaaagaacaaggactctggttacccttgcctccacccatgtgtcataagagtaggctacagaggtgaccaggcctggcagttgaaatctctggaagagggaacatgtggggactactcagaggcaaagaggagctgctcctgcctccatggttgctggccactcccaccaactactcttagggaggctaagcagtctctgttttgcttccatggctcaaataataccctgggtatgcaggacccactataccttgcatttgctgagtacacctagagagcttggctgtttccaaaaacaatcagggtcataaccatccatgcagacatggaggctcggctgaaccaggactcctcactgtctacctgagagaatgagcacccctcatccatctcagcatcaacacaatttccaggggacctcaggtctacctcaggactgaacgccacacctcaggattcctcctccttgaatctgagactggctgcccattctgagatggggatgaaggtaagatgccgcatcaccaggcacgccgcccctgacagctgccttgataccagctctctgtggaaacccccgaggagttggatctggagaacagctgggcctcctcactcaggacttctctcctgaagaacacgcagtgctaaaactgaggatgatttccctaatgcttctgcttggccttatggaggagctgctccttccttacagccttggggatggacttgcccacacctccacctcccctgagccctgtgagaggcacgactgtctatgccaatgaggctcggtggggggctctcaagtgcctgatcctgccctgggctcagagccagcccagagggaagcaactgcacagccccacaggccctccctggcactgtccccccaaccccatctcagagctcagagggtacaagctccagaacagtaaccaagtgggaaaataaagacttcttggatgactgactc

SEQ ID NO: 171703 - DNA, 575 bp, Homo sapiens
  Payload ID: 13753
  Gene Symbol: PTPN7
  Gene Name: protein tyrosine phosphatase, non-receptor type 7
  ENST ID: ENST00000435759
  CDS Start-End: 117-575
aaagacagaccgacagacagacagacagctggcaagaggcagcctgggggccacagctgcttcagcagacctcatggctgagtgagcctcccctgggcccagcaccccacctcagcatggtccaagcccatggggggcgctccagagcacagccgttgaccttgtctttgggggcagccatgacccagcctccgcctgaaaaaacgccagccaagaagcatgtgcgactgcaggagagtggtgggctatgcctgcaggcggggctccaatgtggctctgatgctggacgttcggtccctgggggccgtagaacccatctgctctgtgaacacaccccgggaggtcaccctacactttctgcgcactgctggacacccccttacccgctgggcccttcagcgccagccacccagccccaagcaactggaagaagaattcttgaagatcccttcaaactttgtcagccccgaagacctggacatccctggccacgcctccaaggaccgatacaagaccatcttgccaaatccccagagccgtgtctgtctaggccgggcacagagccaggaggacgg

SEQ ID NO: 171704 - DNA, 551 bp, Homo sapiens
  Payload ID: 13753
  Gene Symbol: PTPN7
  Gene Name: protein tyrosine phosphatase, non-receptor type 7
  ENST ID: ENST00000486116
  CDS Start-End: 132-551
aaagacagaccgacagacagacagacagctggcaagaggcagcctgggggccacagctgcttcaggccctgtctttcaggcagacctcatggctgagtgagcctcccctgggcccagcaccccacctcagcatggtccaagcccatggggggcgctccagagcacagccgttgaccttgtctttgggggcagccatgacccagcctccgcctgaaaaaacgccagccaagaagcatgtgcgactgcaggagaggcggggctccaatgtggctctgatgctggacgttcggtccctgggggccgtagaacccatctgctctgtgaacacaccccgggaggtcaccctacactttctgcgcactgctggacacccccttacccgctgggcccttcagcgccagccacccagccccaagcaactggaagaagaattcttgaagatcccttcaaactttgtcagccccgaagacctggacatccctggccacgcctccaaggaccgatacaagaccatcttgccaaatccccagagccgtgtctgtctaggccgg

SEQ ID NO: 171705 - DNA, 560 bp, Homo sapiens
  Payload ID: 13753
  Gene Symbol: PTPN7
  Gene Name: protein tyrosine phosphatase, non-receptor type 7
  ENST ID: ENST00000492451
  CDS Start-End: 255-560
acaaggtaaaaggaggcgtgcagcgagcatgaaccggctgggctgctggcccgcaaggagcctgccaaggtcaggcaggggcagtgggcagaggagtcttggacttgggggccacccttcaggtcccaggcatccaggcaccccagcagcgaagaggacatgggagtcccctggtgtgagggccagagactgtccactgtctgcagacctcatggctgagtgagcctcccctgggcccagcaccccacctcagcatggtccaagcccatggggggcgctccagagcacagccgttgaccttgtctttgggggcagccatgacccagcctccgcctgaaaaaacgccagccaagaagcatgtgcgactgcaggagaggcggggctccaatgtggctctgatgctggacgttcggtccctgggggccgtagaacccatctgctctgtgaacacaccccgggaggtcaccctacactttctgcgcactgctggacacccccttacccgctgggcccttcagcgccagccacccagccccaagcaactggaagaagaattcttg

SEQ ID NO: 171706 - DNA, 673 bp, Homo sapiens
  Payload ID: 13753
  Gene Symbol: PTPN7
  Gene Name: protein tyrosine phosphatase, non-receptor type 7
  ENST ID: ENST00000477625
  CDS Start-End: 308-673
ggaggaagctggcttcctggagccttctcagccctcaaagacagaccgacagacagacagacagctggcaagaggcagcctgggggccacagctgcttcaaagatcccttcaaactttgtcagccccgaagacctggacatccctggccacgcctccaaggaccgatacaagaccatcttgccaaatccccagagccgtgtctgtctaggccgggcacagagccaggaggacggagattacatcaatgccaactacatccgaggctatgacgggaaggagaaggtctacattgccacccagggccccatgcccaacactgtgtcggacttctgggagatggtgtggcaagaggaagtgtccctcattgtcatgctcactcagctccgagagggcaaggagaaatgtgtccactactggcccacagaagaggaaacctatggacccttccagatccgcatccaggacatgaaagagtgcccagaatacactgtgcggcagctcaccatccagtaccaggaagagcgccggtcagtaaagcacatcctcttttcggcctggccagaccatcagacaccagaatcagctgggcccctgctgcgcctagtggcagaggtggaggagagcccggagacagccgcccaccccgggcctatcgtagtccactgcaggtgc

SEQ ID NO: 171707 - DNA, 1432 bp, Homo sapiens
  Payload ID: 13753
  Gene Symbol: PTPN7
  Gene Name: protein tyrosine phosphatase, non-receptor type 7
  ENST ID: ENST00000477554
  CDS Start-End: 1-1326
aaaaggaggcgtgcagcgagcatgaaccggctgggctgctggcccgcaaggagcctgccaaggtcaggcaggggcagtgggcagaggagtcttggacttgggggccacccttcaggtcccaggcatccaggcaccccagcagcgaagaggacatgggagtcccctggtgtgagggccagagactgtccactgtctacctcatggctgagtgagcctcccctgggcccagcaccccacctcagcatggtccaagcccatggggggcgctccagagcacagccgttgaccttgtctttgggggcagccatgacccagcctccgcctgaaaaaacgccagccaagaagcatgtgcgactgcaggagaggcggggctccaatgtggctctgatgctggacgttcggtccctgggggccgtagaacccatctgctctgtgaacacaccccgggaggtcaccctacactttctgcgcactgctggacacccccttacccgctgggcccttcagcgccagccacccagccccaagcaactggaagaagaattcttgaagatcccttcaaactttgtcagccccgaagacctggacatccctggccacgcctccaaggaccgatacaagaccatcttgccaaatccccagagccgtgtctgtctaggccgggcacagagccaggaggacggagattacatcaatgccaactacatccgaggctatgacgggaaggagaaggtctacattgccacccagggccccatgcccaacactgtgtcggacttctgggagatggtgtggcaagaggaagtgtccctcattgtcatgctcactcagctccgagagggcaaggagaaatgtgtccactactggcccacagaagaggaaacctatggacccttccagatccgcatccaggacatgaaagagtgcccagaatacactgtgcggcagctcaccatccagtaccaggaagagcgccggtcagtaaagcacatcctcttttcggcctggccagaccatcagacaccagaatcagctgggcccctgctgcgcctagtggcagaggtggaggagagcccggagacagccgcccaccccgggcctatcgtagtccactgcagtgcagggattggccggacgggctgcttcatcgccacgcgaattggctgtcaacagctgaaagcccgaggagaagtggacattctgggtattgtgtgccaactgcggctagacagaggggggatgatccagacggcagagcagtaccagttcctgcaccacactttggccctgtatgcaggccagctgcctgaggaacccagcccctgacccctgccaccctccggtggcccaggtgcctacctccctcaagcctgggaaggtgggtctggggaaagtgggccgagtgatctgggggtaccccttgggttggtgt

SEQ ID NO: 171708 - DNA, 577 bp, Homo sapiens
  Payload ID: 13753
  Gene Symbol: PTPN7
  Gene Name: protein tyrosine phosphatase, non-receptor type 7
  ENST ID: ENST00000467283
  CDS Start-End: 117-577
aaagacagaccgacagacagacagacagctggcaagaggcagcctgggggccacagctgcttcagcagacctcatggctgagtgagcctcccctgggcccagcaccccacctcagcatggtccaagcccatggggggcgctccagagcacagccgttgaccttgtctttgggggcagccatgacccagcctccgcctgaaaaaacgccagccaagaagcatgtgcgactgcaggagaggcggggctccaatgtggctctgatgctggacgttcggtccctgggggccgtagaacccatctgctctgtgaacacaccccgggaggtcaccctacactttctgcgcactgctggacacccccttacccgctgggcccttcagcgccagccacccagccccaagcaactggaagaagaattcttgatcccttcaaactttgtcagccccgaagacctggacatccctggccacgcctccaaggaccgatacaagaccatcttgccaaatccccagagccgtgtctgtctaggccgggcacagagccaggaggacggagattacatcaatgccaactacat

SEQ ID NO: 171709 - DNA, 1147 bp, Homo sapiens
  Payload ID: 13753
  Gene Symbol: PTPN7
  Gene Name: protein tyrosine phosphatase, non-receptor type 7
  ENST ID: ENST00000462815
  CDS Start-End: 117-467
aaagacagaccgacagacagacagacagctggcaagaggcagcctgggggccacagctgcttcagcagacctcatggctgagtgagcctcccctgggcccagcaccccacctcagcatggtccaagcccatggggggcgctccagagcacagccgttgaccttgtctttgggggcagccatgacccagcctccgcctgaaaaaacgccagccaagaagcatgtgcgactgcaggagaggcggggctccaatgtggctctgatgctggacgttcggtccctgggggccgtagaacccatctgctctgtgaacacaccccgggaggtcaccctacactttctgcgcactgctggacacccccttacccgctgggcccttcagcgccagccacccagccccaagcaactggaagaagaattcttgaagaggaaacctatggacccttccagatccgcatccaggacatgaaagagtgcccagaatacactgtgcggcagctcaccatccagtaccaggaagagcgccggtcagtaaagcacatcctcttttcggcctggccagaccatcagacaccagaatcagctgggcccctgctgcgcctagtggcagaggtggaggagagcccggagacagccgcccaccccgggcctatcgtagtccactgcagtgcagggattggccggacgggctgcttcatcgccacgcgaattggctgtcaacagctgaaagcccgaggagaagtggacattctgggtattgtgtgccaactgcggctagacagaggggggatgatccagacggcagagcagtaccagttcctgcaccacactttggccctgtatgcaggccagctgcctgaggaacccagcccctgacccctgccaccctccggtggcccaggaagcagcagcagtaaggacaaggggccggattccaggtcttcaacactggccactcctctgcttcctctgttggccccagatggacagtaaggggaacctccaatgtctctctgaacttaaagacaggagctggcatttatgacagacaaagaaagaagcccaggtgtcctggtgttctctgagacactctttgtgagcttcagtttcctgttctataacatgaacataagtgcttagctgccatga

SEQ ID NO: 171710 - DNA, 1463 bp, Homo sapiens
  Payload ID: 13753
  Gene Symbol: PTPN7
  Gene Name: protein tyrosine phosphatase, non-receptor type 7
  ENST ID: ENST00000496197
  CDS Start-End: 117-539
aaagacagaccgacagacagacagacagctggcaagaggcagcctgggggccacagctgcttcagcagacctcatggctgagtgagcctcccctgggcccagcaccccacctcagcatggtccaagcccatggggggcgctccagagcacagccgttgaccttgtctttgggggcagccatgacccagcctccgcctgaaaaaacgccagccaagaagcatgtgcgactgcaggagagaacccatctgctctgtgaacacaccccgggaggtcaccctacactttctgcgcactgctggacacccccttacccgctgggcccttcagcgccagccacccagccccaagcaactggaagaagaattcttgaagatcccttcaaactttgtcagccccgaagacctggacatccctggccacgcctccaaggaccgatacaagaccatcttgccaaatccccagagccgtgtctgtctaggccgggcacagagccaggaggacggagattacatcaatgccaactacatccgaggctatgacgggaaggagaaggtctacattgccacccagggccccatgcccaacactgtgtcggacttctgggagatggtgtggcaagaggaagtgtccctcattgtcatgctcactcagctccgagagggcaaggagaaatgtgtccactactggcccacagaagaggaaacctatggacccttccagatccgcatccaggacatgaaagagtgcccagaatacactgtgcggcagctcaccatccagtaccaggaagagcgccggtcagtaaagcacatcctcttttcggcctggccagaccatcagacaccagaatcagctgggcccctgctgcgcctagtggcagaggtggaggagagcccggagacagccgcccaccccgggcctatcgtagtccactgcagtgcagggattggccggacgggctgcttcatcgccacgcgaattggctgtcaacagctgaaagcccgaggagaagtggacattctgggtattgtgtgccaactgcggctagacagaggggggatgatccagacggcagagcagtaccagttcctgcaccacactttggccctgtatgcaggccagctgcctgaggaacccagcccctgacccctgccaccctccggtggcccaggtgcctacctccctcaagcctgggaaggtgggtctggggaaagtgggccgagtgatctgggggtaccccttgggttggtgtggggaaggagtgcctccttagtggtgcttgcagtcacaggaagcagcagcagtaaggacaaggggccggattccaggtcttcaacactggccactcctctgcttcctctgttggccccagatggacagtaaggggaacctccaatgtctctctgaacttaaagacaggagctggcatttatgacagacaaagaaagaagcccaggtgtcct

SEQ ID NO: 171711 - DNA, 1189 bp, Homo sapiens
  Payload ID: 13753
  Gene Symbol: PTPN7
  Gene Name: protein tyrosine phosphatase, non-receptor type 7
  ENST ID: ENST00000480836
  CDS Start-End: 124-354
agccctcaaagacagaccgacagacagacagacagctggcaagaggcagcctgggggccacagctgcttcagcagacctcatggctgagtgagcctcccctgggcccagcaccccacctcagcatggtccaagcccatggggggcgctccagagcacagccgttgaccttgtctttgggggcagccatgacccagcctccgcctgaaaaaacgccagccaagaagcatgtgcgactgcaggagagaagatcccttcaaactttgtcagccccgaagacctggacatccctggccacgcctccaaggaccgatacaagaccatcttgccaaatccccagagccgtgtctgtctaggccgggcacagagccaggaggacggagattacatcaatgccaactacatccgaggctatgacgggaaggagaaggtctacattgccacccagggccccatgcccaacactgtgtcggacttctgggagatggtgtggcaagaggaagtgtccctcattgtcatgctcactcagctccgagagggcaaggagaaatgtgtccactactggcccacagaagaggaaacctatggacccttccagatccgcatccaggacatgaaagagtgcccagaatacactgtgcggcagctcaccatccagtaccaggaagagcgccggtcagtaaagcacatcctcttttcggcctggccagaccatcagacaccagaatcagctgggcccctgctgcgcctagtggcagaggtggaggagagcccggagacagccgcccaccccgggcctatcgtagtccactgcagtgcagggattggccggacgggctgcttcatcgccacgcgaattggctgtcaacagctgaaagcccgaggagaagtggacattctgggtattgtgtgccaactgcggctagacagaggggggatgatccagacggcagagcagtaccagttcctgcaccacactttggccctgtatgcaggccagctgcctgaggaacccagcccctgacccctgccaccctccggtggcccaggtgcctacctccctcaagcctgggaaggtgggtctggggaaagtgggccgagtgatctgggggtaccccttgggttggtgtggggaaggagtgcctccttagtggtgcttgcagtcacaggaagcagcagcagtaaggacaa

SEQ ID NO: 171712 - DNA, 550 bp, Homo sapiens
  Payload ID: 13753
  Gene Symbol: PTPN7
  Gene Name: protein tyrosine phosphatase, non-receptor type 7
  ENST ID: ENST00000476061
  CDS Start-End: 61-550
agaccgacagacagacagacagctggcaagaggcagcctgggggccacagctgcttcaccatgacccagcctccgcctgaaaaaacgccagccaagaagcatgtgcgactgcaggagaggcggggctccaatgtggctctgatgctggacgttcggtccctgggggccgtagaacccatctgctctgtgaacacaccccgggaggtcaccctacactttctgcgcactgctggacacccccttacccgctgggcccttcagcgccagccacccagccccaagcaactggaagaagaattcttgaagatcccttcaaactttgtcagccccgaagacctggacatccctggccacgcctccaaggaccgatacaagaccatcttgccaaatccccagagccgtgtctgtctaggccgggcacagagccaggaggacggagattacatcaatgccaactacatccgaggctatgacgggaaggagaaggtctacattgccacccagggccccatgcccaacactgtgtcggacttctgggagatggtgtggc

SEQ ID NO: 171713 - DNA, 542 bp, Homo sapiens
  Payload ID: 13753
  Gene Symbol: PTPN7
  Gene Name: protein tyrosine phosphatase, non-receptor type 7
  ENST ID: ENST00000464870
  CDS Start-End: 79-542
aaagacagaccgacagacagacagacagctggcaagaggcagcctgggggccacagctgcttcacaccccacctcagcatggtccaagcccatggggggcgctccagagcacagccgttgaccttgtctttgggggcagccatgacccagcctccgcctgaaaaaacgccagccaagaagcatgtgcgactgcaggagaggcggggctccaatgtggctctgatgctggacgttcggtccctgggggccgtagaacccatctgctctgtgaacacaccccgggaggtcaccctacactttctgcgcactgctggacacccccttacccgctgggcccttcagcgccagccacccagccccaagcaactggaagaagaattcttgaagatcccttcaaactttgtcagccccgaagacctggacatccctggccacgcctccaaggaccgatacaagaccatcttgccaaatccccagagccgtgtctgtctaggccgggcacagagccaggaggacggagattacatcaatgccaactacat

SEQ ID NO: 171714 - DNA, 2689 bp, Homo sapiens
  Payload ID: 13753
  Gene Symbol: PTPN7
  Gene Name: protein tyrosine phosphatase, non-receptor type 7
  Uniprot ID: P35236
  ENST ID: ENST00000495688
  CDS Start-End: 103-1185
agacagacagacagctggcaagaggcagcctgggggccacagctgcttcagcagacctcatggctgagtgagcctcccctgggcccagcaccccacctcagcatggtccaagcccatggggggcgctccagagcacagccgttgaccttgtctttgggggcagccatgacccagcctccgcctgaaaaaacgccagccaagaagcatgtgcgactgcaggagaggcggggctccaatgtggctctgatgctggacgttcggtccctgggggccgtagaacccatctgctctgtgaacacaccccgggaggtcaccctacactttctgcgcactgctggacacccccttacccgctgggcccttcagcgccagccacccagccccaagcaactggaagaagaattcttgaagatcccttcaaactttgtcagccccgaagacctggacatccctggccacgcctccaaggaccgatacaagaccatcttgccaaatccccagagccgtgtctgtctaggccgggcacagagccaggaggacggagattacatcaatgccaactacatccgaggctatgacgggaaggagaaggtctacattgccacccagggccccatgcccaacactgtgtcggacttctgggagatggtgtggcaagaggaagtgtccctcattgtcatgctcactcagctccgagagggcaaggagaaatgtgtccactactggcccacagaagaggaaacctatggacccttccagatccgcatccaggacatgaaagagtgcccagaatacactgtgcggcagctcaccatccagtaccaggaagagcgccggtcagtaaagcacatcctcttttcggcctggccagaccatcagacaccagaatcagctgggcccctgctgcgcctagtggcagaggtggaggagagcccggagacagccgcccaccccgggcctatcgtagtccactgcagtgcagggattggccggacgggctgcttcatcgccacgcgaattggctgtcaacagctgaaagcccgaggagaagtggacattctgggtattgtgtgccaactgcggctagacagaggggggatgatccagacggcagagcagtaccagttcctgcaccacactttggccctgtatgcaggccagctgcctgaggaacccagcccctgacccctgccaccctccggtggcccaggtgcctacctccctcaagcctgggaagtcacaggaagcagcagcagtaaggacaaggggccggattccaggtcttcaacactggccactcctctgcttcctctgttggccccagatggacagtaaggggaacctccaatgtctctctgaacttaaagacaggagctggcatttatgacagacaaagaaagaagcccaggtgtcctggtgttctctgagacactctttgtgagcttcagtttcctgttctataacatgaacataagtgcttagctgccatgagggaaaagtaatgagagaagtttctagaagccactccagccactccttcctggggctgacaaaagggtgattccaagatcatccttcacccgaggtcctgcccaagcacaggccagatgcaagaatggggaaaagtctggtcctgatctccaagtctcaacatcctatcagtgactctgctccctgaccacacatcggaagggctggatgaccccaatcaaaagaaagaacaaggactctggttacccttgcctccacccatgtgtcataagagtaggctacagaggtgaccaggcctggcagttgaaatctctggaagagggaacatgtggggactactcagaggcaaagaggagctgctcctgcctccatggttgctggccactcccaccaactactcttagggaggctaagcagtctctgttttgcttccatggctcaaataataccctgggtatgcaggacccactataccttgcatttgctgagtacacctagagagcttggctgtttccaaaaacaatcagggtcataaccatccatgcagacatggaggctcggctgaaccaggactcctcactgtctacctgagagaatgagcacccctcatccatctcagcatcaacacaatttccaggggacctcaggtctacctcaggactgaacgccacacctcaggattcctcctccttgaatctgagactggctgcccattctgagatggggatgaaggtaagatgccgcatcaccaggcacgccgcccctgacagctgccttgataccagctctctgtggaaacccccgaggagttggatctggagaacagctgggcctcctcactcaggacttctctcctgaagaacacgcagtgctaaaactgaggatgatttccctaatgcttctgcttggccttatggaggagctgctccttccttacagccttggggatggacttgcccacacctccacctcccctgagccctgtgagaggcacgactgtctatgccaatgaggctcggtggggggctctcaagtgcctgatcctgccctgggctcagagccagcccagagggaagcaactgcacagccccacaggccctccctggcactgtccccccaaccccatctcagagctcagagggtacaagctccagaacagtaaccaagtgggaaaataaagacttcttggatgactgac

SEQ ID NO: 171715 - DNA, 437 bp, Homo sapiens
  Payload ID: 13753
  Gene Symbol: PTPN7
  Gene Name: protein tyrosine phosphatase, non-receptor type 7
  ENST ID: ENST00000629151
  CDS Start-End: 87-437
ggcaagaggcagcctgggggccacagctgcttcagcagacctcatggctgagtgagcctcccctgggcccagcaccccacctcagcatggtccaagcccatggggggcgctccagagcacagccgttgaccttgtctttgggggcagccatgacccagcctccgcctgaaaaaacgccagccaagaagcatgtgcgactgcaggagaggcggggctccaatgtggctctgatgctggacgttcggtccctgggggccgtagaacccatctgctctgtgaacacaccccgggaggtcaccctacactttctgcgcactgctggacacccccttacccgctgggcccttcagcgccagccacccagccccaagcaactggaagaagaattcttgaagaggaaacctatggacccttccagatccgcatccaggacatga

SEQ ID NO: 171716 - DNA, 3862 bp, Homo sapiens
  Payload ID: 13754
  Gene Symbol: PTPN9
  Gene Name: protein tyrosine phosphatase, non-receptor type 9
  ENST ID: ENST00000306726
  CDS Start-End: 469-2220
agcctggctgaggcagccgcgcaggtcgcagggccagcgtccgcgaggacggcccggctgggcggccccgagctctgtggcgctgtggaggagcgggagcgcggccgaggaagcggggcgccgagggggtcggcggccttcgggaaatttccgccgacccttcgctcccggctctaaaagttcctgatttcctatttccttttaaatcccgagtggctgttagctcttcgcctgcactttttcttccccaggagataagggggagtgtgaggaacggagcgaataatataaaaaaggatttcctcccggaagagagcggcagttcggagagatttttcttaaggaagcagaagcggcgtttgcggccgctgcaggcgccgggccctgccggccacactatgcgcgagccggccccgggctgctgaggcgcggggacgcggaagcggaggccgagcgcgccggcccgacatggcgccggagctgaccccggaggaggagcaggctaccaagcagtttctcgaagagattaacaagtggacagttcagtacaatgtttccccgctgtcttggaatgtggctgtcaagttcctcatggcaaggaagtttgatgtgctccgtgccatagaattgttccactcctacagagaaactcgaaggaaggaaggcattgtaaagctgaaacctcatgaggaacctcttcgttctgagatcctcagtggaaaattcaccatcttaaatgttcgggacccaacaggagcctccattgccctctttactgccaggttgcatcatccccacaagtcagtccaacatgtggtacttcaggctctgttttacttgctagacagagctgtggatagctttgaaactcagaggaatggactggtgtttatctatgacatgtgtggttctaattatgccaactttgagctggatcttggcaagaaagtcctaaacctgctgaagggagcatttccagctcgtttgaagaaggtgctgattgtgggggcacccatatggttccgagtgccctattccatcatcagtctcctcctgaaggacaaagtccgggagaggattcaaatattaaagacatctgaggtcacgcagcatctgcccagggagtgtcttccagaaaacctgggtgggtacgtcaaaattgatctcgccacttggaatttccagttcctaccccaggtgaacggccacccagatcccttcgatgagatcatcctgttctccctccctcctgccttagactgggactcagtacatgttccaggtccccatgctatgaccatccaagagttggtggactatgttaatgccaggcaaaagcaaggaatctatgaggaatatgaagacattcgtcgtgagaaccctgttggcactttccactgttccatgtctccaggaaacctagagaaaaaccgttatggggatgtaccctgcctggaccaaactagagtgaagctaacaaagcgaagtggccatactcagacagattacatcaatgccagtttcatggatggctacaagcagaagaatgcttacattggcacacaaggtcctttggagaatacctatcgtgatttctggctcatggtatgggagcaaaaagtcttggtgattgtcatgaccacccgctttgaggaaggcggcaggagaaagtgtggccagtactggcctttagaaaaagactctcggatccgatttggcttcctcacagtgaccaatctaggcgtggagaacatgaatcattataagaaaacaacgctagaaattcacaacacagaggaacggcagaaacgccaggtgacccacttccagttcttgagctggccagactatggtgtcccttcctcagcagcttccctcattgacttcttgagagtggtcagaaaccagcagagtctggctgtgagcaacatgggagcacgctccaaagggcagtgccctgagccacccattgtggtccattgcagtgcaggcattggcaggacaggtaccttctgctcactggacatctgcctggcacagctggaggagcttggcacccttaatgtgttccagacggtgtcacgcatgaggacccagagggccttcagcatccagacccctgagcagtactatttttgctacaaggccatcctggagttcgcagagaaggagggcatggtatcctctggccaaaacctgctggccgtggagagtcagtaactctcctacgaacctcctacctgttggccagccttccttaaactaccctggacaccgctgagcctataggttgccatcagttacgctgaagccatggatcaacttctttcttgtgtctcccagcacacgtgtgcacgcaaggcagcctttccctttggctagataaatgtggtgaaattgccactagaaagggccagtagcaatgtgttcttaattcctagcatctgctatcaaactgtgccttattaaaaccaaattgtggctattgatttttgctagggtccccgaggtaagtggggaaggaacctccctcctcctttctcccgccattctttttctgaggtctcctgtctcccactccttccctttcctaggattttatggggaggtttgatgagcatttgcctttctccccagagagcttgaccaagttacatattctagagatcgtcctgagtgccaagcacgtttataagtagggcgtgtattccagtcctttctgtcattctgtgtgtgtgtgtgtgtgcacttatgtgtatgggtccatatgtacgtgtgtatataatatatattgtatgtgataatatgatcgtattctataaatacatatacacacgatactcctttccagaagttcctggggctccgtgttgcagttcaggactccttgcttcttggaccctactatttatcctggactagcttgggttggtgatcatgtctcctcttgtcaggctacagagtggtggaagaggacacacacacatctcctccatgttcctgccacagggccccttccttaagtaatgacttatctccttccagttgccacctgttggagccaagaatgtattagtttgtggtgacactgggttagctcagcatggatttcccttatccgatgatttttctacatttacttggccaatttggggaacagacctccactgtgattccatactctctctttgctttcactatcccagggatgggaggcggagggtagagatgaactcactgagcagccagagccaaatgcaatcggtacgaatcttagaaggaaggagggggagcccaggtatgagaaagaaaaaaccactaagaaaatacctccctgggaggatgagctggggccctttttcttttgctggatggttcctttatgcagcttggccctgtctaccgagatgcccatctcttcctgcctgctagcctgctagaccctcaaactgggtgggttctgtgtcaataaaaagcttcaccccctggctgagtgaggtggtcccctgcaatcactgtttgtcccctacccacccaacctgtccctgcctgctcccagcccactcatccttatgtgctagggataaatcaagagtcctcagcactccacattcccaaaaaatcccaggaactcctaaaccttcccctgtgacagaagatgaggttggcagctgatcagacctcaataattttatactgtaataagctctttgaatgtgtatattattattttttacaatcatttcattttgtatttaatatcaatggactgagtctgattcagaaaataattgtaatgttcatattcaatatcttacagtgatacagttttgtatttacatataaatataccgacatgatc

SEQ ID NO: 171717 - DNA, 545 bp, Homo sapiens
  Payload ID: 13754
  Gene Symbol: PTPN9
  Gene Name: protein tyrosine phosphatase, non-receptor type 9
  ENST ID: ENST00000561731
  CDS Start-End: 1-525
gtaaagctgaaacctcatgaggaacctcttcgttctgagatcctcagtggaaaattcaccatcttaaatgttcgggacccaacaggagcctccattgccctctttactgccaggttgcatcatccccacaagtcagtccaacatgtggtacttcaggctctgttttacttgctagacagagctgtggatagctttgaaactcagaggaatggactggtgtttatctatgacatgtgtggttctaattatgccaactttgagctggatcttggcaagaaagtcctaaacctgctgaagttaccctttagttctactgatttggagaaaccccagcactcctctatggagaatatacagcatctagaacaaacttctccaaaggcctcttcactgaagtgtgataaactactttcatcttttccttcaaagatgcaacaatttatttcaggacctaaatgtccaaggtccttttaccagcaaatcaaaaaccattctaggaaaacacctgttatttccacaaaatgataaataaaaagtagaagcta

SEQ ID NO: 171718 - DNA, 7813 bp, Homo sapiens
  Payload ID: 13754
  Gene Symbol: PTPN9
  Gene Name: protein tyrosine phosphatase, non-receptor type 9
  Uniprot ID: P43378
  ENST ID: ENST00000618819
  CDS Start-End: 514-2295
agcctggctgaggcagccgcgcaggtcgcagggccagcgtccgcgaggacggcccggctgggcggccccgagctctgtggcgctgtggaggagcgggagcgcggccgaggaagcggggcgccgagggggtcggcggccttcgggaaatttccgccgacccttcgctcccggctctaaaagttcctgatttcctatttccttttaaatcccgagtggctgttagctcttcgcctgcactttttcttccccaggagataagggggagtgtgaggaacggagcgaataatataaaaaaggatttcctcccggaagagagcggcagttcggagagatttttcttaaggaagcagaagcggcgtttgcggccgctgcaggcgccgggccctgccggccacactatgcgcgagccggccccgggctgctgaggcgcggggacgcggaagcggaggccgagcgcgccgggctcccgcgctcgcgagcgagttttgtccgcccggcggcggtggcggggggatggagcccgcgaccgcgccccggcccgacatggcgccggagctgaccccggaggaggagcaggctaccaagcagtttctcgaagagattaacaagtggacagttcagtacaatgtttccccgctgtcttggaatgtggctgtcaagttcctcatggcaaggaagtttgatgtgctccgtgccatagaattgttccactcctacagagaaactcgaaggaaggaaggcattgtaaagctgaaacctcatgaggaacctcttcgttctgagatcctcagtggaaaattcaccatcttaaatgttcgggacccaacaggagcctccattgccctctttactgccaggttgcatcatccccacaagtcagtccaacatgtggtacttcaggctctgttttacttgctagacagagctgtggatagctttgaaactcagaggaatggactggtgtttatctatgacatgtgtggttctaattatgccaactttgagctggatcttggcaagaaagtcctaaacctgctgaagggagcatttccagctcgtttgaagaaggtgctgattgtgggggcacccatatggttccgagtgccctattccatcatcagtctcctcctgaaggacaaagtccgggagaggattcaaatattaaagacatctgaggtcacgcagcatctgcccagggagtgtcttccagaaaacctgggtgggtacgtcaaaattgatctcgccacttggaatttccagttcctaccccaggtgaacggccacccagatcccttcgatgagatcatcctgttctccctccctcctgccttagactgggactcagtacatgttccaggtccccatgctatgaccatccaagagttggtggactatgttaatgccaggcaaaagcaaggaatctatgaggaatatgaagacattcgtcgtgagaaccctgttggcactttccactgttccatgtctccaggaaacctagagaaaaaccgttatggggatgtaccctgcctggaccaaactagagtgaagctaacaaagcgaagtggccatactcagacagattacatcaatgccagtttcatggatggctacaagcagaagaatgcttacattggcacacaaggtcctttggagaatacctatcgtgatttctggctcatggtatgggagcaaaaagtcttggtgattgtcatgaccacccgctttgaggaaggcggcaggagaaagtgtggccagtactggcctttagaaaaagactctcggatccgatttggcttcctcacagtgaccaatctaggcgtggagaacatgaatcattataagaaaacaacgctagaaattcacaacacagaggaacggcagaaacgccaggtgacccacttccagttcttgagctggccagactatggtgtcccttcctcagcagcttccctcattgacttcttgagagtggtcagaaaccagcagagtctggctgtgagcaacatgggagcacgctccaaagggcagtgccctgagccacccattgtggtccattgcagtgcaggcattggcaggacaggtaccttctgctcactggacatctgcctggcacagctggaggagcttggcacccttaatgtgttccagacggtgtcacgcatgaggacccagagggccttcagcatccagacccctgagcagtactatttttgctacaaggccatcctggagttcgcagagaaggagggcatggtatcctctggccaaaacctgctggccgtggagagtcagtaactctcctacgaacctcctacctgttggccagccttccttaaactaccctggacaccgctgagcctataggttgccatcagttacgctgaagccatggatcaacttctttcttgtgtctcccagcacacgtgtgcacgcaaggcagcctttccctttggctagataaatgtggtgaaattgccactagaaagggccagtagcaatgtgttcttaattcctagcatctgctatcaaactgtgccttattaaaaccaaattgtggctattgatttttgctagggtccccgaggtaagtggggaaggaacctccctcctcctttctcccgccattctttttctgaggtctcctgtctcccactccttccctttcctaggattttatggggaggtttgatgagcatttgcctttctccccagagagcttgaccaagttacatattctagagatcgtcctgagtgccaagcacgtttataagtagggcgtgtattccagtcctttctgtcattctgtgtgtgtgtgtgtgtgcacttatgtgtatgggtccatatgtacgtgtgtatataatatatattgtatgtgataatatgatcgtattctataaatacatatacacacgatactcctttccagaagttcctggggctccgtgttgcagttcaggactccttgcttcttggaccctactatttatcctggactagcttgggttggtgatcatgtctcctcttgtcaggctacagagtggtggaagaggacacacacacatctcctccatgttcctgccacagggccccttccttaagtaatgacttatctccttccagttgccacctgttggagccaagaatgtattagtttgtggtgacactgggttagctcagcatggatttcccttatccgatgatttttctacatttacttggccaatttggggaacagacctccactgtgattccatactctctctttgctttcactatcccagggatgggaggcggagggtagagatgaactcactgagcagccagagccaaatgcaatcggtacgaatcttagaaggaaggagggggagcccaggtatgagaaagaaaaaaccactaagaaaatacctccctgggaggatgagctggggccctttttcttttgctggatggttcctttatgcagcttggccctgtctaccgagatgcccatctcttcctgcctgctagcctgctagaccctcaaactgggtgggttctgtgtcaataaaaagcttcaccccctggctgagtgaggtggtcccctgcaatcactgtttgtcccctacccacccaacctgtccctgcctgctcccagcccactcatccttatgtgctagggataaatcaagagtcctcagcactccacattcccaaaaaatcccaggaactcctaaaccttcccctgtgacagaagatgaggttggcagctgatcagacctcaataattttatactgtaataagctctttgaatgtgtatattattattttttacaatcatttcattttgtatttaatatcaatggactgagtctgattcagaaaataattgtaatgttcatattcaatatcttacagtgatacagttttgtatttacatataaatataccgacatgatcaaaacccttttagcttcatcaatttagcagcctgggacatgagggagggggtccaggagctggtctgggagggatgagggaggcagggagggacccaagccttcagtatctgagactttgagttctgacactatgagttcaccttgtctgtaggccatggccctatctctggacagagggaccagcaccagttcagtgcttgagatgtgctaagcactatgctaggtgcttttcccccaccctgcctcattcaaacctcacaacaattcagtgagatattatcttctctcccttctcctgtgcacccctttctcatttctatatagatgaggaaggtgaggtccagagggttacagtgatttgctctaaaacgagctcaagttggtctgcttacaaagcctgtggtctcttcactgcatggaagatggagatcttgtgtttggagaacagaggtttgtttagctctcctttcagagtaaaaaaagttcttaaattccaggttgttgttcttgtgcccatgcttcatgtagtagacgcgaagggtgacagggttggtgactgactgtcctagctaggacctcctgatgtagggtcctcatgtctgcagcgtaccaaaggggttatcattctccccaggagactccatatctatgggtacatggtctttgtgagaagatcttgagtcatttgcatttatctcttagaaagaaaggaaccagaagctttgtacatggaagaccactccccatatcatacctgttggctgttgatggcctgcccagttggggcagttgtggctgggaaatattggggtgttcttaataatagtcatagcagccaatttactggatgctcactctattccaggcactgttcagagtaatttctaggtatcatctcattcaccctcaacaaccttttgaggtaggtattgacagaagaaaaaaattgagagacaggaatgttaatttgctacagccaggatcccagaccatctgactccaaagtatcttctttcacctcttacactagacttcctctaaggatccatcttctgatctgccaataaatttttatcgagtttcttaccataatcaggagctcaagtgtagagcagaagattaatctagttccttctccagatgagcctccattctcttgggagtgcacaaacataagaagtgaacagagattcttggaaatctgagaaaccagagaggtcaggggtttggtggaacatgtaagaaatgggattaatgataaacggcctggaggaggtaactttaaattgtcatttatttgaagaggctgtaacccgactgccctgtgaatttaaggttatgcatgagttcctcattgcatatctgaagactggtgaggttatctatcacttcagctccataaaatgctgatttctgggcccatccagtaggttgttagtgagtgacaggattatccaggtttgggaaccatagatttagttcatgtttctgaccctatagagagttaacaaattgatgtctcctaaattttcagtaaaactcagaggaactcctcccactgccattgtttgtagcttttaccagcgtgaacctacctgtgttaggtgttaaaggaggaggtaaaggaaagggaaggcagagacgcaacccagaatctgtttggcaagtcagggttctcatacaggagacttagtgaacaaagcaagagaaaatgctcagggtccaagtgcagtggctttatgcctgtaatcccagtactttggaaggccgaggtgggcagatcacctgaggtcaggagtttgagaccagcctgaccaatatgatgaaaccccatctctactaaaaatataaaaattacccgggtgtggtggtatgtgcttgtaatcccagctactcgggaggctgaaatgggagaatcacttgaatctgggaggcagaggttgcaatgagccgagatcgcgccattgcactctagcctgggcaacaagagtaaaactccatctcaaaaaaaataaataaataaaaaagaaagacagtgttcaggaaagaagaaaacactgagctaaagcaggcttctgcttctgatttgatggctgtttgtttcacctttctctaacattcccatgctatataatttttcaaacatgagataatccctgtgtcctttttcccattgctcccttcatcttgcccatcctcattggctaggatgggactcctgagacgaagggtgccccagcatcctcagcctcggaggcccacccttatcagtcttcatgtgacagtatgcaggtaaatgacagagtaggacttgttcttgggagaatggactatttagcatcatagccctagggaaatttggttccttccctgaaaggaatgcttcctgtctcttgggacagacagacacacatacaaaaacttttataaatcagagacctagagggaattgggccaagaggcattggccaagtagaaaagcttctctagagtgacccagctcttttgtggttttgaggtcttaccactgaaccaaacccaagtcctaggttccctctgtaaaagaaggggctacactagatgatcctaccatgggtcctctgactgtcagggtccagttctttgttagacagtgcaaacacccatagaggagctattaggcctttacttgggttgagttggctcccactagcactccccacttttcattttttttactttcagagacagagtctcactctgttgcctaggttagaggggagtggcatgatcatggctcactgcagtctcaacaactgggctcaagcaggaacccagctttttttttttttctctctctctctctagagacaggatctcactatgttgcccaggctggtctcgaactccagcctcaagcaatcctcctgcctcggcctcccaaagtgagaggattacaggcatgggccaccacacccagcctctccagttttagtgtgttttcagagtctcttctttcaagctgctgctacttccctagcttccctcagttctcttcccccttggccttccaattggaggaaaagcaggtcaggtctctgtcatctccaagaccagcctataggcctttaaagtttccctgtttcttaatgtggggtctacagggtttctcagaggcaaagcatgaacagaccaagggtcctatagctcccaacctagtccttagatttctctctggccttggttactcccacaaaccactgtgagcctaccaagggcaggaatggaaatgcccatcagcctgggaaccatctttttctcttaggaggtatccgccctatagttacctttacacaacacttgtgaatatcaagtgttctagactgcactgttcataattgactacagagaagactaggatcttctccacaaatagaaatatatcacttttacttggagatgttttcttgggggaaaaaaaatctagcaccttgaaacctgttacaatgtttaaatctcccttctttaccttggctgtcataaaatcctcctgtttgagctaaatgtggcctgctgaagtcttaaatgcccatatttttcaggctaaggccatggtggacatagctaactccactagaatcctagctgggggtgttggaaaaaacggtacagtgcccctctcagactccaggctcacgtccgtctcccctccccgcacattataatctactacttctctaatgctgctgcgtagtttgtcttaaagcctcaagactggccagatgtgcacctgagtaaaggtcagccatttcatctgggggctctttcttgacttttaatgaattttcttctgtgaaaaaatgtatttttaataaaaaattttctgtggccagca

SEQ ID NO: 171719 - DNA, 3725 bp, Homo sapiens
  Payload ID: 13755
  Gene Symbol: PTPRA
  Gene Name: protein tyrosine phosphatase, receptor type, A
  Uniprot ID: P18433
  ENST ID: ENST00000216877
  CDS Start-End: 401-2782
agcgaggctgcggcgagtgcggcgctgacagagacgcgcgcgcgcgcgatcgcgctcggaccccggccgctgccgccatcactgtcgcccgcccagtcgcccctcagccgcttcccctcgccatggaggcgaggccgccgccgccgccgcggggctcggagccgcgggccgggcggcggccctgagggctagtggcggcccgaaacgccgccgcggagccgaggcggagccgctgtcctcgtccccagcggtcccgcccaacgcccgactctgtgacacaactaaaaaaaaacaaaggtatttatggaattccactgagtggtaatggatgatgcagttcaaataactaaggacacatgttcaaagagcataattaactttttaaaagaagctaataagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcagatgagacaccaattattgcggtgatggtggccctgtcctctctgctagtgatcgtgtttattatcatagttttgtacatgttaaggtttaagaaatacaagcaagctgggagccattccaattctttccgcttatccaacggccgcactgaggatgtggagccccagagtgtgccacttctggccagatccccaagcaccaacaggaaatacccacccctgcccgtggacaagctggaagaggaaattaaccggagaatggcagacgacaataagctcttcagggaggaattcaacgctctccctgcatgtcctatccaggccacctgtgaggctgcttccaaggaggaaaacaaggaaaaaaatcgatatgtaaacatcttgccttatgaccactctagagtccacctgacaccggttgaaggggttccagattctgattacatcaatgcttcattcatcaacggctaccaagaaaagaacaaattcattgctgcacaaggaccaaaagaagaaacggtgaatgatttctggcggatgatctgggaacaaaacacagccaccatcgtcatggttaccaacctgaaggagagaaaggagtgcaagtgcgcccagtactggccagaccaaggctgctggacctatgggaatattcgggtgtctgtagaggatgtgactgtcctggtggactacacagtacggaagttctgcatccagcaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatatgcagtatgtcttcatataccaagcccttctggagcattatctctatggagatacagaactggaagtgacctctctagaaacccacctgcagaaaatttacaacaaaatcccagggaccagcaacaatggattagaggaggagtttaagaagttaacatcaatcaaaatccagaatgacaagatgcggactggaaaccttccagccaacatgaagaagaaccgtgttttacagatcattccatatgaattcaacagagtgatcattccagttaagcggggcgaagagaatacagactatgtgaacgcatcctttattgatggctaccggcagaaggactcctatatcgccagccagggccctcttctccacacaattgaggacttctggcgaatgatctgggagtggaaatcctgctctatcgtgatgctaacagaactggaggagagaggccaggagaagtgtgcccagtactggccatctgatggactggtgtcctatggagatattacagtggaactgaagaaggaggaggaatgtgagagctacaccgtccgagacctcctggtcaccaacaccagggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcagcgccggggcaggaaggacggggaccttctgtgccctgagcaccgtcctggagcgtgtgaaagcagaggggattttggatgtcttccagactgtcaagagcctgcggctacagaggccacacatggtccagacactggaacagtatgagttctgctacaaggtggtgcaggagtatattgatgcattctcagattatgccaacttcaagtaagcggcaacaagggtccgtggaccaggaggattgcctttaatattttgtaatattctgttttgttaatataccccaaattgtgtatatatcttataactgttttagaaattggtacataggcttctattacctattaggtggaaattttatatgtaaatgtgttagcactgatagtcctttttccaatgttttattggggaattaaatagtgtgatgtttggattgatatcgtgaaatcctcagccgagaaattgggctggattgtgctttggttaatacatctttccctaaagaagataaacacaaaatccattccaggtagctcggcaccaactaagaaaaaaagcacaaagttctcagagctctcgaggaaagtggttgtccccgtaccaccatgcactgtaaatatccctcccctctctccctggtcccctcccccatccccaccactgatatcatggggagtaataggaccagagcggtatctctggcaccacactagggactatcaggtaataaaagctttgactccctgaggaaatgtctctccctttgtctgggggtggggcagccatacaggctggggctctcctcggctgttcatggccctcctgttgctgttctctctgagttatctgagagaggccacagtcccccagctcctcctgtccaccaaacacagcccttccagttcttaggtgatctccaggaccctcctttcattcccagcacatctttggtttagtggtcctggccagcctccctccctaggaaggtggccaggtcctcactgagtctccttaaggacaggggcacaggggagactagagctggctcagctttgggctgaggccagtctgacctctccagtctgtggtgctttgctacaaaactgtctggattgtgtcaccctatctaggataaatctttatgtccacatata

SEQ ID NO: 171720 - DNA, 3219 bp, Homo sapiens
  Payload ID: 13755
  Gene Symbol: PTPRA
  Gene Name: protein tyrosine phosphatase, receptor type, A
  Uniprot ID: P18433
  ENST ID: ENST00000318266
  CDS Start-End: 297-2678
gcggcccgaaacgccgccgcggagccgaggcggagccgctgtcctcgtccccagcggtcccgcccaacgcccgactctgtgacacaactaaaaaaaaacaaaggtatttatggaattccactgagtggtaatggatgatgcagttcaaataactaaggacacatgttcaaagagcataattaactttttaaaagaagctagacttcttcagaagcttgccagtttttcaagctgatttctctcactggcaactcttcagagtgctgttcctactccaccctcccctggtgataagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcagatgagacaccaattattgcggtgatggtggccctgtcctctctgctagtgatcgtgtttattatcatagttttgtacatgttaaggtttaagaaatacaagcaagctgggagccattccaattctttccgcttatccaacggccgcactgaggatgtggagccccagagtgtgccacttctggccagatccccaagcaccaacaggaaatacccacccctgcccgtggacaagctggaagaggaaattaaccggagaatggcagacgacaataagctcttcagggaggaattcaacgctctccctgcatgtcctatccaggccacctgtgaggctgcttccaaggaggaaaacaaggaaaaaaatcgatatgtaaacatcttgccttatgaccactctagagtccacctgacaccggttgaaggggttccagattctgattacatcaatgcttcattcatcaacggctaccaagaaaagaacaaattcattgctgcacaaggaccaaaagaagaaacggtgaatgatttctggcggatgatctgggaacaaaacacagccaccatcgtcatggttaccaacctgaaggagagaaaggagtgcaagtgcgcccagtactggccagaccaaggctgctggacctatgggaatattcgggtgtctgtagaggatgtgactgtcctggtggactacacagtacggaagttctgcatccagcaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatatgcagtatgtcttcatataccaagcccttctggagcattatctctatggagatacagaactggaagtgacctctctagaaacccacctgcagaaaatttacaacaaaatcccagggaccagcaacaatggattagaggaggagtttaagaagttaacatcaatcaaaatccagaatgacaagatgcggactggaaaccttccagccaacatgaagaagaaccgtgttttacagatcattccatatgaattcaacagagtgatcattccagttaagcggggcgaagagaatacagactatgtgaacgcatcctttattgatggctaccggcagaaggactcctatatcgccagccagggccctcttctccacacaattgaggacttctggcgaatgatctgggagtggaaatcctgctctatcgtgatgctaacagaactggaggagagaggccaggagaagtgtgcccagtactggccatctgatggactggtgtcctatggagatattacagtggaactgaagaaggaggaggaatgtgagagctacaccgtccgagacctcctggtcaccaacaccagggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcagcgccggggcaggaaggacggggaccttctgtgccctgagcaccgtcctggagcgtgtgaaagcagaggggattttggatgtcttccagactgtcaagagcctgcggctacagaggccacacatggtccagacactggaacagtatgagttctgctacaaggtggtgcaggagtatattgatgcattctcagattatgccaacttcaagtaagcggcaacaagggtccgtggaccaggaggattgcctttaatattttgtaatattctgttttgttaatataccccaaattgtgtatatatcttataactgttttagaaattggtacataggcttctattacctattaggtggaaattttatatgtaaatgtgttagcactgatagtcctttttccaatgttttattggggaattaaatagtgtgatgtttggattgatatcgtgaaatcctcagccgagaaattgggctggattgtgctttggttaatacatctttccctaaagaagataaacacaaaatccattccaggtagctcggcaccaactaagaaaaaaagcacaaagttctcagagctctcgaggaaagtggttgtccccgtaccaccatgcactgtaaatatccctcccctctctccctggtcccctcccccatccccaccactgatatcatggggagtaataggaccagagcggtatctctggcaccacactagggactatcaggtaataaaagctttgactccctgaggaaa

SEQ ID NO: 171721 - DNA, 3135 bp, Homo sapiens
  Payload ID: 13755
  Gene Symbol: PTPRA
  Gene Name: protein tyrosine phosphatase, receptor type, A
  Uniprot ID: P18433
  ENST ID: ENST00000356147
  CDS Start-End: 219-2600
gtgacacaactaaaaaaaaacaaaggtatttatggaattccactgagtggtaatggatgatgcagttcaaataactaaggacacatgttcaaagagcataattaactttttaaaagaagctagacttcttcagaagcttgccagtttttcaagctgatttctctcactggcaactcttcagagtgctgttcctactccaccctcccctggtgataagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcagatgagacaccaattattgcggtgatggtggccctgtcctctctgctagtgatcgtgtttattatcatagttttgtacatgttaaggtttaagaaatacaagcaagctgggagccattccaattctttccgcttatccaacggccgcactgaggatgtggagccccagagtgtgccacttctggccagatccccaagcaccaacaggaaatacccacccctgcccgtggacaagctggaagaggaaattaaccggagaatggcagacgacaataagctcttcagggaggaattcaacgctctccctgcatgtcctatccaggccacctgtgaggctgcttccaaggaggaaaacaaggaaaaaaatcgatatgtaaacatcttgccttatgaccactctagagtccacctgacaccggttgaaggggttccagattctgattacatcaatgcttcattcatcaacggctaccaagaaaagaacaaattcattgctgcacaaggaccaaaagaagaaacggtgaatgatttctggcggatgatctgggaacaaaacacagccaccatcgtcatggttaccaacctgaaggagagaaaggagtgcaagtgcgcccagtactggccagaccaaggctgctggacctatgggaatattcgggtgtctgtagaggatgtgactgtcctggtggactacacagtacggaagttctgcatccagcaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatatgcagtatgtcttcatataccaagcccttctggagcattatctctatggagatacagaactggaagtgacctctctagaaacccacctgcagaaaatttacaacaaaatcccagggaccagcaacaatggattagaggaggagtttaagaagttaacatcaatcaaaatccagaatgacaagatgcggactggaaaccttccagccaacatgaagaagaaccgtgttttacagatcattccatatgaattcaacagagtgatcattccagttaagcggggcgaagagaatacagactatgtgaacgcatcctttattgatggctaccggcagaaggactcctatatcgccagccagggccctcttctccacacaattgaggacttctggcgaatgatctgggagtggaaatcctgctctatcgtgatgctaacagaactggaggagagaggccaggagaagtgtgcccagtactggccatctgatggactggtgtcctatggagatattacagtggaactgaagaaggaggaggaatgtgagagctacaccgtccgagacctcctggtcaccaacaccagggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcagcgccggggcaggaaggacggggaccttctgtgccctgagcaccgtcctggagcgtgtgaaagcagaggggattttggatgtcttccagactgtcaagagcctgcggctacagaggccacacatggtccagacactggaacagtatgagttctgctacaaggtggtgcaggagtatattgatgcattctcagattatgccaacttcaagtaagcggcaacaagggtccgtggaccaggaggattgcctttaatattttgtaatattctgttttgttaatataccccaaattgtgtatatatcttataactgttttagaaattggtacataggcttctattacctattaggtggaaattttatatgtaaatgtgttagcactgatagtcctttttccaatgttttattggggaattaaatagtgtgatgtttggattgatatcgtgaaatcctcagccgagaaattgggctggattgtgctttggttaatacatctttccctaaagaagataaacacaaaatccattccaggtagctcggcaccaactaagaaaaaaagcacaaagttctcagagctctcgaggaaagtggttgtccccgtaccaccatgcactgtaaatatccctcccctctctccctggtcccctcccccatccccaccactgatatcatggggagtaataggaccagagcggtatctctggcaccacactagggactatcaggtaataaaagctttgactccctg

SEQ ID NO: 171722 - DNA, 3636 bp, Homo sapiens
  Payload ID: 13755
  Gene Symbol: PTPRA
  Gene Name: protein tyrosine phosphatase, receptor type, A
  Uniprot ID: P18433
  ENST ID: ENST00000380393
  CDS Start-End: 687-3095
ggagtatgagccacgctcaggggagcaggtaccccttctcctaaagatgaagaggagcaaactggcactaagcaaggccatcgagagcggggacactgacctggtgttcacggtgttgctgcacctgaagaacgagctgaaccgaggagattttttcatgacccttcggaatcagcccatggccctcagtttgtaccgacagttctgtaagcatcaggagctagagacgctgaaggacctttacaatcaggatgacaatcaccaggaattgggcagcttccacatccgagccagctatgctgcagaagagcgtattgaggggcgagtagcagctctgcagacagccgccgatgccttctacaaggccaagaatgagtttgcagccaaggctacagaggatcaaatgcggctcctacggctgcagcggcgcctagaagacgagctggggggccagttcctagacctgtctctacatgacacagttaccaccctcattcttggcggtcacaacaagcgtgcagagcagctggcacgtgacttccgcatccctgacaagaggtgacacaactaaaaaaaaacaaaggtatttatggaattccactgagtggtaatggatgatgcagttcaaataactaaggacacatgttcaaagagcataattaactttttaaaagaagctaataagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcaggtaattctgactcgaaggacagaagagatgagacaccaattattgcggtgatggtggccctgtcctctctgctagtgatcgtgtttattatcatagttttgtacatgttaaggtttaagaaatacaagcaagctgggagccattccaattctttccgcttatccaacggccgcactgaggatgtggagccccagagtgtgccacttctggccagatccccaagcaccaacaggaaatacccacccctgcccgtggacaagctggaagaggaaattaaccggagaatggcagacgacaataagctcttcagggaggaattcaacgctctccctgcatgtcctatccaggccacctgtgaggctgcttccaaggaggaaaacaaggaaaaaaatcgatatgtaaacatcttgccttatgaccactctagagtccacctgacaccggttgaaggggttccagattctgattacatcaatgcttcattcatcaacggctaccaagaaaagaacaaattcattgctgcacaaggaccaaaagaagaaacggtgaatgatttctggcggatgatctgggaacaaaacacagccaccatcgtcatggttaccaacctgaaggagagaaaggagtgcaagtgcgcccagtactggccagaccaaggctgctggacctatgggaatattcgggtgtctgtagaggatgtgactgtcctggtggactacacagtacggaagttctgcatccagcaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatatgcagtatgtcttcatataccaagcccttctggagcattatctctatggagatacagaactggaagtgacctctctagaaacccacctgcagaaaatttacaacaaaatcccagggaccagcaacaatggattagaggaggagtttaagaagttaacatcaatcaaaatccagaatgacaagatgcggactggaaaccttccagccaacatgaagaagaaccgtgttttacagatcattccatatgaattcaacagagtgatcattccagttaagcggggcgaagagaatacagactatgtgaacgcatcctttattgatggctaccggcagaaggactcctatatcgccagccagggccctcttctccacacaattgaggacttctggcgaatgatctgggagtggaaatcctgctctatcgtgatgctaacagaactggaggagagaggccaggagaagtgtgcccagtactggccatctgatggactggtgtcctatggagatattacagtggaactgaagaaggaggaggaatgtgagagctacaccgtccgagacctcctggtcaccaacaccagggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcagcgccggggcaggaaggacggggaccttctgtgccctgagcaccgtcctggagcgtgtgaaagcagaggggattttggatgtcttccagactgtcaagagcctgcggctacagaggccacacatggtccagacactggaacagtatgagttctgctacaaggtggtgcaggagtatattgatgcattctcagattatgccaacttcaagtaagcggcaacaagggtccgtggaccaggaggattgcctttaatattttgtaatattctgttttgttaatataccccaaattgtgtatatatcttataactgttttagaaattggtacataggcttctattacctattaggtggaaattttatatgtaaatgtgttagcactgatagtcctttttccaatgttttattggggaattaaatagtgtgatgtttggattgatatcgtgaaatcctcagccgagaaattgggctggattgtgctttggttaatacatctttccctaaagaagataaacacaaaatccattccaggtagctcggcaccaactaagaaaaaaagcacaaagttctcagagctctcgaggaaagtggttgtccccgtaccaccatgcactgtaaatatccctcccctctctccctggtcccctcccccatccccaccactgatatcatggggagtaataggaccagagcggtatctctggcaccacactagggactatcaggtaataaaagctttgactccctgaggaaa

SEQ ID NO: 171723 - DNA, 3337 bp, Homo sapiens
  Payload ID: 13755
  Gene Symbol: PTPRA
  Gene Name: protein tyrosine phosphatase, receptor type, A
  Uniprot ID: P18433
  ENST ID: ENST00000399903
  CDS Start-End: 394-2802
ctgcggcgagtgcggcgctgacagagacgcgcgcgcgcgcgatcgcgctcggaccccggccgctgccgccatcactgtcgcccgcccagtcgcccctcagccgcttcccctcgccatggaggcgaggccgccgccgccgccgcggggctcggagccgcgggccgggcggcggccctgagggctagtggcggcccgaaacgccgccgcggagccgaggcggagccgctgtcctcgtccccagcggtcccgcccaacgcccgactctgtgacacaactaaaaaaaaacaaaggtatttatggaattccactgagtggtaatggatgatgcagttcaaataactaaggacacatgttcaaagagcataattaactttttaaaagaagctaataagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcaggtaattctgactcgaaggacagaagagatgagacaccaattattgcggtgatggtggccctgtcctctctgctagtgatcgtgtttattatcatagttttgtacatgttaaggtttaagaaatacaagcaagctgggagccattccaattctttccgcttatccaacggccgcactgaggatgtggagccccagagtgtgccacttctggccagatccccaagcaccaacaggaaatacccacccctgcccgtggacaagctggaagaggaaattaaccggagaatggcagacgacaataagctcttcagggaggaattcaacgctctccctgcatgtcctatccaggccacctgtgaggctgcttccaaggaggaaaacaaggaaaaaaatcgatatgtaaacatcttgccttatgaccactctagagtccacctgacaccggttgaaggggttccagattctgattacatcaatgcttcattcatcaacggctaccaagaaaagaacaaattcattgctgcacaaggaccaaaagaagaaacggtgaatgatttctggcggatgatctgggaacaaaacacagccaccatcgtcatggttaccaacctgaaggagagaaaggagtgcaagtgcgcccagtactggccagaccaaggctgctggacctatgggaatattcgggtgtctgtagaggatgtgactgtcctggtggactacacagtacggaagttctgcatccagcaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatatgcagtatgtcttcatataccaagcccttctggagcattatctctatggagatacagaactggaagtgacctctctagaaacccacctgcagaaaatttacaacaaaatcccagggaccagcaacaatggattagaggaggagtttaagaagttaacatcaatcaaaatccagaatgacaagatgcggactggaaaccttccagccaacatgaagaagaaccgtgttttacagatcattccatatgaattcaacagagtgatcattccagttaagcggggcgaagagaatacagactatgtgaacgcatcctttattgatggctaccggcagaaggactcctatatcgccagccagggccctcttctccacacaattgaggacttctggcgaatgatctgggagtggaaatcctgctctatcgtgatgctaacagaactggaggagagaggccaggagaagtgtgcccagtactggccatctgatggactggtgtcctatggagatattacagtggaactgaagaaggaggaggaatgtgagagctacaccgtccgagacctcctggtcaccaacaccagggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcagcgccggggcaggaaggacggggaccttctgtgccctgagcaccgtcctggagcgtgtgaaagcagaggggattttggatgtcttccagactgtcaagagcctgcggctacagaggccacacatggtccagacactggaacagtatgagttctgctacaaggtggtgcaggagtatattgatgcattctcagattatgccaacttcaagtaagcggcaacaagggtccgtggaccaggaggattgcctttaatattttgtaatattctgttttgttaatataccccaaattgtgtatatatcttataactgttttagaaattggtacataggcttctattacctattaggtggaaattttatatgtaaatgtgttagcactgatagtcctttttccaatgttttattggggaattaaatagtgtgatgtttggattgatatcgtgaaatcctcagccgagaaattgggctggattgtgctttggttaatacatctttccctaaagaagataaacacaaaatccattccaggtagctcggcaccaactaagaaaaaaagcacaaagttctcagagctctcgaggaaagtggttgtccccgtaccaccatgcactgtaaatatccctcccctctctccctggtcccctcccccatccccaccactgatatcatggggagtaataggaccagagcggtatctctggcaccacactagggactatcaggtaataaaagctttgactccctg

SEQ ID NO: 171724 - DNA, 707 bp, Homo sapiens
  Payload ID: 13755
  Gene Symbol: PTPRA
  Gene Name: protein tyrosine phosphatase, receptor type, A
  ENST ID: ENST00000431048
  CDS Start-End: 293-707
agagacgcgcgcgcgcgcgatcgcgctcggaccccggccgctgccgccatcactgtcgcccgcccagtcgcccctcagccgcttcccctcgccatggaggcgaggccgccgccgccgccgcggggctcggagccgcgggccgggcggcggccctgagggctagtggcggcccgaaacgccgccgcggagccgaggcggagccgctgtcctcgtccccagcggtcccgcccaacgcccgactctgacacatgttcaaagagcataattaactttttaaaagaagctaataagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcag

SEQ ID NO: 171725 - DNA, 733 bp, Homo sapiens
  Payload ID: 13755
  Gene Symbol: PTPRA
  Gene Name: protein tyrosine phosphatase, receptor type, A
  ENST ID: ENST00000430705
  CDS Start-End: 207-733
gcggcccgaaacgccgccgcggagccgaggcggagccgctgtcctcgtccccagcggtcccgcccaacgcccgactctgtgacacaactaaaaaaaaacaaaggtatttatggaattccactgagtggtaatggatgatgcagttcaaataactaaggacacatgttcaaagagcataattaactttttaaaagaagctaataagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcaggtaattctgactcgaaggacagaagagatgagacaccaattattgcggtgatggtggccctgtcctctctgctagtgatcgtgtttattatcatagttttgtacatgttaag

SEQ ID NO: 171726 - DNA, 1107 bp, Homo sapiens
  Payload ID: 13755
  Gene Symbol: PTPRA
  Gene Name: protein tyrosine phosphatase, receptor type, A
  ENST ID: ENST00000455631
  CDS Start-End: 348-1107
tgtcggccaaccagcgcctgtctctgaacagccaatgaacacgcgtcttacagccaaggccgggtcgggagcgaggctgcggcgagtgcggcgctgacagagacgcgcgcgcgcgcgatcgcgctcggaccccggccgctgccgccatcactgtcgcccgcccagtcgcccctcagccgcttcccctcgccatggaggcgaggccgccgccgccgccgcggggctcggagccgcgggccgggcggcggccctgagggctagtggcggcccgaaacgccgccgcggagccgaggcggagccgctgtcctcgtccccagcggtcccgcccaacgcccgactctataagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcagatgagacaccaattattgcggtgatggtggccctgtcctctctgctagtgatcgtgtttattatcatagttttgtacatgttaaggtttaagaaatacaagcaagctgggagccattccaattctttccgcttatccaacggccgcactgaggatgtggagccccagagtgtgccacttctggccagatccccaagcaccaacaggaaatacccacccctgcccgtggacaagctggaagaggaaattaaccggagaatggcagacgacaataagctcttcagggaggaattcaacgctctccctgcatgtcctatccaggccacctgtgaggctgcttccaagg

SEQ ID NO: 171727 - DNA, 6110 bp, Homo sapiens
  Payload ID: 13756
  Gene Symbol: PTPRB
  Gene Name: protein tyrosine phosphatase, receptor type, B
  Uniprot ID: P23467
  ENST ID: ENST00000261266
  CDS Start-End: 31-6024
gtctcctctggatcttaactactgagcgcaatgctgagccatggagccgggttggccttgtggatcacactgagcctgctgcagactggactggcggagccagagagatgtaacttcaccctggcggagtccaaggcctccagccattctgtgtctatccagtggagaattttgggctcaccctgtaactttagcctcatctatagcagtgacaccctgggggccgcgttgtgccctacctttcggatagacaacaccacatacggatgtaaccttcaagatttacaagcaggaaccatctataacttcaggattatttctctggatgaagagagaacagtggtcttgcaaacagatcctttacctcctgctaggtttggagtcagtaaagagaagacgacttcaaccagcttgcatgtttggtggactccttcttccggaaaagtcacctcatatgaggtgcaattatttgatgaaaataaccaaaagatacagggggttcaaattcaagaaagtacttcatggaatgaatacacttttttcaatctcactgctggtagtaaatacaatattgccatcacagctgtttctggaggaaaacgttctttttcagtttataccaatggatcaacagtgccatctccagtgaaagatattggtatttccacaaaagccaattctctcctgatttcctggtcccatggttctgggaatgtggaacgataccggctgatgctaatggataaagggatcctagttcatggcggtgttgtggacaaacatgctacttcctatgcttttcacgggctgacccctggctacctctacaacctcactgttatgactgaggctgcagggctgcaaaactacaggtggaaactagtcaggacagcccccatggaagtctcaaatctgaaggtgacaaatgatggcagtttgacctctctaaaagtcaaatggcaaagacctcctggaaatgtggattcttacaatatcaccctgtctcacaaagggaccatcaaggaatccagagtattagcaccttggattactgaaactcactttaaagagttagtccccggtcgactttatcaagttactgtcagctgtgtctctggtgaactgtctgctcagaagatggcagtgggcagaacatttccagacaaagttgcaaacctggaggcaaacaataatggcaggatgaggtctcttgtagtgagctggtcgccccctgctggagactgggagcagtatcggatcctactcttcaatgattctgtggtgctgctcaacatcactgtgggaaaggaagaaacacagtatgtcatggatgacacggggctcgtaccgggaagacagtatgaggtggaagtcattgttgagagtggaaatttgaagaattctgagcgttgccaaggcaggacagtccccctggctgtcctccagcttcgtgtcaaacatgccaatgaaacctcactgagtatcatgtggcagacccctgtagcagaatgggagaaatacatcatttccctagctgacagagacctcttactgatccacaagtcactctccaaagatgccaaagaattcacttttactgacctggtgcctggacgaaaatacatggctacagtcaccagtattagtggagacttaaaaaattcctcttcagtaaaaggaagaacagtgcctgcccaagtgactgacttgcatgtggccaaccaaggaatgaccagtagtctgtttactaactggacccaggcacaaggagacgtagaattttaccaagtcttactgatccatgaaaatgtggtcattaaaaatgaaagcatctccagtgagaccagcagatacagcttccactctctcaagtccggcagcctgtactccgtggtggtaacaacagtgagtggagggatctcttcccgacaagtggttgtggagggaagaacagtcccttccagtgtgagtggagtaacggtgaacaattccggtcgtaatgactacctcagcgtttcctggctgctggcgcccggagatgtggataactatgaggtaacattgtctcatgacggcaaggtggttcagtcccttgtcattgccaagtctgtcagagaatgttccttcagctccctcaccccaggccgcctctacaccgtgaccataactacaaggagtggcaagtatgaaaatcactccttcagccaagagcggacagtgcctgacaaagtccagggagtcagtgttagcaactcagccaggagtgactatttaagggtatcctgggtgcatgccactggagactttgatcactatgaagtcaccattaaaaacaaaaacaacttcattcaaactaaaagcattcccaagtcagaaaacgaatgtgtatttgttcagctagtccctggacggttgtacagtgtcactgttactacaaaaagtggacaatatgaagccaatgaacaagggaatgggagaacaattccagagcctgttaaggatctaacattgcgcaacaggagcactgaggacttgcatgtgacttggtcaggagctaatggggatgtcgaccaatatgagatccagctgctcttcaatgacatgaaagtatttcctccttttcaccttgtaaataccgcaaccgagtatcgatttacttccctaacaccaggccgccaatacaaaattcttgtcttgacgattagcggggatgtacagcagtcagccttcattgagggcttcacagttcctagtgctgtcaaaaatattcacatttctcccaatggagcaacagatagcctgacggtgaactggactcctggtgggggagacgttgattcctacacggtgtcggcattcaggcacagtcaaaaggttgactctcagactattcccaagcacgtctttgagcacacgttccacagactggaggccggggagcagtaccagatcatgattgcctcagtcagcgggtccctgaagaatcagataaatgtggttgggcggacagttccagcatctgtccaaggagtaattgcagacaatgcatacagcagttattccttaatagtaagttggcaaaaagctgctggtgtggcagaaagatatgatatcctgcttctaactgaaaatggaatccttctgcgcaacacatcagagccagccaccactaagcaacacaaatttgaagatctaacaccaggcaagaaatacaagatacagatcctaactgtcagtggaggcctctttagcaaggaagcccagactgaaggccgaacagtcccagcagctgtcaccgacctgaggatcacagagaactccaccaggcacctgtccttccgctggaccgcctcagagggggagctcagctggtacaacatctttttgtacaacccagatgggaatctccaggagagagctcaagttgacccactagtccagagcttctctttccagaacttgctacaaggcagaatgtacaagatggtgattgtaactcacagtggggagctgtctaatgagtctttcatatttggtagaacagtcccagcctctgtgagtcatctcagggggtccaatcggaacacgacagacagcctttggttcaactggagtccagcctctggggactttgacttttatgagctgattctctataatcccaatggcacaaagaaggaaaactggaaagacaaggacctgacggagtggcggtttcaaggccttgttcctggaaggaagtacgtgctgtgggtggtaactcacagtggagatctcagcaataaagtcacagcggagagcagaacagctccaagtcctcccagtcttatgtcatttgctgacattgcaaacacatccttggccatcacgtggaaagggcccccagactggacagactacaacgactttgagctgcagtggttgcccagagatgcacttactgtcttcaacccctacaacaacagaaaatcagaaggacgcattgtgtatggtcttcgtccagggagatcctatcaattcaacgtcaagactgtcagtggtgattcctggaaaacttacagcaaaccaatttttggatctgtgaggacaaagcctgacaagatacaaaacctgcattgccggcctcagaactccacggccattgcctgttcttggatccctcctgattctgactttgatggttatagtattgaatgccggaaaatggacacccaagaagttgagttttccagaaagctggagaaagaaaaatctctgctcaacatcatgatgctagtgccccataagaggtacctggtgtccatcaaagtgcagtcggccggcatgaccagcgaggtggttgaagacagcactatcacaatgatagaccgcccccctcctccacccccacacattcgtgtgaatgaaaaggatgtgctaattagcaagtcttccatcaactttactgtcaactgcagctggttcagcgacaccaatggagctgtgaaatacttcacagtggtggtgagagaggctgatggcagtgatgagctgaagccagaacagcagcaccctctcccttcctacctggagtacaggcacaatgcctccattcgggtgtatcagactaattattttgccagcaaatgtgccgaaaatcctaacagcaactccaagagttttaacattaagcttggagcagagatggagagcctaggtggaaaatgcgatcccactcagcaaaaattctgtgatggaccactgaagccacacactgcctacagaatcagcattcgagcttttacacagctctttgatgaggacctgaaggaattcacaaagccactctattcagacacatttttttctttacccatcactactgaatcagagcccttgtttggagctattgaaggtgtgagtgctggtctgtttttaattggcatgctagtggctgttgttgccttattgatctgcagacagaaagtgagccatggtcgagaaagaccctctgcccgtctgagcattcgtagggatcgaccattatctgtccacttaaacctgggccagaaaggtaaccggaaaacttcttgtccaataaaaataaatcagtttgaagggcatttcatgaagctacaggctgactccaactaccttctatccaaggaatacgaggagttaaaagacgtgggccgaaaccagtcatgtgacattgcactcttgccggagaatagagggaaaaatcgatacaacaatatattgccctatgatgccacgcgagtgaagctctccaatgtagatgatgatccttgctctgactacatcaatgccagctacatccctggcaacaacttcagaagagaatacattgtcactcagggaccgcttcctggcaccaaggatgacttctggaaaatggtgtgggaacaaaacgttcacaacatcgtcatggtgacccagtgtgttgagaagggccgagtaaagtgtgatcattactggccagcggaccaggattccctctactatggggacctcatcctgcagatgctctcagagtccgtcctgcctgagtggaccatccgggagtttaagatatgcggtgaggaacagcttgatgcacacagactcatccgccactttcactatacggtgtggccagaccatggagtcccagaaaccacccagtctctgatccagtttgtgagaactgtcagggactacatcaacagaagcccgggtgctgggcccactgtggtgcactgcagtgctggtgtgggtaggactggaacctttattgcattggaccgaatcctccagcagttagactccaaagactctgtggacatttatggagcagtgcacgacctaagacttcacagggttcacatggtccagactgagtgtcagtatgtctacctacatcagtgtgtaagagatgtcctcagagcaagaaagctacggagtgaacaagaaaaccccttgtttccaatctatgaaaatgtgaatccagagtatcacagagatccagtctattcaaggcattgagaatgtacctgaagagctcctggataaaaattattcactgtgtgatttgtttttaaaaacttgcttcatgccctacagaggtgcca

SEQ ID NO: 171728 - DNA, 12316 bp, Homo sapiens
  Payload ID: 13756
  Gene Symbol: PTPRB
  Gene Name: protein tyrosine phosphatase, receptor type, B
  Uniprot ID: P23467
  ENST ID: ENST00000334414
  CDS Start-End: 46-6693
ttttttttttccccaagcgaagcatgaacagttgctaagtggaaaatggaggctgaattttacatggtgattcttacctgcttgatcttcaggaactcagaagggtttcagattgtccatgtccagaaacaacagtgtcttttcaaaaatgagaaagtggtcgtgggctcatgcaacaggaccatccagaaccagcagtggatgtggactgaggatgaaaagctccttcatgttaaatctgcactgtgcttggccatctccaactcttcccgcggcccctcccgctcagccatcttggaccgctgttcccaggcaccccgatggacctgctatgatcaggaaggcttccttgaggtggaaaatgcctctctctttctccagaaacaaggctccagagtagtggtcaagaaggccaggaaatacctccatagctggatgaaaatagatgtcaacaaggagggaaaactggtcaatgaaagcctctgtttacaaaaagctggcctgggagcagaagtttcggtgaggagcactagaaacacggctccaccccagattctcactacctttaatgcagttccagatggcctggtattccttattaggaataccacagaggccttcatcagaaatgctgcagaaaactacagccaaaacagcagcgagaggcagcatcccaatctgcacatgactggaattacagacacatcatgggttttgtcgactactcagcccttctccagcaccactgaagagactggactggcggagccagagagatgtaacttcaccctggcggagtccaaggcctccagccattctgtgtctatccagtggagaattttgggctcaccctgtaactttagcctcatctatagcagtgacaccctgggggccgcgttgtgccctacctttcggatagacaacaccacatacggatgtaaccttcaagatttacaagcaggaaccatctataacttcaggattatttctctggatgaagagagaacagtggtcttgcaaacagatcctttacctcctgctaggtttggagtcagtaaagagaagacgacttcaaccagcttgcatgtttggtggactccttcttccggaaaagtcacctcatatgaggtgcaattatttgatgaaaataaccaaaagatacagggggttcaaattcaagaaagtacttcatggaatgaatacacttttttcaatctcactgctggtagtaaatacaatattgccatcacagctgtttctggaggaaaacgttctttttcagtttataccaatggatcaacagtgccatctccagtgaaagatattggtatttccacaaaagccaattctctcctgatttcctggtcccatggttctgggaatgtggaacgataccggctgatgctaatggataaagggatcctagttcatggcggtgttgtggacaaacatgctacttcctatgcttttcacgggctgacccctggctacctctacaacctcactgttatgactgaggctgcagggctgcaaaactacaggtggaaactagtcaggacagcccccatggaagtctcaaatctgaaggtgacaaatgatggcagtttgacctctctaaaagtcaaatggcaaagacctcctggaaatgtggattcttacaatatcaccctgtctcacaaagggaccatcaaggaatccagagtattagcaccttggattactgaaactcactttaaagagttagtccccggtcgactttatcaagttactgtcagctgtgtctctggtgaactgtctgctcagaagatggcagtgggcagaacatttccagacaaagttgcaaacctggaggcaaacaataatggcaggatgaggtctcttgtagtgagctggtcgccccctgctggagactgggagcagtatcggatcctactcttcaatgattctgtggtgctgctcaacatcactgtgggaaaggaagaaacacagtatgtcatggatgacacggggctcgtaccgggaagacagtatgaggtggaagtcattgttgagagtggaaatttgaagaattctgagcgttgccaaggcaggacagtccccctggctgtcctccagcttcgtgtcaaacatgccaatgaaacctcactgagtatcatgtggcagacccctgtagcagaatgggagaaatacatcatttccctagctgacagagacctcttactgatccacaagtcactctccaaagatgccaaagaattcacttttactgacctggtgcctggacgaaaatacatggctacagtcaccagtattagtggagacttaaaaaattcctcttcagtaaaaggaagaacagtgcctgcccaagtgactgacttgcatgtggccaaccaaggaatgaccagtagtctgtttactaactggacccaggcacaaggagacgtagaattttaccaagtcttactgatccatgaaaatgtggtcattaaaaatgaaagcatctccagtgagaccagcagatacagcttccactctctcaagtccggcagcctgtactccgtggtggtaacaacagtgagtggagggatctcttcccgacaagtggttgtggagggaagaacagtcccttccagtgtgagtggagtaacggtgaacaattccggtcgtaatgactacctcagcgtttcctggctgctggcgcccggagatgtggataactatgaggtaacattgtctcatgacggcaaggtggttcagtcccttgtcattgccaagtctgtcagagaatgttccttcagctccctcaccccaggccgcctctacaccgtgaccataactacaaggagtggcaagtatgaaaatcactccttcagccaagagcggacagtgcctgacaaagtccagggagtcagtgttagcaactcagccaggagtgactatttaagggtatcctgggtgcatgccactggagactttgatcactatgaagtcaccattaaaaacaaaaacaacttcattcaaactaaaagcattcccaagtcagaaaacgaatgtgtatttgttcagctagtccctggacggttgtacagtgtcactgttactacaaaaagtggacaatatgaagccaatgaacaagggaatgggagaacaattccagagcctgttaaggatctaacattgcgcaacaggagcactgaggacttgcatgtgacttggtcaggagctaatggggatgtcgaccaatatgagatccagctgctcttcaatgacatgaaagtatttcctccttttcaccttgtaaataccgcaaccgagtatcgatttacttccctaacaccaggccgccaatacaaaattcttgtcttgacgattagcggggatgtacagcagtcagccttcattgagggcttcacagttcctagtgctgtcaaaaatattcacatttctcccaatggagcaacagatagcctgacggtgaactggactcctggtgggggagacgttgattcctacacggtgtcggcattcaggcacagtcaaaaggttgactctcagactattcccaagcacgtctttgagcacacgttccacagactggaggccggggagcagtaccagatcatgattgcctcagtcagcgggtccctgaagaatcagataaatgtggttgggcggacagttccagcatctgtccaaggagtaattgcagacaatgcatacagcagttattccttaatagtaagttggcaaaaagctgctggtgtggcagaaagatatgatatcctgcttctaactgaaaatggaatccttctgcgcaacacatcagagccagccaccactaagcaacacaaatttgaagatctaacaccaggcaagaaatacaagatacagatcctaactgtcagtggaggcctctttagcaaggaagcccagactgaaggccgaacagtcccagcagctgtcaccgacctgaggatcacagagaactccaccaggcacctgtccttccgctggaccgcctcagagggggagctcagctggtacaacatctttttgtacaacccagatgggaatctccaggagagagctcaagttgacccactagtccagagcttctctttccagaacttgctacaaggcagaatgtacaagatggtgattgtaactcacagtggggagctgtctaatgagtctttcatatttggtagaacagtcccagcctctgtgagtcatctcagggggtccaatcggaacacgacagacagcctttggttcaactggagtccagcctctggggactttgacttttatgagctgattctctataatcccaatggcacaaagaaggaaaactggaaagacaaggacctgacggagtggcggtttcaaggccttgttcctggaaggaagtacgtgctgtgggtggtaactcacagtggagatctcagcaataaagtcacagcggagagcagaacagctccaagtcctcccagtcttatgtcatttgctgacattgcaaacacatccttggccatcacgtggaaagggcccccagactggacagactacaacgactttgagctgcagtggttgcccagagatgcacttactgtcttcaacccctacaacaacagaaaatcagaaggacgcattgtgtatggtcttcgtccagggagatcctatcaattcaacgtcaagactgtcagtggtgattcctggaaaacttacagcaaaccaatttttggatctgtgaggacaaagcctgacaagatacaaaacctgcattgccggcctcagaactccacggccattgcctgttcttggatccctcctgattctgactttgatggttatagtattgaatgccggaaaatggacacccaagaagttgagttttccagaaagctggagaaagaaaaatctctgctcaacatcatgatgctagtgccccataagaggtacctggtgtccatcaaagtgcagtcggccggcatgaccagcgaggtggttgaagacagcactatcacaatgatagaccgcccccctcctccacccccacacattcgtgtgaatgaaaaggatgtgctaattagcaagtcttccatcaactttactgtcaactgcagctggttcagcgacaccaatggagctgtgaaatacttcacagtggtggtgagagaggctgatggcagtgatgagctgaagccagaacagcagcaccctctcccttcctacctggagtacaggcacaatgcctccattcgggtgtatcagactaattattttgccagcaaatgtgccgaaaatcctaacagcaactccaagagttttaacattaagcttggagcagagatggagagcctaggtggaaaatgcgatcccactcagcaaaaattctgtgatggaccactgaagccacacactgcctacagaatcagcattcgagcttttacacagctctttgatgaggacctgaaggaattcacaaagccactctattcagacacatttttttctttacccatcactactgaatcagagcccttgtttggagctattgaaggtgtgagtgctggtctgtttttaattggcatgctagtggctgttgttgccttattgatctgcagacagaaagtgagccatggtcgagaaagaccctctgcccgtctgagcattcgtagggatcgaccattatctgtccacttaaacctgggccagaaaggtaaccggaaaacttcttgtccaataaaaataaatcagtttgaagggcatttcatgaagctacaggctgactccaactaccttctatccaaggaatacgaggagttaaaagacgtgggccgaaaccagtcatgtgacattgcactcttgccggagaatagagggaaaaatcgatacaacaatatattgccctatgatgccacgcgagtgaagctctccaatgtagatgatgatccttgctctgactacatcaatgccagctacatccctggcaacaacttcagaagagaatacattgtcactcagggaccgcttcctggcaccaaggatgacttctggaaaatggtgtgggaacaaaacgttcacaacatcgtcatggtgacccagtgtgttgagaagggccgagtaaagtgtgatcattactggccagcggaccaggattccctctactatggggacctcatcctgcagatgctctcagagtccgtcctgcctgagtggaccatccgggagtttaagatatgcggtgaggaacagcttgatgcacacagactcatccgccactttcactatacggtgtggccagaccatggagtcccagaaaccacccagtctctgatccagtttgtgagaactgtcagggactacatcaacagaagcccgggtgctgggcccactgtggtgcactgcagtgctggtgtgggtaggactggaacctttattgcattggaccgaatcctccagcagttagactccaaagactctgtggacatttatggagcagtgcacgacctaagacttcacagggttcacatggtccagactgagtgtcagtatgtctacctacatcagtgtgtaagagatgtcctcagagcaagaaagctacggagtgaacaagaaaaccccttgtttccaatctatgaaaatgtgaatccagagtatcacagagatccagtctattcaaggcattgagaatgtacctgaagagctcctggataaaaattattcactgtgtgatttgtttttaaaaacttgcttcatgccctacagaggtgccagctatttctgttgatactatgtataatttattaatctggagaatgtttaaaattttatataatttaaaggtaacagatattattgtacatagttgtattttgtagtttcttctgtaaatatgtatttttcataatgtttaatattaagctttatataatactatttttccacactaaagtgttcatgacttgttctacataaaactaattcaacctgtatgacaggactactggtaaaatgcatatggaggtggtggcagagacaatccttcaggccatgttttctacctgttttgatattcactggacaggaaaaagggcagggctagagagagcaaatactatggctagatttgctgcattgctgtcccatgaatctcgagagccaacagacatgtcctaacttgctattaggacaaatgtgacagtcaaaaaaaggattagagggagggagaaaaaagaattaagcagtaccaaagctgaactagatgcttgtgtctgaactagttgctctctctctcctttctccttccagggattcaagccaaagtggtcagctcagggatcatgtaacttgcagtgcaagcccaggatggtaggatgcagggttgagggttctgatagagaatgattccaaacagaagtgatgaattccttttgttaataagatgccagctatacccagactggaaacataacatgcaaagcactatctacagtgattagagatcctttcattgcattcatggtgtggagtgtgaacatccacacccatactgtaatgtatttatacacactagtttctgtctcattttcagtggtctccattcctagaaaagtcacaattatccattcctacttgatttcccattaaaagaatattatggtagcagattgtgcccctcattaaaaggcttaatgccaacattttcatagaaatgactacaaacatcatatatagtaaatttaaaaacaatagcaaaaacaaaaacagtggtcttcagtaaaattttcaaaacttcttttagtaaatcaatgaagtcaaaatgtcaagtaatcacccaaagttgcatttaataacaaaaggcactacatactgtaccaagtttatcttcaatatttgtgccttacttactttgactataacaaattccaatgagtcagaaagtatttccttcatcaaggtccagttccgacagcattcctgggaaaaatttgaaaggagtttgtacggaatcttcatagatacctgagaagatgagctggagatgtttgcctttttcacactacaaatttttctgtaataaacttgggaattagaggtcaagtttgttgatggcatagcttcctttgcataaagagtatatttcttttcaaagtatatatttttgtaacctaccataaagtccgtaagtgaatacaacgaatgtaattgacataataattgaaaatcattgactatacctaaaatagttctttataattaaataactctacacccaatctggaaatttttccaaggttatttgaagtttacaaaaatgtgaagcataatcataagcttcaaagattcacagtttcattgtgctcaatgctcttgtgaaatgacagtcttaagctctgattctgtatcaaggaactaagtgaatcttctggaaatgaaaaggaacaacatatgtgtaagtgcagtagatgtaccaccagcgagaaaatagaggtcagagatctacaacgtgtggcatccattagaaatcacctttcctacattgaaaagaaaaaagagaaaaagcagaattttacactaatgttgcttgatgcaaagcacattaatgcttggaaggatacattcattttcgacttttcattcactcagaaaacttctagtaagtatctgcaacctgctaggcactgttccagaatctacacatttctactcacataaagagaatcctcataaagttaggattgttgttactaccttcaattgagcttaaaagacagcctcatcaagggaatgggataactgagccagtctaggacagtggtcaccttccacaggccacacactggaaagtgctaatgctactttaatagcaaacctctggatctaggagagagagcaattaattgcacaaaccaggagttaaaaccataaaaaaaacctatgcatctgtaatagtaaataacactcacgtactctggcaacatctagggtagtatcagaattatgtaaatggacatgacagggaaaaatcgtaggtttttttagtctaatccaacccaggaaatgtttattcctaccctacacctaattttaaaccttcttagcaacaaatatttcactattcgctcctactcctgggaagactaaatatataattgacttatttattaaatttaggagaaaaaaaaagttttccttgacattcagctctattggatttatttccatttaattgcatcatgtgttatgtcttggtaaacactccatttcctgtcttggtgggcatcctgtctgtgtacctgtgcagtacactttaatcatcaagacttcaaagtgcttttgagctatcaaatcttgggagagtcccatctagcatcttaataattatttttccaagttcgttataattaactcctttaacctcatctcattaaatcaattttgtattgtcattctgttgttctctggaaagcagccaattgttcagctcttgaatcagaattttcaaagactcacctctcttacctgggcttgcacatatttgtcctaagtaattctctatcccttaaacctctgagtccctctgttttattacttgccccactcctcctacttgaatatgtttgttttcccagttgaatgtgatttttatctactgttcatattatcttttatacccatgagtataatttcatagtcctttcaggttccacatcatcaaagagatgaccataatttcacttttttttgaaatgaagtcttgctctgttgcccaggctggagtgcagtggcacaatctcagctcactacaacctccgcctcccaggttcaagcgattctgccttagcctcccaagtagctggaattacaggtgcctgccaccatgtctggctaatttttgtgtttttagtagagatggggtttcaccatgttggccaggctggtcttgaactcgtgaccttaggtgatccacccacctcaacctcccaaagtgctaggattacaagagtgagccaccgcacctggccaattcacttttaaatactaaaaggcacacagcacacagacattttcggggcagttttctttgggagggtctttgataaattttgtaatcacctctcggaagaaagcccaaaatgacatgtgaaaataatattaaaccatttaccagatgtccagcaatataaaaatagacctcacatgctacccttcacatgctgattctcttgccttgctgtttaaggatccagtttcttatgttaaacattttccttaccttttgcaataatattattggccatatactaaattctcattcacttagctttctaagaattctttgaggttggaatcctgaaatcataaagctaccagatctgcacaacagcagtggtagtatctgagcccaaactctgagacgctctagagttttagtttacaaacatgagccagaccaaacctgacctggtgaaaatcaataggtaataaactgcttgtatatgatagcagttcaagggctttctgggttccatttcactgaggaaatgaaaatataactgattagccaagacagagtggcaataaggaataactgatcctcctccaagttgcagtgagcaagccctcaagcctacctcattcctgaagagttgaaggagaaaatgccgtgctaattttctgccctgctatttttaacctgaaatttagaattacatcaggtattcaaagaatgttccctatcaaaggaaaatctgtaaacgatgactgcaaaaagcaagtgaaatgatgcaaagagaaaatatttgcaaaacagaatctaaccagacatcatcatgaagataaaatggcatctcttctgtgtggcctgggtgtgcttggacaatcctgtcacacgtttctattaggacatgttgcccttttgaggattcactctatgttggccagatggtttaactgattaaacaattgaatcaatttattttgctttttgaattgaccagatatttaactaaatgtactgggtttggcattttagacacactgccttagattcttgtagtgcatgatgactttgaaaatgtttggccattttagttaaaatgcagggtaacatttgatgcagccatgataacaggaaaaatctgttctgttctaaaaatgtttctagcaatagaagtatttctggctaagagaatactcttgacttgtagggaggctccctcggaataaatgtatgcaacacaaataaggcattttattttttaaaagattgtctatataagatacacttattaaataaagaaattgttggtgaatgctctgaaaatagaggcttatgtaatggaaataagagattaacaggtttaccaaagattatttttataacctctatgccaattcacatgatcttatataagacaccaaaataagttattcaaaactgtgaataatgtcagacaaatgcaatgtgtcccttctagaacagtcacaaaaagaattggttatagctattttaataaataatatcctcaccccaagaacaaacgttcagttatgctgagatgttctaatagctgtgtgcgtagataagcacctccatcaagaaaggaacacatgaaattgtggctttaagagtttgtggcagagttggacagcattccatctgcaggttagtaggaaagcctgtaccagcctttgtggaatgtcctagtctgccacactgacaagagggtgcaccagtgctctactggaagagtatttctggttttctatgcaggactattgggcttataaattcctcaagaacaaggaccaagtctttaatctcgtctcgactcctaccttgtggaaattagtgcacagctcatagacattctacacacacttcttgaaattgctcctggcctgatattttggatgttaggtagtcagtgtccaataatactgttgtccgtgcaggttaatctagccattccttcatttgtgtgaagcataaataatgtaagtaaatacagcaactgaactttttatgttctataatagagcacttttatgtttttaatatcatttattatttctctgaaaatccagttaagatggcagatgattctattttttcatattatagcatctacccacaatatttctaactaactgtatttgaacaaagaacttccttagtctttcaatttaaattatgtatttgcttaatacatttttatatttgtaactgtggtaaaaaaaaaatctatatagcatcttgcatacattctcactagtacaggaataaaactgcagtttgttgaaggag

SEQ ID NO: 171729 - DNA, 6581 bp, Homo sapiens
  Payload ID: 13756
  Gene Symbol: PTPRB
  Gene Name: protein tyrosine phosphatase, receptor type, B
  ENST ID: ENST00000451516
  CDS Start-End: 27-2786
aagcatgaacagttgctaagtggaaaatggaggctgaattttacatggtgattcttacctgcttgatcttcaggaactcagaagggtttcagattgtccatgtccagaaacaacagtgtcttttcaaaaatgagaaagtggtcgtgggctcatgcaacaggaccatccagaaccagcagtggatgtggactgaggatgaaaagctccttcatgttaaatctgcactgtgcttggccatctccaactcttcccgcggcccctcccgctcagccatcttggaccgctgttcccaggcaccccgatggacctgctatgatcaggaaggcttccttgaggtggaaaatgcctctctctttctccagaaacaaggctccagagtagtggtcaagaaggccaggaaatacctccatagctggatgaaaatagatgtcaacaaggagggaaaactggtcaatgaaagcctctgtttacaaaaagctggcctgggagcagaagtttcggtgaggagcactagaaacacggctccaccccagattctcactacctttaatgcagttccagatggcctggtattccttattaggaataccacagaggccttcatcagaaatgctgcagaaaactacagccaaaacagcagcgagaggcagcatcccaatctgcacatgactggaattacagacacatcatgggttttgtcgactactcagcccttctccagcaccactgaagagactggactggcggagccagagagatgtaacttcaccctggcggagtccaaggcctccagccattctgtgtctatccagtggagaattttgggctcaccctgtaactttagcctcatctatagcagtgacaccctgggggccgcgttgtgccctacctttcggatagacaacaccacatacggatgtaaccttcaagatttacaagcaggaaccatctataacttcaggattatttctctggatgaagagagaacagtggtcttgcaaacagatcctttacctcctgctaggtttggagtcagtaaagagaagacgacttcaaccagcttgcatgtttggtggactccttcttccggaaaagtcacctcatatgaggtgcaattatttgatgaaaataaccaaaagatacagggggttcaaattcaagaaagtacttcatggaatgaatacacttttttcaatctcactgctggtagtaaatacaatattgccatcacagctgtttctggaggaaaacgttctttttcagtttataccaatggatcaacagtgccatctccagtgaaagatattggtatttccacaaaagccaattctctcctgatttcctggtcccatggttctgggaatgtggaacgataccggctgatgctaatggataaagggatcctagttcatggcggtgttgtggacaaacatgctacttcctatgcttttcacgggctgacccctggctacctctacaacctcactgttatgactgaggctgcagggctgcaaaactacaggtggaaactagtcaggacagcccccatggaagtctcaaatctgaaggtgacaaatgatggcagtttgacctctctaaaagtcaaatggcaaagacctcctggaaatgtggattcttacaatatcaccctgtctcacaaagggaccatcaaggaatccagagtattagcaccttggattactgaaactcactttaaagagttagtccccggtcgactttatcaagttactgtcagctgtgtctctggtgaactgtctgctcagaagatggcagtgggcagaacatttccagacaaagttgcaaacctggaggcaaacaataatggcaggatgaggtctcttgtagtgagctggtcgccccctgctggagactgggagcagtatcggatcctactcttcaatgattctgtggtgctgctcaacatcactgtgggaaaggaagaaacacagtatgtcatggatgacacggggctcgtaccgggaagacagtatgaggtggaagtcattgttgagagtggaaatttgaagaattctgagcgttgccaaggcaggacagtccccctggctgtcctccagcttcgtgtcaaacatgccaatgaaacctcactgagtatcatgtggcagacccctgtagcagaatgggagaaatacatcatttccctagctgacagagacctcttactgatccacaagtcactctccaaagatgccaaagaattcacttttactgacctggtgcctggacgaaaatacatggctacagtcaccagtattagtggagacttaaaaaattcctcttcagtaaaaggaagaacagtgcctgcccaagtgactgacttgcatgtggccaaccaaggaatgaccagtagtctgtttactaactggacccaggcacaaggagacgtagaattttaccaagtcttactgatccatgaaaatgtggtcattaaaaatgaaagcatctccagtgagaccagcagatacagcttccactctctcaagtccggcagcctgtactccgtggtggtaacaacagtgagtggagggatctcttcccgacaagtggttgtggagggaagaacagtgcctgacaaagtccagggagtcagtgttagcaactcagccaggagtgactatttaagggtatcctgggtgcatgccactggagactttgatcactatgaagtcaccattaaaaacaaaaacaacttcattcaaactaaagcattcccaagtcagaaaacgaatgtgtatttgttcagctagtccctggacggttgtacagtgtcactgttactacaaaaagtggacaatatgaagccaatgaacaagggaatgggagaacaattccagagcctgttaaggatctaacattgcgcaacaggagcactgaggacttgcatgtgacttggtcaggagctaatggggatgtcgaccaatatgagatccagctgctcttcaatgacatgaaagtatttcctccttttcaccttgtaaataccgcaaccgagtatcgatttacttccctaacaccaggccgccaatacaaaattcttgtcttgacgattagcggggatgtacagcagtcagccttcattgagggcttcacagttcctagtgctgtcaaaaatattcacatttctcccaatggagcaacagatagcctgacggtgaactggactcctggtgggggagacgttgattcctacacggtgtcggcattcaggcacagtcaaaaggttgactctcagactattcccaagcacgtctttgagcacacgttccacagactggaggccggggagcagtaccagatcatgattgcctcagtcagcgggtccctgaagaatcagataaatgtggttgggcggacagttccagcatctgtccaaggagtaattgcagacaatgcatacagcagttattccttaatagtaagttggcaaaaagctgctggtgtggcagaaagatatgatatcctgcttctaactgaaaatggaatccttctgcgcaacacatcagagccagccaccactaagcaacacaaatttgaagatctaacaccaggcaagaaatacaagatacagatcctaactgtcagtggaggcctctttagcaaggaagcccagactgaaggccgaacagtcccagcagctgtcaccgacctgaggatcacagagaactccaccaggcacctgtccttccgctggaccgcctcagagggggagctcagctggtacaacatctttttgtacaacccagatgggaatctccaggagagagctcaagttgacccactagtccagagcttctctttccagaacttgctacaaggcagaatgtacaagatggtgattgtaactcacagtggggagctgtctaatgagtctttcatatttggtagaacagtcccagcctctgtgagtcatctcagggggtccaatcggaacacgacagacagcctttggttcaactggagtccagcctctggggactttgacttttatgagctgattctctataatcccaatggcacaaagaaggaaaactggaaagacaaggacctgacggagtggcggtttcaaggccttgttcctggaaggaagtacgtgctgtgggtggtaactcacagtggagatctcagcaataaagtcacagcggagagcagaacagctccaagtcctcccagtcttatgtcatttgctgacattgcaaacacatccttggccatcacgtggaaagggcccccagactggacagactacaacgactttgagctgcagtggttgcccagagatgcacttactgtcttcaacccctacaacaacagaaaatcagaaggacgcattgtgtatggtcttcgtccagggagatcctatcaattcaacgtcaagactgtcagtggtgattcctggaaaacttacagcaaaccaatttttggatctgtgaggacaaagcctgacaagatacaaaacctgcattgccggcctcagaactccacggccattgcctgttcttggatccctcctgattctgactttgatggttatagtattgaatgccggaaaatggacacccaagaagttgagttttccagaaagctggagaaagaaaaatctctgctcaacatcatgatgctagtgccccataagaggtacctggtgtccatcaaagtgcagtcggccggcatgaccagcgaggtggttgaagacagcactatcacaatgatagaccgcccccctcctccacccccacacattcgtgtgaatgaaaaggatgtgctaattagcaagtcttccatcaactttactgtcaactgcagctggttcagcgacaccaatggagctgtgaaatacttcacagtggtggtgagagaggctgatggcagtgatgagctgaagccagaacagcagcaccctctcccttcctacctggagtacaggcacaatgcctccattcgggtgtatcagactaattattttgccagcaaatgtgccgaaaatcctaacagcaactccaagagttttaacattaagcttggagcagagatggagagcctaggtggaaaatgcgatcccactcagcaaaaattctgtgatggaccactgaagccacacactgcctacagaatcagcattcgagcttttacacagctctttgatgaggacctgaaggaattcacaaagccactctattcagacacatttttttctttacccatcactactgaatcagagcccttgtttggagctattgaaggtgtgagtgctggtctgtttttaattggcatgctagtggctgttgttgccttattgatctgcagacagaaagtgagccatggtcgagaaagaccctctgcccgtctgagcattcgtagggatcgaccattatctgtccacttaaacctgggccagaaaggtaaccggaaaacttcttgtccaataaaaataaatcagtttgaagggcatttcatgaagctacaggctgactccaactaccttctatccaaggaatacgaggagttaaaagacgtgggccgaaaccagtcatgtgacattgcactcttgccggagaatagagggaaaaatcgatacaacaatatattgccctatgatgccacgcgagtgaagctctccaatgtagatgatgatccttgctctgactacatcaatgccagctacatccctggcaacaacttcagaagagaatacattgtcactcagggaccgcttcctggcaccaaggatgacttctggaaaatggtgtgggaacaaaacgttcacaacatcgtcatggtgacccagtgtgttgagaagggccgagtaaagtgtgatcattactggccagcggaccaggattccctctactatggggacctcatcctgcagatgctctcagagtccgtcctgcctgagtggaccatccgggagtttaagatatgcggtgaggaacagcttgatgcacacagactcatccgccactttcactatacggtgtggccagaccatggagtcccagaaaccacccagtctctgatccagtttgtgagaactgtcagggactacatcaacagaagcccgggtgctgggcccactgtggtgcactgcagtgctggtgtgggtaggactggaacctttattgcattggaccgaatcctccagcagttagactccaaagactctgtggacatttatggagcagtgcacgacctaagacttcacagggttcacatggtccagactgagtgtcagtatgtctacctacatcagtgtgtaagagatgtcctcagagcaagaaagctacggagtgaacaagaaaaccccttgtttccaatctatgaaaatgtgaatccagagtatcacagagatccagtctattcaaggcattgagaatgtacctgaagagctcctggataaaaattattcactgtgtgatttgtttttaaaaacttgcttcatgccctacagaggtgccagctatttctgttgatactatgtataatttattaatctggagaatgtttaaaattttatataatttaaaggtaacagatattattgt

SEQ ID NO: 171730 - DNA, 5839 bp, Homo sapiens
  Payload ID: 13756
  Gene Symbol: PTPRB
  Gene Name: protein tyrosine phosphatase, receptor type, B
  Uniprot ID: P23467
  ENST ID: ENST00000538708
  CDS Start-End: 30-5753
tctcctctggatcttaactactgagcgcaatgctgagccatggagccgggttggccttgtggatcacactgagcctgctgcagactggactggcggagccagagagatgtaacttcaccctggcggagtccaaggcctccagccattctgtgtctatccagtggagaattttgggctcaccctgtaactttagcctcatctatagcagtgacaccctgggggccgcgttgtgccctacctttcggatagacaacaccacatacggatgtaaccttcaagatttacaagcaggaaccatctataacttcaggattatttctctggatgaagagagaacagtggtcttgcaaacagatcctttacctcctgctaggtttggagtcagtaaagagaagacgacttcaaccagcttgcatgtttggtggactccttcttccggaaaagtcacctcatatgaggtgcaattatttgatgaaaataaccaaaagatacagggggttcaaattcaagaaagtacttcatggaatgaatacacttttttcaatctcactgctggtagtaaatacaatattgccatcacagctgtttctggaggaaaacgttctttttcagtttataccaatggatcaacagtgccatctccagtgaaagatattggtatttccacaaaagccaattctctcctgatttcctggtcccatggttctgggaatgtggaacgataccggctgatgctaatggataaagggatcctagttcatggcggtgttgtggacaaacatgctacttcctatgcttttcacgggctgacccctggctacctctacaacctcactgttatgactgaggctgcagggctgcaaaactacaggtggaaactagtcaggacagcccccatggaagtctcaaatctgaaggtgacaaatgatggcagtttgacctctctaaaagtcaaatggcaaagacctcctggaaatgtggattcttacaatatcaccctgtctcacaaagggaccatcaaggaatccagagtattagcaccttggattactgaaactcactttaaagagttagtccccggtcgactttatcaagttactgtcagctgtgtctctggtgaactgtctgctcagaagatggcagtgggcagaacatttccagacaaagttgcaaacctggaggcaaacaataatggcaggatgaggtctcttgtagtgagctggtcgccccctgctggagactgggagcagtatcggatcctactcttcaatgattctgtggtgctgctcaacatcactgtgggaaaggaagaaacacagtatgtcatggatgacacggggctcgtaccgggaagacagtatgaggtggaagtcattgttgagagtggaaatttgaagaattctgagcgttgccaaggcaggacagtccccctggctgtcctccagcttcgtgtcaaacatgccaatgaaacctcactgagtatcatgtggcagacccctgtagcagaatgggagaaatacatcatttccctagctgacagagacctcttactgatccacaagtcactctccaaagatgccaaagaattcacttttactgacctggtgcctggacgaaaatacatggctacagtcaccagtattagtggagacttaaaaaattcctcttcagtaaaaggaagaacagtgcctgcccaagtgactgacttgcatgtggccaaccaaggaatgaccagtagtctgtttactaactggacccaggcacaaggagacgtagaattttaccaagtcttactgatccatgaaaatgtggtcattaaaaatgaaagcatctccagtgagaccagcagatacagcttccactctctcaagtccggcagcctgtactccgtggtggtaacaacagtgagtggagggatctcttcccgacaagtggttgtggagggaagaacagtcccttccagtgtgagtggagtaacggtgaacaattccggtcgtaatgactacctcagcgtttcctggctgctggcgcccggagatgtggataactatgaggtaacattgtctcatgacggcaaggtggttcagtcccttgtcattgccaagtctgtcagagaatgttccttcagctccctcaccccaggccgcctctacaccgtgaccataactacaaggagtggcaagtatgaaaatcactccttcagccaagagcggacagtgcctgacaaagtccagggagtcagtgttagcaactcagccaggagtgactatttaagggtatcctgggtgcatgccactggagactttgatcactatgaagtcaccattaaaaacaaaaacaacttcattcaaactaaaagcattcccaagtcagaaaacgaatgtgtatttgttcagctagtccctggacggttgtacagtgtcactgttactacaaaaagtggacaatatgaagccaatgaacaagggaatgggagaacaattccagagcctgttaaggatctaacattgcgcaacaggagcactgaggacttgcatgtgacttggtcaggagctaatggggatgtcgaccaatatgagatccagctgctcttcaatgacatgaaagtatttcctccttttcaccttgtaaataccgcaaccgagtatcgatttacttccctaacaccaggccgccaatacaaaattcttgtcttgacgattagcggggatgtacagcagtcagccttcattgagggcttcacagttcctagtgctgtcaaaaatattcacatttctcccaatggagcaacagatagcctgacggtgaactggactcctggtgggggagacgttgattcctacacggtgtcggcattcaggcacagtcaaaaggttgactctcagactattcccaagcacgtctttgagcacacgttccacagactggaggccggggagcagtaccagatcatgattgcctcagtcagcgggtccctgaagaatcagataaatgtggttgggcggacagtcccagcagctgtcaccgacctgaggatcacagagaactccaccaggcacctgtccttccgctggaccgcctcagagggggagctcagctggtacaacatctttttgtacaacccagatgggaatctccaggagagagctcaagttgacccactagtccagagcttctctttccagaacttgctacaaggcagaatgtacaagatggtgattgtaactcacagtggggagctgtctaatgagtctttcatatttggtagaacagtcccagcctctgtgagtcatctcagggggtccaatcggaacacgacagacagcctttggttcaactggagtccagcctctggggactttgacttttatgagctgattctctataatcccaatggcacaaagaaggaaaactggaaagacaaggacctgacggagtggcggtttcaaggccttgttcctggaaggaagtacgtgctgtgggtggtaactcacagtggagatctcagcaataaagtcacagcggagagcagaacagctccaagtcctcccagtcttatgtcatttgctgacattgcaaacacatccttggccatcacgtggaaagggcccccagactggacagactacaacgactttgagctgcagtggttgcccagagatgcacttactgtcttcaacccctacaacaacagaaaatcagaaggacgcattgtgtatggtcttcgtccagggagatcctatcaattcaacgtcaagactgtcagtggtgattcctggaaaacttacagcaaaccaatttttggatctgtgaggacaaagcctgacaagatacaaaacctgcattgccggcctcagaactccacggccattgcctgttcttggatccctcctgattctgactttgatggttatagtattgaatgccggaaaatggacacccaagaagttgagttttccagaaagctggagaaagaaaaatctctgctcaacatcatgatgctagtgccccataagaggtacctggtgtccatcaaagtgcagtcggccggcatgaccagcgaggtggttgaagacagcactatcacaatgatagaccgcccccctcctccacccccacacattcgtgtgaatgaaaaggatgtgctaattagcaagtcttccatcaactttactgtcaactgcagctggttcagcgacaccaatggagctgtgaaatacttcacagtggtggtgagagaggctgatggcagtgatgagctgaagccagaacagcagcaccctctcccttcctacctggagtacaggcacaatgcctccattcgggtgtatcagactaattattttgccagcaaatgtgccgaaaatcctaacagcaactccaagagttttaacattaagcttggagcagagatggagagcctaggtggaaaatgcgatcccactcagcaaaaattctgtgatggaccactgaagccacacactgcctacagaatcagcattcgagcttttacacagctctttgatgaggacctgaaggaattcacaaagccactctattcagacacatttttttctttacccatcactactgaatcagagcccttgtttggagctattgaaggtgtgagtgctggtctgtttttaattggcatgctagtggctgttgttgccttattgatctgcagacagaaagtgagccatggtcgagaaagaccctctgcccgtctgagcattcgtagggatcgaccattatctgtccacttaaacctgggccagaaaggtaaccggaaaacttcttgtccaataaaaataaatcagtttgaagggcatttcatgaagctacaggctgactccaactaccttctatccaaggaatacgaggagttaaaagacgtgggccgaaaccagtcatgtgacattgcactcttgccggagaatagagggaaaaatcgatacaacaatatattgccctatgatgccacgcgagtgaagctctccaatgtagatgatgatccttgctctgactacatcaatgccagctacatccctggcaacaacttcagaagagaatacattgtcactcagggaccgcttcctggcaccaaggatgacttctggaaaatggtgtgggaacaaaacgttcacaacatcgtcatggtgacccagtgtgttgagaagggccgagtaaagtgtgatcattactggccagcggaccaggattccctctactatggggacctcatcctgcagatgctctcagagtccgtcctgcctgagtggaccatccgggagtttaagatatgcggtgaggaacagcttgatgcacacagactcatccgccactttcactatacggtgtggccagaccatggagtcccagaaaccacccagtctctgatccagtttgtgagaactgtcagggactacatcaacagaagcccgggtgctgggcccactgtggtgcactgcagtgctggtgtgggtaggactggaacctttattgcattggaccgaatcctccagcagttagactccaaagactctgtggacatttatggagcagtgcacgacctaagacttcacagggttcacatggtccagactgagtgtcagtatgtctacctacatcagtgtgtaagagatgtcctcagagcaagaaagctacggagtgaacaagaaaaccccttgtttccaatctatgaaaatgtgaatccagagtatcacagagatccagtctattcaaggcattgagaatgtacctgaagagctcctggataaaaattattcactgtgtgatttgtttttaaaaacttgcttcatgccctacagaggtgcca

SEQ ID NO: 171731 - DNA, 639 bp, Homo sapiens
  Payload ID: 13756
  Gene Symbol: PTPRB
  Gene Name: protein tyrosine phosphatase, receptor type, B
  ENST ID: ENST00000547715
  CDS Start-End: 1-310
cttgtggatcacactgagcctgctgcagactggactggcggagccagagagatgtaacttcaccctggcggagtccaaggcctccagccattctgtgtctatccagtggagaattttgggctcaccctgtaactttagcctcatctatagcagtgacaccctgggggccgcgttgtgccctacctttcggatagacaacaccacatacggatgtaaccttcaagatttacaagcaggaaccatctataacttcaggattatttctctggatgaagagagaacagtggtcttgcaaacaggtaaaggatgacaggtgcaattggatggccaagccacacggggttgggccctgccttttcaagctggtgtttcatttgagttccagggatacaaaaaatgaaggtaaaaatacctgtgaagataaatattgacagaaatgtctggtttcctcggatctagccagaagcagcttggtggactttcagagactcccttagtgctgaaaacagccaactagctactgaaagggtcggggtggggtgcagggcggtcagcaaagagaaactttgggctgcggtgggaattttttaaagtgatgtggtttacgcttccattgcattaaattgtcaaaccctggaa

SEQ ID NO: 171732 - DNA, 4237 bp, Homo sapiens
  Payload ID: 13756
  Gene Symbol: PTPRB
  Gene Name: protein tyrosine phosphatase, receptor type, B
  ENST ID: ENST00000548122
  CDS Start-End: 17-4237
agttgctaagtggaaaatggaggctgaattttacatggtgattcttacctgcttgatcttcaggaactcagaagggtttcagattgtccatgtccagaaacaacagtgtcttttcaaaaatgagaaagtggtcgtgggctcatgcaacaggaccatccagaaccagcagtggatgtggactgaggatgaaaagctccttcatgttaaatctgcactgtgcttggccttcatcagaaatgctgcagaaaactacagccaaaacagcagcgagaggcagcatcccaatctgcacatgactggaattacagacacatcatgggttttgtcgactactcagcccttctccagcaccactgaagagactggactggcggagccagagagatgtaacttcaccctggcggagtccaaggcctccagccattctgtgtctatccagtggagaattttgggctcaccctgtaactttagcctcatctatagcagtgacaccctgggggccgcgttgtgccctacctttcggatagacaacaccacatacggatgtaaccttcaagatttacaagcaggaaccatctataacttcaggattatttctctggatgaagagagaacagtggtcttgcaaacagatcctttacctcctgctaggtttggagtcagtaaagagaagacgacttcaaccagcttgcatgtttggtggactccttcttccggaaaagtcacctcatatgaggtgcaattatttgatgaaaataaccaaaagatacagggggttcaaattcaagaaagtacttcatggaatgaatacacttttttcaatctcactgctggtagtaaatacaatattgccatcacagctgtttctggaggaaaacgttctttttcagtttataccaatggatcaacagtgccatctccagtgaaagatattggtatttccacaaaagccaattctctcctgatttcctggtcccatggttctgggaatgtggaacgataccggctgatgctaatggataaagggatcctagttcatggcggtgttgtggacaaacatgctacttcctatgcttttcacgggctgacccctggctacctctacaacctcactgttatgactgaggctgcagggctgcaaaactacaggtggaaactagtcaggacagcccccatggaagtctcaaatctgaaggtgacaaatgatggcagtttgacctctctaaaagtcaaatggcaaagacctcctggaaatgtggattcttacaatatcaccctgtctcacaaagggaccatcaaggaatccagagtattagcaccttggattactgaaactcactttaaagagttagtccccggtcgactttatcaagttactgtcagctgtgtctctggtgaactgtctgctcagaagatggcagtgggcagaacatttccagacaaagttgcaaacctggaggcaaacaataatggcaggatgaggtctcttgtagtgagctggtcgccccctgctggagactgggagcagtatcggatcctactcttcaatgattctgtggtgctgctcaacatcactgtgggaaaggaagaaacacagtatgtcatggatgacacggggctcgtaccgggaagacagtatgaggtggaagtcattgttgagagtggaaatttgaagaattctgagcgttgccaaggcaggacagtccccctggctgtcctccagcttcgtgtcaaacatgccaatgaaacctcactgagtatcatgtggcagacccctgtagcagaatgggagaaatacatcatttccctagctgacagagacctcttactgatccacaagtcactctccaaagatgccaaagaattcacttttactgacctggtgcctggacgaaaatacatggctacagtcaccagtattagtggagacttaaaaaattcctcttcagtaaaaggaagaacagtgcctgcccaagtgactgacttgcatgtggccaaccaaggaatgaccagtagtctgtttactaactggacccaggcacaaggagacgtagaattttaccaagtcttactgatccatgaaaatgtggtcattaaaaatgaaagcatctccagtgagaccagcagatacagcttccactctctcaagtccggcagcctgtactccgtggtggtaacaacagtgagtggagggatctcttcccgacaagtggttgtggagggaagaacagtcccttccagtgtgagtggagtaacggtgaacaattccggtcgtaatgactacctcagcgtttcctggctgctggcgcccggagatgtggataactatgaggtaacattgtctcatgacggcaaggtggttcagtcccttgtcattgccaagtctgtcagagaatgttccttcagctccctcaccccaggccgcctctacaccgtgaccataactacaaggagtggcaagtatgaaaatcactccttcagccaagagcggacagtgcctgacaaagtccagggagtcagtgttagcaactcagccaggagtgactatttaagggtatcctgggtgcatgccactggagactttgatcactatgaagtcaccattaaaaacaaaaacaacttcattcaaactaaaagcattcccaagtcagaaaacgaatgtgtatttgttcagctagtccctggacggttgtacagtgtcactgttactacaaaaagtggacaatatgaagccaatgaacaagggaatgggagaacaattccagagcctgttaaggatctaacattgcgcaacaggagcactgaggacttgcatgtgacttggtcaggagctaatggggatgtcgaccaatatgagatccagctgctcttcaatgacatgaaagtatttcctccttttcaccttgtaaataccgcaaccgagtatcgatttacttccctaacaccaggccgccaatacaaaattcttgtcttgacgattagcggggatgtacagcagtcagccttcattgagggcttcacagttcctagtgctgtcaaaaatattcacatttctcccaatggagcaacagatagcctgacggtgaactggactcctggtgggggagacgttgattcctacacggtgtcggcattcaggcacagtcaaaaggttgactctcagactattcccaagcacgtctttgagcacacgttccacagactggaggccggggagcagtaccagatcatgattgcctcagtcagcgggtccctgaagaatcagataaatgtggttgggcggacagttccagcatctgtccaaggagtaattgcagacaatgcatacagcagttattccttaatagtaagttggcaaaaagctgctggtgtggcagaaagatatgatatcctgcttctaactgaaaatggaatccttctgcgcaacacatcagagccagccaccactaagcaacacaaatttgaagatctaacaccaggcaagaaatacaagatacagatcctaactgtcagtggaggcctctttagcaaggaagcccagactgaaggccgaacagtcccagcagctgtcaccgacctgaggatcacagagaactccaccaggcacctgtccttccgctggaccgcctcagagggggagctcagctggtacaacatctttttgtacaacccagatgggaatctccaggagagagctcaagttgacccactagtccagagcttctctttccagaacttgctacaaggcagaatgtacaagatggtgattgtaactcacagtggggagctgtctaatgagtctttcatatttggtagaacagtcccagcctctgtgagtcatctcagggggtccaatcggaacacgacagacagcctttggttcaactggagtccagcctctggggactttgacttttatgagctgattctctataatcccaatggcacaaagaaggaaaactggaaagacaaggacctgacggagtggcggtttcaaggccttgttcctggaaggaagtacgtgctgtgggtggtaactcacagtggagatctcagcaataaagtcacagcggagagcagaacagctccaagtcctcccagtcttatgtcatttgctgacattgcaaacacatccttggccatcacgtggaaagggcccccagactggacagactacaacgactttgagctgcagtggttgcccagagatgcacttactgtcttcaacccctacaac

SEQ ID NO: 171733 - DNA, 5839 bp, Homo sapiens
  Payload ID: 13756
  Gene Symbol: PTPRB
  Gene Name: protein tyrosine phosphatase, receptor type, B
  Uniprot ID: P23467
  ENST ID: ENST00000550857
  CDS Start-End: 30-5753
tctcctctggatcttaactactgagcgcaatgctgagccatggagccgggttggccttgtggatcacactgagcctgctgcagactggactggcggagccagagagatgtaacttcaccctggcggagtccaaggcctccagccattctgtgtctatccagtggagaattttgggctcaccctgtaactttagcctcatctatagcagtgacaccctgggggccgcgttgtgccctacctttcggatagacaacaccacatacggatgtaaccttcaagatttacaagcaggaaccatctataacttcaggattatttctctggatgaagagagaacagtggtcttgcaaacagatcctttacctcctgctaggtttggagtcagtaaagagaagacgacttcaaccagcttgcatgtttggtggactccttcttccggaaaagtcacctcatatgaggtgcaattatttgatgaaaataaccaaaagatacagggggttcaaattcaagaaagtacttcatggaatgaatacacttttttcaatctcactgctggtagtaaatacaatattgccatcacagctgtttctggaggaaaacgttctttttcagtttataccaatggatcaacagtgccatctccagtgaaagatattggtatttccacaaaagccaattctctcctgatttcctggtcccatggttctgggaatgtggaacgataccggctgatgctaatggataaagggatcctagttcatggcggtgttgtggacaaacatgctacttcctatgcttttcacgggctgacccctggctacctctacaacctcactgttatgactgaggctgcagggctgcaaaactacaggtggaaactagtcaggacagcccccatggaagtctcaaatctgaaggtgacaaatgatggcagtttgacctctctaaaagtcaaatggcaaagacctcctggaaatgtggattcttacaatatcaccctgtctcacaaagggaccatcaaggaatccagagtattagcaccttggattactgaaactcactttaaagagttagtccccggtcgactttatcaagttactgtcagctgtgtctctggtgaactgtctgctcagaagatggcagtgggcagaacattccccctggctgtcctccagcttcgtgtcaaacatgccaatgaaacctcactgagtatcatgtggcagacccctgtagcagaatgggagaaatacatcatttccctagctgacagagacctcttactgatccacaagtcactctccaaagatgccaaagaattcacttttactgacctggtgcctggacgaaaatacatggctacagtcaccagtattagtggagacttaaaaaattcctcttcagtaaaaggaagaacagtgcctgcccaagtgactgacttgcatgtggccaaccaaggaatgaccagtagtctgtttactaactggacccaggcacaaggagacgtagaattttaccaagtcttactgatccatgaaaatgtggtcattaaaaatgaaagcatctccagtgagaccagcagatacagcttccactctctcaagtccggcagcctgtactccgtggtggtaacaacagtgagtggagggatctcttcccgacaagtggttgtggagggaagaacagtcccttccagtgtgagtggagtaacggtgaacaattccggtcgtaatgactacctcagcgtttcctggctgctggcgcccggagatgtggataactatgaggtaacattgtctcatgacggcaaggtggttcagtcccttgtcattgccaagtctgtcagagaatgttccttcagctccctcaccccaggccgcctctacaccgtgaccataactacaaggagtggcaagtatgaaaatcactccttcagccaagagcggacagtgcctgacaaagtccagggagtcagtgttagcaactcagccaggagtgactatttaagggtatcctgggtgcatgccactggagactttgatcactatgaagtcaccattaaaaacaaaaacaacttcattcaaactaaaagcattcccaagtcagaaaacgaatgtgtatttgttcagctagtccctggacggttgtacagtgtcactgttactacaaaaagtggacaatatgaagccaatgaacaagggaatgggagaacaattccagagcctgttaaggatctaacattgcgcaacaggagcactgaggacttgcatgtgacttggtcaggagctaatggggatgtcgaccaatatgagatccagctgctcttcaatgacatgaaagtatttcctccttttcaccttgtaaataccgcaaccgagtatcgatttacttccctaacaccaggccgccaatacaaaattcttgtcttgacgattagcggggatgtacagcagtcagccttcattgagggcttcacagttcctagtgctgtcaaaaatattcacatttctcccaatggagcaacagatagcctgacggtgaactggactcctggtgggggagacgttgattcctacacggtgtcggcattcaggcacagtcaaaaggttgactctcagactattcccaagcacgtctttgagcacacgttccacagactggaggccggggagcagtaccagatcatgattgcctcagtcagcgggtccctgaagaatcagataaatgtggttgggcggacagttccagcatctgtccaaggagtaattgcagacaatgcatacagcagttattccttaatagtaagttggcaaaaagctgctggtgtggcagaaagatatgatatcctgcttctaactgaaaatggaatccttctgcgcaacacatcagagccagccaccactaagcaacacaaatttgaagatctaacaccaggcaagaaatacaagatacagatcctaactgtcagtggaggcctctttagcaaggaagcccagactgaaggccgaacagtcccagcagctgtcaccgacctgaggatcacagagaactccaccaggcacctgtccttccgctggaccgcctcagagggggagctcagctggtacaacatctttttgtacaacccagatgggaatctccaggagagagctcaagttgacccactagtccagagcttctctttccagaacttgctacaaggcagaatgtacaagatggtgattgtaactcacagtggggagctgtctaatgagtctttcatatttggtagaacagtcccagcctctgtgagtcatctcagggggtccaatcggaacacgacagacagcctttggttcaactggagtccagcctctggggactttgacttttatgagctgattctctataatcccaatggcacaaagaaggaaaactggaaagacaaggacctgacggagtggcggtttcaaggccttgttcctggaaggaagtacgtgctgtgggtggtaactcacagtggagatctcagcaataaagtcacagcggagagcagaacagctccaagtcctcccagtcttatgtcatttgctgacattgcaaacacatccttggccatcacgtggaaagggcccccagactggacagactacaacgactttgagctgcagtggttgcccagagatgcacttactgtcttcaacccctacaacaacagaaaatcagaaggacgcattgtgtatggtcttcgtccagggagatcctatcaattcaacgtcaagactgtcagtggtgattcctggaaaacttacagcaaaccaatttttggatctgtgaggacaaagcctgacaagatacaaaacctgcattgccggcctcagaactccacggccattgcctgttcttggatccctcctgattctgactttgatggttatagtattgaatgccggaaaatggacacccaagaagttgagttttccagaaagctggagaaagaaaaatctctgctcaacatcatgatgctagtgccccataagaggtacctggtgtccatcaaagtgcagtcggccggcatgaccagcgaggtggttgaagacagcactatcacaatgatagaccgcccccctcctccacccccacacattcgtgtgaatgaaaaggatgtgctaattagcaagtcttccatcaactttactgtcaactgcagctggttcagcgacaccaatggagctgtgaaatacttcacagtggtggtgagagaggctgatggcagtgatgagctgaagccagaacagcagcaccctctcccttcctacctggagtacaggcacaatgcctccattcgggtgtatcagactaattattttgccagcaaatgtgccgaaaatcctaacagcaactccaagagttttaacattaagcttggagcagagatggagagcctaggtggaaaatgcgatcccactcagcaaaaattctgtgatggaccactgaagccacacactgcctacagaatcagcattcgagcttttacacagctctttgatgaggacctgaaggaattcacaaagccactctattcagacacatttttttctttacccatcactactgaatcagagcccttgtttggagctattgaaggtgtgagtgctggtctgtttttaattggcatgctagtggctgttgttgccttattgatctgcagacagaaagtgagccatggtcgagaaagaccctctgcccgtctgagcattcgtagggatcgaccattatctgtccacttaaacctgggccagaaaggtaaccggaaaacttcttgtccaataaaaataaatcagtttgaagggcatttcatgaagctacaggctgactccaactaccttctatccaaggaatacgaggagttaaaagacgtgggccgaaaccagtcatgtgacattgcactcttgccggagaatagagggaaaaatcgatacaacaatatattgccctatgatgccacgcgagtgaagctctccaatgtagatgatgatccttgctctgactacatcaatgccagctacatccctggcaacaacttcagaagagaatacattgtcactcagggaccgcttcctggcaccaaggatgacttctggaaaatggtgtgggaacaaaacgttcacaacatcgtcatggtgacccagtgtgttgagaagggccgagtaaagtgtgatcattactggccagcggaccaggattccctctactatggggacctcatcctgcagatgctctcagagtccgtcctgcctgagtggaccatccgggagtttaagatatgcggtgaggaacagcttgatgcacacagactcatccgccactttcactatacggtgtggccagaccatggagtcccagaaaccacccagtctctgatccagtttgtgagaactgtcagggactacatcaacagaagcccgggtgctgggcccactgtggtgcactgcagtgctggtgtgggtaggactggaacctttattgcattggaccgaatcctccagcagttagactccaaagactctgtggacatttatggagcagtgcacgacctaagacttcacagggttcacatggtccagactgagtgtcagtatgtctacctacatcagtgtgtaagagatgtcctcagagcaagaaagctacggagtgaacaagaaaaccccttgtttccaatctatgaaaatgtgaatccagagtatcacagagatccagtctattcaaggcattgagaatgtacctgaagagctcctggataaaaattattcactgtgtgatttgtttttaaaaacttgcttcatgccctacagaggtgcca

SEQ ID NO: 171734 - DNA, 6583 bp, Homo sapiens
  Payload ID: 13756
  Gene Symbol: PTPRB
  Gene Name: protein tyrosine phosphatase, receptor type, B
  ENST ID: ENST00000550358
  CDS Start-End: 27-6410
aagcatgaacagttgctaagtggaaaatggaggctgaattttacatggtgattcttacctgcttgatcttcaggaactcagaagggtttcagattgtccatgtccagaaacaacagtgtcttttcaaaaatgagaaagtggtcgtgggctcatgcaacaggaccatccagaaccagcagtggatgtggactgaggatgaaaagctccttcatgttaaatctgcactgtgcttggccatctccaactcttcccgcggcccctcccgctcagccatcttggaccgctgttcccaggcaccccgatggacctgctatgatcaggaaggcttccttgaggtggaaaatgcctctctctttctccagaaacaaggctccagagtagtggtcaagaaggccaggaaatacctccatagctggatgaaaatagatgtcaacaaggagggaaaactggtcaatgaaagcctctgtttacaaaaagctggcctgggagcagaagtttcggtgaggagcactagaaacacggctccaccccagattctcactacctttaatgcagttccagatggcctggtattccttattaggaataccacagaggccttcatcagaaatgctgcagaaaactacagccaaaacagcagcgagaggcagcatcccaatctgcacatgactggaattacagacacatcatgggttttgtcgactactcagcccttctccagcaccactgaagagactggactggcggagccagagagatgtaacttcaccctggcggagtccaaggcctccagccattctgtgtctatccagtggagaattttgggctcaccctgtaactttagcctcatctatagcagtgacaccctgggggccgcgttgtgccctacctttcggatagacaacaccacatacggatgtaaccttcaagatttacaagcaggaaccatctataacttcaggattatttctctggatgaagagagaacagtggtcttgcaaacagatcctttacctcctgctaggtttggagtcagtaaagagaagacgacttcaaccagcttgcatgtttggtggactccttcttccggaaaagtcacctcatatgaggtgcaattatttgatgaaaataaccaaaagatacagggggttcaaattcaagaaagtacttcatggaatgaatacacttttttcaatctcactgctggtagtaaatacaatattgccatcacagctgtttctggaggaaaacgttctttttcagtttataccaatggatcaacagtgccatctccagtgaaagatattggtatttccacaaaagccaattctctcctgatttcctggtcccatggttctgggaatgtggaacgataccggctgatgctaatggataaagggatcctagttcatggcggtgttgtggacaaacatgctacttcctatgcttttcacgggctgacccctggctacctctacaacctcactgttatgactgaggctgcagggctgcaaaactacaggtggaaactagtcaggacagcccccatggaagtctcaaatctgaaggtgacaaatgatggcagtttgacctctctaaaagtcaaatggcaaagacctcctggaaatgtggattcttacaatatcaccctgtctcacaaagggaccatcaaggaatccagagtattagcaccttggattactgaaactcactttaaagagttagtccccggtcgactttatcaagttactgtcagctgtgtctctggtgaactgtctgctcagaagatggcagtgggcagaacatttccagacaaagttgcaaacctggaggcaaacaataatggcaggatgaggtctcttgtagtgagctggtcgccccctgctggagactgggagcagtatcggatcctactcttcaatgattctgtggtgctgctcaacatcactgtgggaaaggaagaaacacagtatgtcatggatgacacggggctcgtaccgggaagacagtatgaggtggaagtcattgttgagagtggaaatttgaagaattctgagcgttgccaaggcaggacagtccccctggctgtcctccagcttcgtgtcaaacatgccaatgaaacctcactgagtatcatgtggcagacccctgtagcagaatgggagaaatacatcatttccctagctgacagagacctcttactgatccacaagtcactctccaaagatgccaaagaattcacttttactgacctggtgcctggacgaaaatacatggctacagtcaccagtattagtggagacttaaaaaattcctcttcagtaaaaggaagaacagtgcctgcccaagtgactgacttgcatgtggccaaccaaggaatgaccagtagtctgtttactaactggacccaggcacaaggagacgtagaattttaccaagtcttactgatccatgaaaatgtggtcattaaaaatgaaagcatctccagtgagaccagcagatacagcttccactctctcaagtccggcagcctgtactccgtggtggtaacaacagtgagtggagggatctcttcccgacaagtggttgtggagggaagaacagtgcctgacaaagtccagggagtcagtgttagcaactcagccaggagtgactatttaagggtatcctgggtgcatgccactggagactttgatcactatgaagtcaccattaaaaacaaaaacaacttcattcaaactaaaagcattcccaagtcagaaaacgaatgtgtatttgttcagctagtccctggacggttgtacagtgtcactgttactacaaaaagtggacaatatgaagccaatgaacaagggaatgggagaacaattccagagcctgttaaggatctaacattgcgcaacaggagcactgaggacttgcatgtgacttggtcaggagctaatggggatgtcgaccaatatgagatccagctgctcttcaatgacatgaaagtatttcctccttttcaccttgtaaataccgcaaccgagtatcgatttacttccctaacaccaggccgccaatacaaaattcttgtcttgacgattagcggggatgtacagcagtcagccttcattgagggcttcacagttcctagtgctgtcaaaaatattcacatttctcccaatggagcaacagatagcctgacggtgaactggactcctggtgggggagacgttgattcctacacggtgtcggcattcaggcacagtcaaaaggttgactctcagactattcccaagcacgtctttgagcacacgttccacagactggaggccggggagcagtaccagatcatgattgcctcagtcagcgggtccctgaagaatcagataaatgtggttgggcggacagttccagcatctgtccaaggagtaattgcagacaatgcatacagcagttattccttaatagtaagttggcaaaaagctgctggtgtggcagaaagatatgatatcctgcttctaactgaaaatggaatccttctgcgcaacacatcagagccagccaccactaagcaacacaaatttgaagatctaacaccaggcaagaaatacaagatacagatcctaactgtcagtggaggcctctttagcaaggaagcccagactgaaggccgaacagtcccagcagctgtcaccgacctgaggatcacagagaactccaccaggcacctgtccttccgctggaccgcctcagagggggagctcagctggtacaacatctttttgtacaacccagatgggaatctccaggagagagctcaagttgacccactagtccagagcttctctttccagaacttgctacaaggcagaatgtacaagatggtgattgtaactcacagtggggagctgtctaatgagtctttcatatttggtagaacagtcccagcctctgtgagtcatctcagggggtccaatcggaacacgacagacagcctttggttcaactggagtccagcctctggggactttgacttttatgagctgattctctataatcccaatggcacaaagaaggaaaactggaaagacaaggacctgacggagtggcggtttcaaggccttgttcctggaaggaagtacgtgctgtgggtggtaactcacagtggagatctcagcaataaagtcacagcggagagcagaacagctccaagtcctcccagtcttatgtcatttgctgacattgcaaacacatccttggccatcacgtggaaagggcccccagactggacagactacaacgactttgagctgcagtggttgcccagagatgcacttactgtcttcaacccctacaacaacagaaaatcagaaggacgcattgtgtatggtcttcgtccagggagatcctatcaattcaacgtcaagactgtcagtggtgattcctggaaaacttacagcaaaccaatttttggatctgtgaggacaaagcctgacaagatacaaaacctgcattgccggcctcagaactccacggccattgcctgttcttggatccctcctgattctgactttgatggttatagtattgaatgccggaaaatggacacccaagaagttgagttttccagaaagctggagaaagaaaaatctctgctcaacatcatgatgctagtgccccataagaggtacctggtgtccatcaaagtgcagtcggccggcatgaccagcgaggtggttgaagacagcactatcacaatgatagaccgcccccctcctccacccccacacattcgtgtgaatgaaaaggatgtgctaattagcaagtcttccatcaactttactgtcaactgcagctggttcagcgacaccaatggagctgtgaaatacttcacagtggtggtgagagaggctgatggcagtgatgagctgaagccagaacagcagcaccctctcccttcctacctggagtacaggcacaatgcctccattcgggtgtatcagactaattattttgccagcaaatgtgccgaaaatcctaacagcaactccaagagttttaacattaagcttggagcagagatggagagcctaggtggaaaatgcgatcccactcagcaaaaattctgtgatggaccactgaagccacacactgcctacagaatcagcattcgagcttttacacagctctttgatgaggacctgaaggaattcacaaagccactctattcagacacatttttttctttacccatcactactgaatcagagcccttgtttggagctattgaaggtgtgagtgctggtctgtttttaattggcatgctagtggctgttgttgccttattgatctgcagacagaaagtgagccatggtcgagaaagaccctctgcccgtctgagcattcgtagggatcgaccattatctgtccacttaaacctgggccagaaaggtaaccggaaaacttcttgtccaataaaaataaatcagtttgaagggcatttcatgaagctacaggctgactccaactaccttctatccaaggaatacgaggagttaaaagacgtgggccgaaaccagtcatgtgacattgcactcttgccggagaatagagggaaaaatcgatacaacaatatattgccctatgatgccacgcgagtgaagctctccaatgtagatgatgatccttgctctgactacatcaatgccagctacatccctggcaacaacttcagaagagaatacattgtcactcagggaccgcttcctggcaccaaggatgacttctggaaaatggtgtgggaacaaaacgttcacaacatcgtcatggtgacccagtgtgttgagaagggccgagtaaagtgtgatcattactggccagcggaccaggattccctctactatggggacctcatcctgcagatgctctcagagtccgtcctgcctgagtggaccatccgggagtttaagatatgcggtgaggaacagcttgatgcacacagactcatccgccactttcactatacggtgtggccagaccatggagtcccagaaaccacccagtctctgatccagtttgtgagaactgtcagggactacatcaacagaagcccgggtgctgggcccactgtggtgcactgcagtgctggtgtgggtaggactggaacctttattgcattggaccgaatcctccagcagttagactccaaagactctgtggacatttatggagcagtgcacgacctaagacttcacagggttcacatggtccagactgagtgtcagtatgtctacctacatcagtgtgtaagagatgtcctcagagcaagaaagctacggagtgaacaagaaaaccccttgtttccaatctatgaaaatgtgaatccagagtatcacagagatccagtctattcaaggcattgagaatgtacctgaagagctcctggataaaaattattcactgtgtgatttgtttttaaaaacttgcttcatgccctacagaggtgccagctatttctgttgatactatgtataatttattaatctggagaatgtttaaaattttatataatttaaaggtaacagatattattgta

SEQ ID NO: 171735 - DNA, 5291 bp, Homo sapiens
  Payload ID: 13756
  Gene Symbol: PTPRB
  Gene Name: protein tyrosine phosphatase, receptor type, B
  ENST ID: ENST00000551525
  CDS Start-End: 26-4777
agcatgaacagttgctaagtggaaaatggaggctgaattttacatggtgattcttacctgcttgatcttcaggaactcagggtttcagattgtccatgtccagaaacaacagtgtcttttcaaaaatgagaaagtggtcgtgggctcatgcaacaggaccatccagaaccagcagtggatgtggactgaggatgaaaagctccttcatgttaaatctgcactgtgcttggccatctccaactcttcccgcggcccctcccgctcagccatcttggaccgctgttcccaggcaccccgatggacctgctatgatcaggaaggcttccttgaggtggaaaatgcctctctctttctccagaaacaaggctccagagtagtggtcaagaaggccaggaaatacctccatagctggatgaaaatagatgtcaacaaggagggaaaactggtcaatgaaagcctctgtttacaaaaagctggcctgggagcagaagtttcggtgaggagcactagaaacacggctccaccccagattctcactacctttaatgcagttccagatggcctggtattccttattaggaataccacagaggccttcatcagaaatgctgcagaaaactacagccaaaacagcagcgagaggcagcatcccaatctgcacatgactggaattacagacacatcatgggttttgtcgactactcagcccttctccagcaccactgaagagactggactggcggagccagagagatgtaacttcaccctggcggagtccaaggcctccagccattctgtgtctatccagtggagaattttgggctcaccctgtaactttagcctcatctatagcagtgacaccctgggggccgcgttgtgccctacctttcggatagacaacaccacatacggatgtaaccttcaagatttacaagcaggaaccatctataacttcaggattatttctctggatgaagagagaacagtggtcttgcaaacagatcctttacctcctgctaggtttggagtcagtaaagagaagacgacttcaaccagcttgcatgtttggtggactccttcttccggaaaagtcacctcatatgaggtgcaattatttgatgaaaataaccaaaagatacagggggttcaaattcaagaaagtacttcatggaatgaatacacttttttcaatctcactgctggtagtaaatacaatattgccatcacagctgtttctggaggaaaacgttctttttcagtttataccaatggatcaacagtgccatctccagtgaaagatattggtatttccacaaaagccaattctctcctgatttcctggtcccatggttctgggaatgtggaacgataccggctgatgctaatggataaagggatcctagttcatggcggtgttgtggacaaacatgctacttcctatgcttttcacgggctgacccctggctacctctacaacctcactgttatgactgaggctgcagggctgcaaaactacaggtggaaactagtcaggacagcccccatggaagtctcaaatctgaaggtgacaaatgatggcagtttgacctctctaaaagtcaaatggcaaagacctcctggaaatgtggattcttacaatatcaccctgtctcacaaagggaccatcaaggaatccagagtattagcaccttggattactgaaactcactttaaagagttagtccccggtcgactttatcaagttactgtcagctgtgtctctggtgaactgtctgctcagaagatggcagtgggcagaacatttccagacaaagttgcaaacctggaggcaaacaataatggcaggatgaggtctcttgtagtgagctggtcgccccctgctggagactgggagcagtatcggatcctactcttcaatgattctgtggtgctgctcaacatcactgtgggaaaggaagaaacacagtatgtcatggatgacacggggctcgtaccgggaagacagtatgaggtggaagtcattgttgagagtggaaatttgaagaattctgagcgttgccaaggcaggacagtccccctggctgtcctccagcttcgtgtcaaacatgccaatgaaacctcactgagtatcatgtggcagacccctgtagcagaatgggagaaatacatcatttccctagctgacagagacctcttactgatccacaagtcactctccaaagatgccaaagaattcacttttactgacctggtgcctggacgaaaatacatggctacagtcaccagtattagtggagacttaaaaaattcctcttcagtaaaaggaagaacagtgcctgcccaagtgactgacttgcatgtggccaaccaaggaatgaccagtagtctgtttactaactggacccaggcacaaggagacgtagaattttaccaagtcttactgatccatgaaaatgtggtcattaaaaatgaaagcatctccagtgagaccagcagatacagcttccactctctcaagtccggcagcctgtactccgtggtggtaacaacagtgagtggagggatctcttcccgacaagtggttgtggagggaagaacagtcccttccagtgtgagtggagtaacggtgaacaattccggtcgtaatgactacctcagcgtttcctggctgctggcgcccggagatgtggataactatgaggtaacattgtctcatgacggcaaggtggttcagtcccttgtcattgccaagtctgtcagagaatgttccttcagctccctcaccccaggccgcctctacaccgtgaccataactacaaggagtggcaagtatgaaaatcactccttcagccaagagcggacagtgcctgacaaagtccagggagtcagtgttagcaactcagccaggagtgactatttaagggtatcctgggtgcatgccactggagactttgatcactatgaagtcaccattaaaaacaaaaacaacttcattcaaactaaaagcattcccaagtcagaaaacgaatgtgtatttgttcagctagtccctggacggttgtacagtgtcactgttactacaaaaagtggacaatatgaagccaatgaacaagggaatgggagaacaattccagagcctgttaaggatctaacattgcgcaacaggagcactgaggacttgcatgtgacttggtcaggagctaatggggatgtcgaccaatatgagatccagctgctcttcaatgacatgaaagtatttcctccttttcaccttgtaaataccgcaaccgagtatcgatttacttccctaacaccaggccgccaatacaaaattcttgtcttgacgattagcggggatgtacagcagtcagccttcattgagggcttcacagttcctagtgctgtcaaaaatattcacatttctcccaatggagcaacagatagcctgacggtgaactggactcctggtgggggagacgttgattcctacacggtgtcggcattcaggcacagtcaaaaggttgactctcagactattcccaagcacgtctttgagcacacgttccacagactggaggccggggagcagtaccagatcatgattgcctcagtcagcgggtccctgaagaatcagataaatgtggttgggcggacagttccagcatctgtccaaggagtaattgcagacaatgcatacagcagttattccttaatagtaagttggcaaaaagctgctggtgtggcagaaagatatgatatcctgcttctaactgaaaatggaatccttctgcgcaacacatcagagccagccaccactaagcaacacaaatttgaagatctaacaccaggcaagaaatacaagatacagatcctaactgtcagtggaggcctctttagcaaggaagcccagactgaaggccgaacagtcccagcagctgtcaccgacctgaggatcacagagaactccaccaggcacctgtccttccgctggaccgcctcagagggggagctcagctggtacaacatctttttgtacaacccagatgggaatctccaggagagagctcaagttgacccactagtccagagcttctctttccagaacttgctacaaggcagaatgtacaagatggtgattgtaactcacagtggggagctgtctaatgagtctttcatatttggtagaacagtcccagcctctgtgagtcatctcagggggtccaatcggaacacgacagacagcctttggttcaactggagtccagcctctggggactttgacttttatgagctgattctctataatcccaatggcacaaagaaggaaaactggaaagacaaggacctgacggagtggcggtttcaaggccttgttcctggaaggaagtacgtgctgtgggtggtaactcacagtggagatctcagcaataaagtcacagcggagagcagaacagctccaagtcctcccagtcttatgtcatttgctgacattgcaaacacatccttggccatcacgtggaaagggcccccagactggacagactacaacgactttgagctgcagtggttgcccagagatgcacttactgtcttcaacccctacaacaacagaaaatcagaaggacgcattgtgtatggtcttcgtccagggagatcctatcaattcaacgtcaagactgtcagtggtgattcctggaaaacttacagcaaaccaatttttggatctgtgaggacaagtatgacatgttttgctactcttatttctcaaatggagtagaggaagtatatgttcaacatcttactcaaatagggcttggattaaatccatatttttacatgggattggtctggatttgaattcaggcagaagtctctgtagatttgttcgttcattcaacattaacaacaagggacaataaatctctctctgccctcatggggcttacaattaggtaggacgtactatttgtaaatagacattatattttgggtgtgatgagggaagtaaatggtactatggagacacttgttaggtaatctgacccaatacaagagaacttcttggaaaaggaaacatccaaatagaaacctaaagcaagagatttaccaggtagaggtaggggaagaagtggagaatattccaggtagagagaataaaatattccaagatgagagaggagggagagtacaagatctaccaataggggaacagaaagaagtttatttggccatagcataaaaggtgaggattaagggaatcagataataaaatattttgtattccatggtaa

SEQ ID NO: 171736 - DNA, 4626 bp, Homo sapiens
  Payload ID: 13757
  Gene Symbol: PTPRC
  Gene Name: protein tyrosine phosphatase, receptor type, C
  ENST ID: ENST00000348564
  CDS Start-End: 87-3524
agaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactgatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgagataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataa

SEQ ID NO: 171737 - DNA, 1017 bp, Homo sapiens
  Payload ID: 13757
  Gene Symbol: PTPRC
  Gene Name: protein tyrosine phosphatase, receptor type, C
  ENST ID: ENST00000367364
  CDS Start-End: 85-195
aggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactggtaagaattaatatttatatttttactaattttattttcttgttgcaaagtttatatatttaactacaattttctattattaacactgaaattatttttaaggataaattttataatcatgagtgattcttgacattcacttgttcttaaactttctgcttatacgttatagagtttaataactacctaaacatgttattaaatttgtatatatattttgtgtataaatagtaacttttcccaaacttgacagtaaatcacacaacaggtttctactctcttttaatattttaagactataaaaaaatgcatttaaattagataacaaaattttatagtctgaaagcaggttaacagctgtctatgtatgttatagatatgtagataacagatttgcatatgtctatatttctttaagagtatgttgcttttttcaatggtatgcaaaacctttgagactattgagatatttttaaataataattttcaaattctactgaacacttcaatagtccttataaatgtcttaatcatgagataaatttaaaacacagagatgctgcaaataaattcatacatagtacatacaaaataagagaaaaaattaaattgcagatggttaaatatcacatcacttaactgatgttactgaaaatgtattttcctgcataatcatatggttgacagtatgcattaagaaggtaagtaaaacaatgaagacaattttgatttaatatggtaatgcacaattccaactaacgtacattcaacagatcatgaaattgggttattaaaatgaatatttttgtcattaaataaaaattccgtccaaa

SEQ ID NO: 171738 - DNA, 2291 bp, Homo sapiens
  Payload ID: 13757
  Gene Symbol: PTPRC
  Gene Name: protein tyrosine phosphatase, receptor type, C
  ENST ID: ENST00000367367
  CDS Start-End: 87-2291
agaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgtcccaggagagaggagtacagccagcacctttcctacagacccagtttccccattgacaaccaccctcagccttgcacaccacagctctgctgccttacctgcacgcacctccaacaccaccatcacagcgaacacctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgagataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaat

SEQ ID NO: 171739 - DNA, 517 bp, Homo sapiens
  Payload ID: 13757
  Gene Symbol: PTPRC
  Gene Name: protein tyrosine phosphatase, receptor type, C
  ENST ID: ENST00000367379
  CDS Start-End: 72-517
tagttttttcattcatttggccgtctcaaaggacgcatgctgtttcttagggacacggctgacttccagatatgaccatgtatttgtggcttaaactcttggcatttggctttgcctttctggacacagaagtatttgtgacagggcaaagcccaacaccttcccccactgatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatga

SEQ ID NO: 171740 - DNA, 462 bp, Homo sapiens
  Payload ID: 13757
  Gene Symbol: PTPRC
  Gene Name: protein tyrosine phosphatase, receptor type, C
  ENST ID: ENST00000418674
  CDS Start-End: 108-462
acatttttgattcgtttttacagagaaaaacttctacagagataacaattattttgcttttcagaaggacgcatgctgtttcttagggacacggctgacttccagatatgaccatgtatttgtggcttaaactcttggcatttggctttgcctttctggacacagaagtatttgtgacagggcaaagcccaacaccttcccccactggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttaataccacaggtgtttcatcagtacagacgcctcaccttcccacgcacgcagactcgcagacgccct

SEQ ID NO: 171741 - DNA, 1338 bp, Homo sapiens
  Payload ID: 13757
  Gene Symbol: PTPRC
  Gene Name: protein tyrosine phosphatase, receptor type, C
  ENST ID: ENST00000413409
  CDS Start-End: 85-348
aggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactggccatctgcaagctgaggagcaaggaagccaatccaagtcaccaaacctcaaaagtagggaagctgacagttcagccttcagttggtggccaaaggcccgagagcccctcacaaaccactggagtaagtccaagagtccaaaagctgaggaacttggagtctgatgttcaagagcaggaagcagccagcacgagagaaagatgaagaccagaagactcagcaagctcacttctcctaccttcttgtgcctgctttttctagccgtgctggcagttgcttggatgatgcccactcatattgggtgggggtgggggggttggggagggtctgcctcccccagtccactgactcaaatgttaatctcccttggcaatacgctcacaggcacacccaggaacaatactttgcatccttcaatccaatcaagttgacactcaatattaaccatcaaatactattataaggagaatgttgcatgattttccttctagtctgtttgtaattcacatctaatgaaagagtgagagtggacgataaagggaacttgttgaaacatttctctcaaagcaaaagggatcattggaagcaggcagacaccagaattggtttaacctaaaaataacaaattaataattatcaagtctataatgatgacagtgacttaatgtgaatagaaagaattctaaactctctccttccttcctccctcccttctttcctactttctttccactccctttctcccacccccttttcttttcctttcttttctcccaccctctctccctccctttcttttattcaatgcatagtagttgaaaaaatctaaagttagacctgattttacactgaagactagaggtagttactatcctattactgtacttagttggctatgctggcatgtcattatgggtaaaagtttgatggatttatttgtgagttatttggttatgaaaatctagagattgaagtttttcattagaaaataacacacataacaagtctatgatcattttgcatttctgtaatcacagaatagttctgcaatatttcatgtatattggaattgaagttcaattgaattttatctgtatttagtaaaaattaactttagctttgatactaatgaataaagctgggttttttattta

SEQ ID NO: 171742 - DNA, 5164 bp, Homo sapiens
  Payload ID: 13757
  Gene Symbol: PTPRC
  Gene Name: protein tyrosine phosphatase, receptor type, C
  ENST ID: ENST00000442510
  CDS Start-End: 142-4062
gacatcatcacctagcagttcatgcagctagcaagtggtttgttcttagggtaacagaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttaataccacaggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgtcccaggagagaggagtacagccagcacctttcctacagacccagtttccccattgacaaccaccctcagccttgcacaccacagctctgctgccttacctgcacgcacctccaacaccaccatcacagcgaacacctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgagataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataa

SEQ ID NO: 171743 - DNA, 1962 bp, Homo sapiens
  Payload ID: 13757
  Gene Symbol: PTPRC
  Gene Name: protein tyrosine phosphatase, receptor type, C
  ENST ID: ENST00000530727
  CDS Start-End: 163-1962
gaagttagtaaaaccgaatctgacatcatcacctagcagttcatgcagctagcaagtggtttgttcttagggtaacagaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgagataaacggagatgcagggtcaaactacataaatgccagctatattgat

SEQ ID NO: 171744 - DNA, 1017 bp, Homo sapiens; identical to SEQ ID NO: 171737
  Payload ID: 13757
  Gene Symbol: PTPRC
  Gene Name: protein tyrosine phosphatase, receptor type, C
  ENST ID: ENST00000570609
  CDS Start-End: 91-195

SEQ ID NO: 171745 - DNA, 1861 bp, Homo sapiens
  Payload ID: 13757
  Gene Symbol: PTPRC
  Gene Name: protein tyrosine phosphatase, receptor type, C
  Uniprot ID: P08575
  ENST ID: ENST00000573679
  CDS Start-End: 148-1861
gacatcatcacctagcagttcatgcagctagcaagtggtttgttcttagggtaacagaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttaataccacaggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgtcccaggagagaggagtacagccagcacctttcctacagacccagtttccccattgacaaccaccctcagccttgcacaccacagctctgctgccttacctgcacgcacctccaacaccaccatcacagcgaacacctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatctt

SEQ ID NO: 171746 - DNA, 1338 bp, Homo sapiens; identical to SEQ ID NO: 171741
  Payload ID: 13757
  Gene Symbol: PTPRC
  Gene Name: protein tyrosine phosphatase, receptor type, C
  ENST ID: ENST00000571847
  CDS Start-End: 91-348

SEQ ID NO: 171747 - DNA, 1608 bp, Homo sapiens
  Payload ID: 13757
  Gene Symbol: PTPRC
  Gene Name: protein tyrosine phosphatase, receptor type, C
  ENST ID: ENST00000576833
  CDS Start-End: 93-1608
agaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgtcccaggagagaggagtacagccagcacctttcctacagacccagtttccccattgacaaccaccctcagccttgcacaccacagctctgctgccttacctgcacgcacctccaacaccaccatcacagcgaacacctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatctt

SEQ ID NO: 171748 - DNA, 517 bp, Homo sapiens; identical to SEQ ID NO: 171739
  Payload ID: 13757
  Gene Symbol: PTPRC
  Gene Name: protein tyrosine phosphatase, receptor type, C
  ENST ID: ENST00000573298
  CDS Start-End: 78-517

SEQ ID NO: 171749 - DNA, 1323 bp, Homo sapiens
  Payload ID: 13757
  Gene Symbol: PTPRC
  Gene Name: protein tyrosine phosphatase, receptor type, C
  Uniprot ID: P08575
  ENST ID: ENST00000573477
  CDS Start-End: 93-1323
agaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactgatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatctt

SEQ ID NO: 171750 - DNA, 1540 bp, Homo sapiens
  Payload ID: 13757
  Gene Symbol: PTPRC
  Gene Name: protein tyrosine phosphatase, receptor type, C
  ENST ID: ENST00000575923
  CDS Start-End: 169-1540
gaagttagtaaaaccgaatctgacatcatcacctagcagttcatgcagctagcaagtggtttgttcttagggtaacagaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatctt

SEQ ID NO: 171751 - DNA, 462 bp, Homo sapiens; identical to SEQ ID NO: 171740
  Payload ID: 13757
  Gene Symbol: PTPRC
  Gene Name: protein tyrosine phosphatase, receptor type, C
  ENST ID: ENST00000573971
  CDS Start-End: 114-462

SEQ ID NO: 171752 - DNA, 2336 bp, Homo sapiens
  Payload ID: 13757
  Gene Symbol: PTPRC
  Gene Name: protein tyrosine phosphatase, receptor type, C
  ENST ID: ENST00000529828
  CDS Start-End: 78-2336
aattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttaataccacaggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgagataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaat

SEQ ID NO: 171753 - DNA, 1653 bp, Homo sapiens
  Payload ID: 13757
  Gene Symbol: PTPRC
  Gene Name: protein tyrosine phosphatase, receptor type, C
  ENST ID: ENST00000574441
  CDS Start-End: 84-1653
aattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttaataccacaggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatctt

SEQ ID NO: 171754 - DNA, 408 bp, Homo sapiens
  Payload ID: 13757
  Gene Symbol: PTPRC
  Gene Name: protein tyrosine phosphatase, receptor type, C
  ENST ID: ENST00000574718
  CDS Start-End: 1-275
ttaaactcttggcatttggctttgcctttctggacacagaagtatttggcaaagcccaacaccttcccccactggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgtcccaggagagaggagtacagccagcacctttcctacagacccagtttccccattgacaaccaccctcagccttgcacaccacagctctgctgccttacctgcacgcacctccaacaccaccatcacagcgaacacctcagatgcctaccttaatgcctctgaaacaaccactctgagcccttctggaag

SEQ ID NO: 171755 - DNA, 1292 bp, Homo sapiens
  Payload ID: 13758
  Gene Symbol: PTPRCAP
  Gene Name: protein tyrosine phosphatase, receptor type, C-associated protein
  Uniprot ID: Q14761
  ENST ID: ENST00000326294
  CDS Start-End: 449-1069
aaattctctttctaaaagccaggctgacctgctgctgcaagggtggggctgagaagtctggaaacctggagacagaggatgtcacaggagtcacacatgtgcagaaggtctgggggcagtgagcagccccacaggcattgctcccctggattgtcaggcagggaaactgaggcagaagacctgagaacacatgcaaggctgcatccagcttcaagttggtgctgcttcttccttggaggacaggcccggcagcccagcctcctccagagagactggggagggtctggtgtggaccaggggtcctgcagcagggaggggcaggtggggtatgtgggcaggaagcggaagcctgggccacccttcactgcagacgagcactgagctcacttctcgctcgacacagccagagctggaggtgggtgcccggcacggaggggcctgcggaccaatggctctgccctgcaccttagggctcgggatgctgctggccctgccaggggccttgggctcgggtggcagcgcggaggacagcgtgggctccagctctgtcaccgttgtcctgctgctgctgctgctcctactgctggccactggcctagcactggcctggcgccgcctcagccgtgactcagggggctactaccacccggcccgcctaggtgccgcgctgtggggccgcacgcggcgcctgctctgggccagccccccaggtcgctggctgcaggcccgagctgagctggggtccacagacaatgaccttgagcgacaggaggatgagcaggacacagactatgaccacgtcgcggatggtggcctgcaggctgaccctggggaaggcgagcagcaatgtggagaggcgtccagcccagagcaggtccccgtgcgggctgaggaagccagagacagtgacacggagggcgacctggtcctcggctccccaggaccagcgagcgcagggggcagtgctgaggccctgctgagtgacctgcacgcctttgctggcagcgcagcctgggatgacagcgccagggcagctgggggccagggcctccatgtcaccgcactgtagaggccggtcttggtgtcccatccctgtcacagccgctcactccccgtgcctctgcttcccaagatgccatggctggactggacccccagcccacatgaccatgcctcagactgtcaccccctaccagttcccaagtccatgtgtaccccgctcaccacgggaacggccccccccaaccacaggcatcaggcaaccatttgaaataaaactccttcagcctgtg

SEQ ID NO: 171756 - DNA, 8251 bp, Homo sapiens
  Payload ID: 13759
  Gene Symbol: PTPRD
  Gene Name: protein tyrosine phosphatase, receptor type, D
  Uniprot ID: P23468
  ENST ID: ENST00000355233
  CDS Start-End: 104-4624
gctctgaaagtgttccagctgaaatttcagatcggacagactcgctgcggctccggaggcagtgattccaagctgctcgcgcacgctgctgccaagctgcaggatggtgcacgtagccaggctgctgctgctgctcctcactttcttcctccgcacggatgctgagacacctccaaggtttacacgaacacccgttgatcagacaggggtctctggcggagttgcctctttcatctgccaagctacgggagacccaagacctaaaattgtctggaacaaaaaaggaaagaaagtcagcaatcagagatttgaggtaatagagtttgacgatgggtctggatcagttctcagaatacaacccttacggactccgagggatgaggccatttatgaatgtgtggcctcaaataatgtgggagaaataagtgtatccaccagactcacagttttgcgggaagatcaaattcccaggggcttccctaccattgacatgggcccacagttgaaggtggttgagcgtactcgcacggccaccatgctttgtgcagccagtggtaatccggatccagaaatcacttggtttaaagatttcttacctgtggacacaagcaacaacaatggtcgtattaagcagttacgatcagaatctattggtggtacaccaataagaggagcccttcagattgagcagagtgaagagtctgaccaaggaaaatatgagtgtgttgccaccaacagcgcgggcactcgctattccgctcctgccaatttatatgtcagagagctgcgagaagttcgccgtgtcccaccaagattctctatcccacccactaatcatgaaatcatgccaggcggaagcgttaatatcacctgtgtggccgtggggtcaccaatgccttatgtaaagtggatgttgggggcagaagatctgacacctgaagatgatatgccaataggaagaaatgtgctagaactgaatgatgtaagacagtcagcaaattacacctgtgttgctatgtcaacactgggtgtcattgaagcaatagcacagatcactgtcaaagccttacccaaacctccaggaactcctgtagtgaccgagagcacagctacaagcatcacactgacgtgggactctgggaaccctgagcctgtttcttattacataattcagcataaacctaaaaactctgaggaactttacaaagaaattgatggggtggcgaccacacgctacagtgtcgctggactaagtccctactcggattatgaattcagggttgttgctgtcaataacattgggcgggggcctcccagcgaacctgtgctaacacaaacctcagagcaagcaccatccagtgccccgagggatgtccaggcacgaatgttgagttcgaccaccattttggtacagtggaaggaacctgaagagccaaatggacagatccaaggatatagagtttattatacaatggatcccactcaacatgtcaacaactggatgaaacacaatgtagctgacagccaaatcactactattggcaacttagtgccccagaaaacatattctgtcaaagtcctggcttttacctcaattggagatggtcccctttcaagtgacatacaagtcatcactcagacaggagtaccagggcagccactaaacttcaaagcagaacctgagtctgaaacaagtattttgctctcttggacacctccacgttcagataccattgccaactatgaactggtctacaaagatggggagcatggagaggagcaacgaattaccattgagccagggacatcatataggctgcaaggactgaaaccaaacagcttatactatttccgtctggctgcacgctcccctcaaggcctgggtgcttctactgcagaaatatcagctagaaccatgcagtcaatgtttgcaaaaaattttcatgtcaaagcagtaatgaagacttccgtgttgctgtcttgggagattccagagaattataactccgccatgcctttcaaaattctttatgatgatgggaaaatggtagaagaagtggatggccgagccacacagaagttaattgtcaacctgaagcctgagaaatcatattcatttgtgctgacaaatcgtggaaacagtgctggtgggctgcagcacagggtcacggcaaagactgcaccagatgtattacgtaccaagcctgccttcattgggaagaccaacttggatggcatgattactgtgcaactgcctgaagtacctgcaaatgagaatataaaaggttactacataataattgtgcctttgaagaaatctcgcgggaaatttatcaagccatgggagagtccagatgaaatggaattagatgagctgcttaaggagatatctaggaagcgcagaagcatccgttatgggagagaagttgaattaaagccatatattgccgctcactttgatgtccttcccactgagttcaccctgggggatgacaagcattatggtggatttacaaacaagcaactccaaagtggtcaagaatatgtcttctttgtgttagcagtaatggaacatgcagagtctaagatgtatgcaaccagcccttactccgaccccgtggtgtcaatggatctggatccgcagccaatcacggatgaagaagaaggcttgatctgggttgtaggtcctgtccttgcagtggtctttatcatctgcattgtcattgctattcttctttataaaagcagtaaacccgacaggaagagggcagagtccgactctagaaaaagcagcataccgaacaataaggagatcccttcacaccacccaacagaccctgtagaactgaggcgccttaactttcaaacaccgggtatggctagccatcctccaatacccatcttggaacttgcagaccacattgaaagattgaaagcaaatgacaacttgaagttttcccaggaatatgagtcaattgaccctggccagcagttcacttgggaacattcaaacttggaagtaaacaaaccaaagaatagatacgcgaatgtaatcgcatatgatcattcccgggttctcctatcagctatagaagggatcccaggaagtgactatgtgaatgccaactacatagatgggtataggaagcaaaatgcctatattgcaacacagggatctctccccgaaacatttggggacttttggagaatgatatgggaacaacggagtgccacagttgtcatgatgacaaaactagaagaaagatcaagggtgaagtgtgaccagtattggcctagcagaggcacagaaacccacggactcgttcaagtaacgctgcttgatactgtggagctggccacatattgtgttcgaacatttgcactttacaagaatggttcaagtgagaagagagaagtgagacaattccagttcaccgcctggcctgatcatggtgttccagaacaccctacaccttttctagctttcttacgtagagtcaaaacctgtaaccctcccgatgctggtccgatggttgtgcactgcagtgcgggagttggccggactggttgcttcatcgtcatagatgccatgttagaaagaataaagcatgaaaaaactgtagatatttatggccatgtaactttaatgagagcccagaggaactatatggttcaaacagaagaccaatacatctttatccatgatgcactgttagaagcagtgacttgtggaaataccgaagtgccagctagaaacttgtatgcctacattcagaagctgacacaaatagaaacgggagagaatgtcacaggaatggagctcgaatttaagcgtctagccagctcaaaagctcacacctcaaggtttatcagtgccaatcttccatgtaataaattcaaaaatcgccttgttaatattatgccatatgaatccacaagggtatgcctgcagcctatccgtggagtagaaggatctgattacatcaatgccagttttattgatggatacagacaacagaaagcctacatcgctacccaggggcccttggcagagaccactgaagacttctggcggatgctctgggaacacaattccaccatagttgtgatgctcaccaagctgcgtgaaatgggcagagagaaatgtcaccaatactggccagcagaacggtctgcaagataccagtactttgttgtagatcccatggctgagtacaacatgccacagtatatcctaagggaattcaaggtcacagatgccagggacggccagtcccgaacagtaaggcagttccagttcactgactggccagagcaaggagtgccaaagtccggagaaggatttattgacttcatcggccaagtccataaaacaaaagaacagtttggccaagatggacccatttcagtccattgcagcgcgggcgttggaagaactggagtcttcataacgctaagcattgttttggaaagaatgagatatgaaggagttgtagatatcttccagactgtcaaaatgttaagaacacaacgaccagctatggtacagacagaggatcaatatcagttttcctatcgtgccgcactagagtacctgggcagctttgaccactatgcaacgtagaaacccctgacccattctggatttttactacaggcccttcaatatccatggagtctcttctgagccatacagggcacttgagaagtccttcttaacttctagctaacaactacttagtgggactattacacacaaaacaaattaaaaacaaattattccaggtggaccaagaattcacagtttaataatctaacctgaaaaataatgaagagaatcctgactgatgaggcatctgaaggattttatttacagatacctcaaggattcaaaatcaagggaagaagaaatcacagcaaagaaccaccatcttattcaggattgcttgaaaggtgcaaggagaaattgccagaatgctgcagttcagcacaagatatgtgctggtgtggcttctcacaatgaaacggactctgctttgacatcgccccttcccaccatactgctcataataacattttagggggaaaggggagggaatgtttaaaaagaaagtccttgatttagttttttagtattgtaaagatactgctgacctgtgcttcatttctaactgtgtaaacttttttttaacaaaatgtatcattcgataaagtgaattttaaaaaagttacataactcttcatttttttatttccaaatcgtaggtttttttaagctgtagaactgttatctgtaatatcttgctgtagaaatatcaaatcatttgaaaatttgcacatttttgtgcaaaactcaatctacagtatcagtctcgtcagatatattaattttacacttcagttttgattggtgagaaagtacccattctcttcaaataatcaaagataattattattttgttttgtttttggaatcaacagggaggcgcaaagtataaagttgctgctaacatatatacatatatatccatattttataagggtgtctatgtatatatagacagtgtgtccacacaaaaaatagatacagttatcagtcagtcagttcttccatgatttagtttttttaaacgtagaaaagctattgtaaacatctctttccatttattcttaattttttgacatattggtatttctttaaagggaaatgaggaatgcacatcagtgattgattgtcaaacctcaccccctgatttcctacctaatctacccccacctaaccaatcaatcacatccacaaattgttttgtttgtttgttagtcaggcttccaacaaagttcaatatttctaacactctagtgcaataaaaattattattaaatagctaagaggtgtgcatgtgggaaaggtcagtgcatatccctttaggaggggagaatgttgtaatatatcagctatcgagttgtttaaaaaaagtgtattcaatcgtatattgtctatagtatgtgctatgaaatttgcatttatgatatgtaacaggggcaaagccaaattcatgttactctgttcagtcagaaacattttgtggcatacagcattcctgggaagtgctgtactttgtttcgttttggttttagttttgcatttagagtgccttataattgatgcctattttaatagcatttctttttagcttttggttcgtatttccattcactgttcgtatctgttactttctattaaagcattatctgtttaccacatgtacaaaaactctttgaataatatgcattcctagttttcagccaagtcggggatgttagtgattgtaccagcccaaagcacttggataatcagggcccttcttccttttataatcaatcatcaacatcagaaaaagctacttgttttatttatattcccttccaaatccgctctggaacatgcagtaactgcaccaaacttattttagtaacaaatatcattggcaactttggaatatatttgatattccattaggatttttctaaaaggggaaataaactatatatatatatgtatcttacccccaattcttccaacagaatttctataggaagccatggatgatggcataagtttgccacatattacatgattttaaataatcctcaaaatacccaaggaactcttaaagagttttggtatgagtatactactttggtttaattttagcttcatggatgttctgcatggaaggatttttgttttccacattttcccattgctagcagagtgaaatccaagagaccaaacatttgcaagcattgtatttgagcacttttgtaaaaaacaaagaaaaagaaaaaaaagaaaatatatataatactaaaaaaaagtatctagaaggctacctcagaatgagactctctaacctacatcagaaccagagaagaatgtgcactatgtgggtctgttatcattattttcttttagtttgtatctttttggagatttatccaagtgccagattactcagtgctataattttcttttagttaaacaaagggggtcagacagacattgcatcatccagacatgccttgttggacatgtagaatccgatggagcactgcacaccagaatgattggccaatgagcagcttctctccctgaaacaataactgcccatttggcaaagggaaagatgacaataatcagaagaagaaaatgaatgggatgcataccatagacgaacgaggcggagactattgcgggaatcttactgttcaggagctgttcctagaactaactcccttactgtcattgatgtgcattccactctgtgcttttctgtacaaccattcaagttttaatttcccaggtgaaccatctttatctgccattaccacaagctttcaagtttccagttattttcatcatcataaccagtacggtgctattatttacctatgtacgtgtagttatgtataattttgtaattagttacaatggtaaaaaaaatcaaaatatataaaaagtgatttgtacagaactttattttagctcttttttaaaaatgatttgcatggttagaaaacggcgaggacagccaggggagggaagggcctctagggaactttgcactttctatacctttgtactatgcactgccctattgattctacacccaataatgatattacttgaacccatctgtaagaaactgcttcggaaattcatttgtgtgtatgtaaataacacaacatagaaacaggaagggaaaaaagtctgcagtaatgcacgtattttttttctttcctgtttattttcggttttgctttaagtccttttatttttaattccctttttgtttttctttttgggttttggttccttttgggtttatgggtgccctgatactccagcagagatcagaaggctacagatccattctatccatccgttatgtggctttgccatcccagcttggagtgtctttacaaagataataacagttgtgttctttgctctcgttttggatgcatagactgaaaaattaaaacaaataacttgtaaaatggcttgttaaaaaatacaattacctctaattagtagtacgcgtaaatgttttacagaatgaaaggcgtgctttttattttcttacttcgttacattggtggcgaaagaagtctgtatgaaaatcagttctttgctgacacaagttccatttgttacaaatgaattctaataaaaatgtcagtgttatgc

SEQ ID NO: 171757 - DNA, 9472 bp, Homo sapiens
  Payload ID: 13759
  Gene Symbol: PTPRD
  Gene Name: protein tyrosine phosphatase, receptor type, D
  Uniprot ID: P23468
  ENST ID: ENST00000356435
  CDS Start-End: 107-5845
caggctctgaaagtgttccagctgaaatttcagatcggacagactcgctgcggctccggaggcagtgattccaagctgctcgcgcacgctgctgccaagctgcaggatggtgcacgtagccaggctgctgctgctgctcctcactttcttcctccgcacggatgctgagacacctccaaggtttacacgaacacccgttgatcagacaggggtctctggcggagttgcctctttcatctgccaagctacgggagacccaagacctaaaattgtctggaacaaaaaaggaaagaaagtcagcaatcagagatttgaggtaatagagtttgacgatgggtctggatcagttctcagaatacaacccttacggactccgagggatgaggccatttatgaatgtgtggcctcaaataatgtgggagaaataagtgtatccaccagactcacagttttgcgggaagatcaaattcccaggggcttccctaccattgacatgggcccacagttgaaggtggttgagcgtactcgcacggccaccatgctttgtgcagccagtggtaatccggatccagaaatcacttggtttaaagatttcttacctgtggacacaagcaacaacaatggtcgtattaagcagttacgatcagaatctattggtggtacaccaataagaggagcccttcagattgagcagagtgaagagtctgaccaaggaaaatatgagtgtgttgccaccaacagcgcgggcactcgctattccgctcctgccaatttatatgtcagagagctgcgagaagttcgccgtgtcccaccaagattctctatcccacccactaatcatgaaatcatgccaggcggaagcgttaatatcacctgtgtggccgtggggtcaccaatgccttatgtaaagtggatgttgggggcagaagatctgacacctgaagatgatatgccaataggaagaaatgtgctagaactgaatgatgtaagacagtcagcaaattacacctgtgttgctatgtcaacactgggtgtcattgaagcaatagcacagatcactgtcaaagccttacccaaacctccaggaactcctgtagtgaccgagagcacagctacaagcatcacactgacgtgggactctgggaaccctgagcctgtttcttattacataattcagcataaacctaaaaactctgaggaactttacaaagaaattgatggggtggcgaccacacgctacagtgtcgctggactaagtccctactcggattatgaattcagggttgttgctgtcaataacattgggcgggggcctcccagcgaacctgtgctaacacaaacctcagagcaagcaccatccagtgccccgagggatgtccaggcacgaatgttgagttcgaccaccattttggtacagtggaaggaacctgaagagccaaatggacagatccaaggatatagagtttattatacaatggatcccactcaacatgtcaacaactggatgaaacacaatgtagctgacagccaaatcactactattggcaacttagtgccccagaaaacatattctgtcaaagtcctggcttttacctcaattggagatggtcccctttcaagtgacatacaagtcatcactcagacaggagtaccagggcagccactaaacttcaaagcagaacctgagtctgaaacaagtattttgctctcttggacacctccacgttcagataccattgccaactatgaactggtctacaaagatggggagcatggagaggagcaacgaattaccattgagccagggacatcatataggctgcaaggactgaaaccaaacagcttatactatttccgtctggctgcacgctcccctcaaggcctgggtgcttctactgcagaaatatcagctagaaccatgcagtcaaagccgtcagctcctcctcaagacattagttgcaccagcccaagttccactagtattttggtaagttggcaacctccaccagtggaaaaacagaatggcattatcactgaatactccatcaagtacactgcagtggatggggaagatgacaagcctcacgagattttgggaattccttcggacactaccaaataccttttggaacagctggaaaaatggactgaataccggatcactgtgacagcccatacagatgtcggccctggccctgagagcttgtccgtgttgattcgaaccaatgaagatgttcctagtggtcctcctcgcaaagtcgaggtagaggctgtcaactcaacatctgttaaagtctcatggcgctcacccgtgcccaataaacagcatggccagataagaggatatcaggtgcattatgtgaggatggaaaatggtgagcccaagggccagcccatgctgaaagatgtcatgctggctgatgcacagtgggaatttgatgatactactgaacatgacatgatcatttctgggctccagcctgaaacttcctactccctcaccgtcacagcctacacaaccaaaggagatggtgctcgcagcaagcccaaactggtgtccaccactggggcagttccagggaaacctcggcttgtgattaaccacactcagatgaatactgctcttattcagtggcaccctccggtggacacatttggacctcttcagggctaccgtctaaaatttggccgcaaggatatggagccacttactactcttgagttctctgaaaaagaagatcactttacagctacagacatccacaagggagcatcatacgtcttcaggctctcagccagaaacaaagtgggctttggggaggagatggtgaaggagatttccattccagaagaagtaccaactggattccctcaaaaccttcactcagaaggcaccacttcaacctccgtccagttatcttggcaaccacctgtcctggcagagagaaatggcattatcaccaagtatacccttctttatagggatatcaacatcccccttctcccgatggagcagcttattgttccagctgacaccactatgacactcactggcttaaaaccagataccacatacgatgtaaaagtacgtgctcatacgagcaaagggcccgggccatatagtcccagtgtccagttcaggacactgcctgtggatcaagtgtttgcaaaaaattttcatgtcaaagcagtaatgaagacttccgtgttgctgtcttgggagattccagagaattataactccgccatgcctttcaaaattctttatgatgatgggaaaatggtagaagaagtggatggccgagccacacagaagttaattgtcaacctgaagcctgagaaatcatattcatttgtgctgacaaatcgtggaaacagtgctggtgggctgcagcacagggtcacggcaaagactgcaccagatgtattacgtaccaagcctgccttcattgggaagaccaacttggatggcatgattactgtgcaactgcctgaagtacctgcaaatgagaatataaaaggttactacataataattgtgcctttgaagaaatctcgcgggaaatttatcaagccatgggagagtccagatgaaatggaattagatgagctgcttaaggagatatctaggaagcgcagaagcatccgttatgggagagaagttgaattaaagccatatattgccgctcactttgatgtccttcccactgagttcaccctgggggatgacaagcattatggtggatttacaaacaagcaactccaaagtggtcaagaatatgtcttctttgtgttagcagtaatggaacatgcagagtctaagatgtatgcaaccagcccttactccgaccccgtggtgtcaatggatctggatccgcagccaatcacggatgaagaagaaggcttgatctgggttgtaggtcctgtccttgcagtggtctttatcatctgcattgtcattgctattcttctttataaaaggaagagggcagagtccgactctagaaaaagcagcataccgaacaataaggagatcccttcacaccacccaacagaccctgtagaactgaggcgccttaactttcaaacaccgggtatggctagccatcctccaatacccatcttggaacttgcagaccacattgaaagattgaaagcaaatgacaacttgaagttttcccaggaatatgagtcaattgaccctggccagcagttcacttgggaacattcaaacttggaagtaaacaaaccaaagaatagatacgcgaatgtaatcgcatatgatcattcccgggttctcctatcagctatagaagggatcccaggaagtgactatgtgaatgccaactacatagatgggtataggaagcaaaatgcctatattgcaacacagggatctctccccgaaacatttggggacttttggagaatgatatgggaacaacggagtgccacagttgtcatgatgacaaaactagaagaaagatcaagggtgaagtgtgaccagtattggcctagcagaggcacagaaacccacggactcgttcaagtaacgctgcttgatactgtggagctggccacatattgtgttcgaacatttgcactttacaagaatggttcaagtgagaagagagaagtgagacaattccagttcaccgcctggcctgatcatggtgttccagaacaccctacaccttttctagctttcttacgtagagtcaaaacctgtaaccctcccgatgctggtccgatggttgtgcactgcagtgcgggagttggccggactggttgcttcatcgtcatagatgccatgttagaaagaataaagcatgaaaaaactgtagatatttatggccatgtaactttaatgagagcccagaggaactatatggttcaaacagaagaccaatacatctttatccatgatgcactgttagaagcagtgacttgtggaaataccgaagtgccagctagaaacttgtatgcctacattcagaagctgacacaaatagaaacgggagagaatgtcacaggaatggagctcgaatttaagcgtctagccagctcaaaagctcacacctcaaggtttatcagtgccaatcttccatgtaataaattcaaaaatcgccttgttaatattatgccatatgaatccacaagggtatgcctgcagcctatccgtggagtagaaggatctgattacatcaatgccagttttattgatggatacagacaacagaaagcctacatcgctacccaggggcccttggcagagaccactgaagacttctggcggatgctctgggaacacaattccaccatagttgtgatgctcaccaagctgcgtgaaatgggcagagagaaatgtcaccaatactggccagcagaacggtctgcaagataccagtactttgttgtagatcccatggctgagtacaacatgccacagtatatcctaagggaattcaaggtcacagatgccagggacggccagtcccgaacagtaaggcagttccagttcactgactggccagagcaaggagtgccaaagtccggagaaggatttattgacttcatcggccaagtccataaaacaaaagaacagtttggccaagatggacccatttcagtccattgcagcgcgggcgttggaagaactggagtcttcataacgctaagcattgttttggaaagaatgagatatgaaggagttgtagatatcttccagactgtcaaaatgttaagaacacaacgaccagctatggtacagacagaggatcaatatcagttttcctatcgtgccgcactagagtacctgggcagctttgaccactatgcaacgtagaaacccctgacccattctggatttttactacaggcccttcaatatccatggagtctcttctgagccatacagggcacttgagaagtccttcttaacttctagctaacaactacttagtgggactattacacacaaaacaaattaaaaacaaattattccaggtggaccaagaattcacagtttaataatctaacctgaaaaataatgaagagaatcctgactgatgaggcatctgaaggattttatttacagatacctcaaggattcaaaatcaagggaagaagaaatcacagcaaagaaccaccatcttattcaggattgcttgaaaggtgcaaggagaaattgccagaatgctgcagttcagcacaagatatgtgctggtgtggcttctcacaatgaaacggactctgctttgacatcgccccttcccaccatactgctcataataacattttagggggaaaggggagggaatgtttaaaaagaaagtccttgatttagttttttagtattgtaaagatactgctgacctgtgcttcatttctaactgtgtaaacttttttttaacaaaatgtatcattcgataaagtgaattttaaaaaagttacataactcttcatttttttatttccaaatcgtaggtttttttaagctgtagaactgttatctgtaatatcttgctgtagaaatatcaaatcatttgaaaatttgcacatttttgtgcaaaactcaatctacagtatcagtctcgtcagatatattaattttacacttcagttttgattggtgagaaagtacccattctcttcaaataatcaaagataattattattttgttttgtttttggaatcaacagggaggcgcaaagtataaagttgctgctaacatatatacatatatatccatattttataagggtgtctatgtatatatagacagtgtgtccacacaaaaaatagatacagttatcagtcagtcagttcttccatgatttagtttttttaaacgtagaaaagctattgtaaacatctctttccatttattcttaattttttgacatattggtatttctttaaagggaaatgaggaatgcacatcagtgattgattgtcaaacctcaccccctgatttcctacctaatctacccccacctaaccaatcaatcacatccacaaattgttttgtttgtttgttagtcaggcttccaacaaagttcaatatttctaacactctagtgcaataaaaattattattaaatagctaagaggtgtgcatgtgggaaaggtcagtgcatatccctttaggaggggagaatgttgtaatatatcagctatcgagttgtttaaaaaaagtgtattcaatcgtatattgtctatagtatgtgctatgaaatttgcatttatgatatgtaacaggggcaaagccaaattcatgttactctgttcagtcagaaacattttgtggcatacagcattcctgggaagtgctgtactttgtttcgttttggttttagttttgcatttagagtgccttataattgatgcctattttaatagcatttctttttagcttttggttcgtatttccattcactgttcgtatctgttactttctattaaagcattatctgtttaccacatgtacaaaaactctttgaataatatgcattcctagttttcagccaagtcggggatgttagtgattgtaccagcccaaagcacttggataatcagggcccttcttccttttataatcaatcatcaacatcagaaaaagctacttgttttatttatattcccttccaaatccgctctggaacatgcagtaactgcaccaaacttattttagtaacaaatatcattggcaactttggaatatatttgatattccattaggatttttctaaaaggggaaataaactatatatatatatgtatcttacccccaattcttccaacagaatttctataggaagccatggatgatggcataagtttgccacatattacatgattttaaataatcctcaaaatacccaaggaactcttaaagagttttggtatgagtatactactttggtttaattttagcttcatggatgttctgcatggaaggatttttgttttccacattttcccattgctagcagagtgaaatccaagagaccaaacatttgcaagcattgtatttgagcacttttgtaaaaaacaaagaaaaagaaaaaaaagaaaatatatataatactaaaaaaaagtatctagaaggctacctcagaatgagactctctaacctacatcagaaccagagaagaatgtgcactatgtgggtctgttatcattattttcttttagtttgtatctttttggagatttatccaagtgccagattactcagtgctataattttcttttagttaaacaaagggggtcagacagacattgcatcatccagacatgccttgttggacatgtagaatccgatggagcactgcacaccagaatgattggccaatgagcagcttctctccctgaaacaataactgcccatttggcaaagggaaagatgacaataatcagaagaagaaaatgaatgggatgcataccatagacgaacgaggcggagactattgcgggaatcttactgttcaggagctgttcctagaactaactcccttactgtcattgatgtgcattccactctgtgcttttctgtacaaccattcaagttttaatttcccaggtgaaccatctttatctgccattaccacaagctttcaagtttccagttattttcatcatcataaccagtacggtgctattatttacctatgtacgtgtagttatgtataattttgtaattagttacaatggtaaaaaaaatcaaaatatataaaaagtgatttgtacagaactttattttagctcttttttaaaaatgatttgcatggttagaaaacggcgaggacagccaggggagggaagggcctctagggaactttgcactttctatacctttgtactatgcactgccctattgattctacacccaataatgatattacttgaacccatctgtaagaaactgcttcggaaattcatttgtgtgtatgtaaataacacaacatagaaacaggaagggaaaaaagtctgcagtaatgcacgtattttttttctttcctgtttattttcggttttgctttaagtccttttatttttaattccctttttgtttttctttttgggttttggttccttttgggtttatgggtgccctgatactccagcagagatcagaaggctacagatccattctatccatccgttatgtggctttgccatcccagcttggagtgtctttacaaagataataacagttgtgttctttgctctcgttttggatgcatagactgaaaaattaaaacaaataacttgtaaaatggcttgttaaaaaatacaattacctctaattagtagtacgcgtaaatgttttacagaatgaaaggcgtgctttttattttcttacttcgttacattggtggcgaaagaagtctgtatgaaaatcagttctttgctgacacaagttccatttgttacaaatgaattctaataaaaatgtcagtgttatgc

SEQ ID NO: 171758 - DNA, 9911 bp, Homo sapiens
  Payload ID: 13759
  Gene Symbol: PTPRD
  Gene Name: protein tyrosine phosphatase, receptor type, D
  Uniprot ID: P23468
  ENST ID: ENST00000381196
  CDS Start-End: 545-6283
ggaaatcttgaggagtctgatacttttcatcctccagctataaaatcatcttgtagggggaagctgtacattggtggaaaataaaaggcaagcagttcctggcccgtgatattccagttagaggtgtctgactgacagcatgttggcaccgagggaagcgatgggcttcggctccaggtttctgtcctgagaccacagcagaatgtgccttggacaaaggcttggactccttgatcttctggtaacttcaaaaatctggtctcagggtggtgaactttttcttcgaattcctaacctgtgagcttacgatgatggtgcctgtccattaactgaacaactgtggttttgaacttcttgaggccagggactgtgtctgaaaacaccgacggtggctaactcaagggagacgtctggtgaacacccgtgggatctaaagaacaagctctgaaagtgttccagctgaaatttcagatcggacagactcgctgcggctccggaggcagtgattccaagctgctcgcgcacgctgctgccaagctgcaggatggtgcacgtagccaggctgctgctgctgctcctcactttcttcctccgcacggatgctgagacacctccaaggtttacacgaacacccgttgatcagacaggggtctctggcggagttgcctctttcatctgccaagctacgggagacccaagacctaaaattgtctggaacaaaaaaggaaagaaagtcagcaatcagagatttgaggtaatagagtttgacgatgggtctggatcagttctcagaatacaacccttacggactccgagggatgaggccatttatgaatgtgtggcctcaaataatgtgggagaaataagtgtatccaccagactcacagttttgcgggaagatcaaattcccaggggcttccctaccattgacatgggcccacagttgaaggtggttgagcgtactcgcacggccaccatgctttgtgcagccagtggtaatccggatccagaaatcacttggtttaaagatttcttacctgtggacacaagcaacaacaatggtcgtattaagcagttacgatcagaatctattggtggtacaccaataagaggagcccttcagattgagcagagtgaagagtctgaccaaggaaaatatgagtgtgttgccaccaacagcgcgggcactcgctattccgctcctgccaatttatatgtcagagagctgcgagaagttcgccgtgtcccaccaagattctctatcccacccactaatcatgaaatcatgccaggcggaagcgttaatatcacctgtgtggccgtggggtcaccaatgccttatgtaaagtggatgttgggggcagaagatctgacacctgaagatgatatgccaataggaagaaatgtgctagaactgaatgatgtaagacagtcagcaaattacacctgtgttgctatgtcaacactgggtgtcattgaagcaatagcacagatcactgtcaaagccttacccaaacctccaggaactcctgtagtgaccgagagcacagctacaagcatcacactgacgtgggactctgggaaccctgagcctgtttcttattacataattcagcataaacctaaaaactctgaggaactttacaaagaaattgatggggtggcgaccacacgctacagtgtcgctggactaagtccctactcggattatgaattcagggttgttgctgtcaataacattgggcgggggcctcccagcgaacctgtgctaacacaaacctcagagcaagcaccatccagtgccccgagggatgtccaggcacgaatgttgagttcgaccaccattttggtacagtggaaggaacctgaagagccaaatggacagatccaaggatatagagtttattatacaatggatcccactcaacatgtcaacaactggatgaaacacaatgtagctgacagccaaatcactactattggcaacttagtgccccagaaaacatattctgtcaaagtcctggcttttacctcaattggagatggtcccctttcaagtgacatacaagtcatcactcagacaggagtaccagggcagccactaaacttcaaagcagaacctgagtctgaaacaagtattttgctctcttggacacctccacgttcagataccattgccaactatgaactggtctacaaagatggggagcatggagaggagcaacgaattaccattgagccagggacatcatataggctgcaaggactgaaaccaaacagcttatactatttccgtctggctgcacgctcccctcaaggcctgggtgcttctactgcagaaatatcagctagaaccatgcagtcaaagccgtcagctcctcctcaagacattagttgcaccagcccaagttccactagtattttggtaagttggcaacctccaccagtggaaaaacagaatggcattatcactgaatactccatcaagtacactgcagtggatggggaagatgacaagcctcacgagattttgggaattccttcggacactaccaaataccttttggaacagctggaaaaatggactgaataccggatcactgtgacagcccatacagatgtcggccctggccctgagagcttgtccgtgttgattcgaaccaatgaagatgttcctagtggtcctcctcgcaaagtcgaggtagaggctgtcaactcaacatctgttaaagtctcatggcgctcacccgtgcccaataaacagcatggccagataagaggatatcaggtgcattatgtgaggatggaaaatggtgagcccaagggccagcccatgctgaaagatgtcatgctggctgatgcacagtgggaatttgatgatactactgaacatgacatgatcatttctgggctccagcctgaaacttcctactccctcaccgtcacagcctacacaaccaaaggagatggtgctcgcagcaagcccaaactggtgtccaccactggggcagttccagggaaacctcggcttgtgattaaccacactcagatgaatactgctcttattcagtggcaccctccggtggacacatttggacctcttcagggctaccgtctaaaatttggccgcaaggatatggagccacttactactcttgagttctctgaaaaagaagatcactttacagctacagacatccacaagggagcatcatacgtcttcaggctctcagccagaaacaaagtgggctttggggaggagatggtgaaggagatttccattccagaagaagtaccaactggattccctcaaaaccttcactcagaaggcaccacttcaacctccgtccagttatcttggcaaccacctgtcctggcagagagaaatggcattatcaccaagtatacccttctttatagggatatcaacatcccccttctcccgatggagcagcttattgttccagctgacaccactatgacactcactggcttaaaaccagataccacatacgatgtaaaagtacgtgctcatacgagcaaagggcccgggccatatagtcccagtgtccagttcaggacactgcctgtggatcaagtgtttgcaaaaaattttcatgtcaaagcagtaatgaagacttccgtgttgctgtcttgggagattccagagaattataactccgccatgcctttcaaaattctttatgatgatgggaaaatggtagaagaagtggatggccgagccacacagaagttaattgtcaacctgaagcctgagaaatcatattcatttgtgctgacaaatcgtggaaacagtgctggtgggctgcagcacagggtcacggcaaagactgcaccagatgtattacgtaccaagcctgccttcattgggaagaccaacttggatggcatgattactgtgcaactgcctgaagtacctgcaaatgagaatataaaaggttactacataataattgtgcctttgaagaaatctcgcgggaaatttatcaagccatgggagagtccagatgaaatggaattagatgagctgcttaaggagatatctaggaagcgcagaagcatccgttatgggagagaagttgaattaaagccatatattgccgctcactttgatgtccttcccactgagttcaccctgggggatgacaagcattatggtggatttacaaacaagcaactccaaagtggtcaagaatatgtcttctttgtgttagcagtaatggaacatgcagagtctaagatgtatgcaaccagcccttactccgaccccgtggtgtcaatggatctggatccgcagccaatcacggatgaagaagaaggcttgatctgggttgtaggtcctgtccttgcagtggtctttatcatctgcattgtcattgctattcttctttataaaaggaagagggcagagtccgactctagaaaaagcagcataccgaacaataaggagatcccttcacaccacccaacagaccctgtagaactgaggcgccttaactttcaaacaccgggtatggctagccatcctccaatacccatcttggaacttgcagaccacattgaaagattgaaagcaaatgacaacttgaagttttcccaggaatatgagtcaattgaccctggccagcagttcacttgggaacattcaaacttggaagtaaacaaaccaaagaatagatacgcgaatgtaatcgcatatgatcattcccgggttctcctatcagctatagaagggatcccaggaagtgactatgtgaatgccaactacatagatgggtataggaagcaaaatgcctatattgcaacacagggatctctccccgaaacatttggggacttttggagaatgatatgggaacaacggagtgccacagttgtcatgatgacaaaactagaagaaagatcaagggtgaagtgtgaccagtattggcctagcagaggcacagaaacccacggactcgttcaagtaacgctgcttgatactgtggagctggccacatattgtgttcgaacatttgcactttacaagaatggttcaagtgagaagagagaagtgagacaattccagttcaccgcctggcctgatcatggtgttccagaacaccctacaccttttctagctttcttacgtagagtcaaaacctgtaaccctcccgatgctggtccgatggttgtgcactgcagtgcgggagttggccggactggttgcttcatcgtcatagatgccatgttagaaagaataaagcatgaaaaaactgtagatatttatggccatgtaactttaatgagagcccagaggaactatatggttcaaacagaagaccaatacatctttatccatgatgcactgttagaagcagtgacttgtggaaataccgaagtgccagctagaaacttgtatgcctacattcagaagctgacacaaatagaaacgggagagaatgtcacaggaatggagctcgaatttaagcgtctagccagctcaaaagctcacacctcaaggtttatcagtgccaatcttccatgtaataaattcaaaaatcgccttgttaatattatgccatatgaatccacaagggtatgcctgcagcctatccgtggagtagaaggatctgattacatcaatgccagttttattgatggatacagacaacagaaagcctacatcgctacccaggggcccttggcagagaccactgaagacttctggcggatgctctgggaacacaattccaccatagttgtgatgctcaccaagctgcgtgaaatgggcagagagaaatgtcaccaatactggccagcagaacggtctgcaagataccagtactttgttgtagatcccatggctgagtacaacatgccacagtatatcctaagggaattcaaggtcacagatgccagggacggccagtcccgaacagtaaggcagttccagttcactgactggccagagcaaggagtgccaaagtccggagaaggatttattgacttcatcggccaagtccataaaacaaaagaacagtttggccaagatggacccatttcagtccattgcagcgcgggcgttggaagaactggagtcttcataacgctaagcattgttttggaaagaatgagatatgaaggagttgtagatatcttccagactgtcaaaatgttaagaacacaacgaccagctatggtacagacagaggatcaatatcagttttcctatcgtgccgcactagagtacctgggcagctttgaccactatgcaacgtagaaacccctgacccattctggatttttactacaggcccttcaatatccatggagtctcttctgagccatacagggcacttgagaagtccttcttaacttctagctaacaactacttagtgggactattacacacaaaacaaattaaaaacaaattattccaggtggaccaagaattcacagtttaataatctaacctgaaaaataatgaagagaatcctgactgatgaggcatctgaaggattttatttacagatacctcaaggattcaaaatcaagggaagaagaaatcacagcaaagaaccaccatcttattcaggattgcttgaaaggtgcaaggagaaattgccagaatgctgcagttcagcacaagatatgtgctggtgtggcttctcacaatgaaacggactctgctttgacatcgccccttcccaccatactgctcataataacattttagggggaaaggggagggaatgtttaaaaagaaagtccttgatttagttttttagtattgtaaagatactgctgacctgtgcttcatttctaactgtgtaaacttttttttaacaaaatgtatcattcgataaagtgaattttaaaaaagttacataactcttcatttttttatttccaaatcgtaggtttttttaagctgtagaactgttatctgtaatatcttgctgtagaaatatcaaatcatttgaaaatttgcacatttttgtgcaaaactcaatctacagtatcagtctcgtcagatatattaattttacacttcagttttgattggtgagaaagtacccattctcttcaaataatcaaagataattattattttgttttgtttttggaatcaacagggaggcgcaaagtataaagttgctgctaacatatatacatatatatccatattttataagggtgtctatgtatatatagacagtgtgtccacacaaaaaatagatacagttatcagtcagtcagttcttccatgatttagtttttttaaacgtagaaaagctattgtaaacatctctttccatttattcttaattttttgacatattggtatttctttaaagggaaatgaggaatgcacatcagtgattgattgtcaaacctcaccccctgatttcctacctaatctacccccacctaaccaatcaatcacatccacaaattgttttgtttgtttgttagtcaggcttccaacaaagttcaatatttctaacactctagtgcaataaaaattattattaaatagctaagaggtgtgcatgtgggaaaggtcagtgcatatccctttaggaggggagaatgttgtaatatatcagctatcgagttgtttaaaaaaagtgtattcaatcgtatattgtctatagtatgtgctatgaaatttgcatttatgatatgtaacaggggcaaagccaaattcatgttactctgttcagtcagaaacattttgtggcatacagcattcctgggaagtgctgtactttgtttcgttttggttttagttttgcatttagagtgccttataattgatgcctattttaatagcatttctttttagcttttggttcgtatttccattcactgttcgtatctgttactttctattaaagcattatctgtttaccacatgtacaaaaactctttgaataatatgcattcctagttttcagccaagtcggggatgttagtgattgtaccagcccaaagcacttggataatcagggcccttcttccttttataatcaatcatcaacatcagaaaaagctacttgttttatttatattcccttccaaatccgctctggaacatgcagtaactgcaccaaacttattttagtaacaaatatcattggcaactttggaatatatttgatattccattaggatttttctaaaaggggaaataaactatatatatatatgtatcttacccccaattcttccaacagaatttctataggaagccatggatgatggcataagtttgccacatattacatgattttaaataatcctcaaaatacccaaggaactcttaaagagttttggtatgagtatactactttggtttaattttagcttcatggatgttctgcatggaaggatttttgttttccacattttcccattgctagcagagtgaaatccaagagaccaaacatttgcaagcattgtatttgagcacttttgtaaaaaacaaagaaaaagaaaaaaaagaaaatatatataatactaaaaaaaagtatctagaaggctacctcagaatgagactctctaacctacatcagaaccagagaagaatgtgcactatgtgggtctgttatcattattttcttttagtttgtatctttttggagatttatccaagtgccagattactcagtgctataattttcttttagttaaacaaagggggtcagacagacattgcatcatccagacatgccttgttggacatgtagaatccgatggagcactgcacaccagaatgattggccaatgagcagcttctctccctgaaacaataactgcccatttggcaaagggaaagatgacaataatcagaagaagaaaatgaatgggatgcataccatagacgaacgaggcggagactattgcgggaatcttactgttcaggagctgttcctagaactaactcccttactgtcattgatgtgcattccactctgtgcttttctgtacaaccattcaagttttaatttcccaggtgaaccatctttatctgccattaccacaagctttcaagtttccagttattttcatcatcataaccagtacggtgctattatttacctatgtacgtgtagttatgtataattttgtaattagttacaatggtaaaaaaaatcaaaatatataaaaagtgatttgtacagaactttattttagctcttttttaaaaatgatttgcatggttagaaaacggcgaggacagccaggggagggaagggcctctagggaactttgcactttctatacctttgtactatgcactgccctattgattctacacccaataatgatattacttgaacccatctgtaagaaactgcttcggaaattcatttgtgtgtatgtaaataacacaacatagaaacaggaagggaaaaaagtctgcagtaatgcacgtattttttttctttcctgtttattttcggttttgctttaagtccttttatttttaattccctttttgtttttctttttgggttttggttccttttgggtttatgggtgccctgatactccagcagagatcagaaggctacagatccattctatccatccgttatgtggctttgccatcccagcttggagtgtctttacaaagataataacagttgtgttctttgctctcgttttggatgcatagactgaaaaattaaaacaaataacttgtaaaatggcttgttaaaaaatacaattacctctaattagtagtacgcgtaaatgttttacagaatgaaaggcgtgctttttattttcttacttcgttacattggtggcgaaagaagtctgtatgaaaatcagttctttgctgacacaagttccatttgttacaaatgaattctaataaaaatgtcagtgttatgca

SEQ ID NO: 171759 - DNA, 5038 bp, Homo sapiens
  Payload ID: 13759
  Gene Symbol: PTPRD
  Gene Name: protein tyrosine phosphatase, receptor type, D
  Uniprot ID: P23468
  ENST ID: ENST00000397606
  CDS Start-End: 52-4569
ccggaggcagtgattccaagctgctcgcgcacgctgctgccaagctgcaggatggtgcacgtagccaggctgctgctgctgctcctcactttcttcctccgcacggatgctgagacacctccaaggtttacacgaacacccgttgatcagacaggggtctctggcggagttgcctctttcatctgccaagctacgggagacccaagacctaaaattgtctggaacaaaaaaggaaagaaagtcagcaatcagagatttgaggtaatagagtttgacgatgggtctggatcagttctcagaatacaacccttacggactccgagggatgaggccatttatgaatgtgtggcctcaaataatgtgggagaaataagtgtatccaccagactcacagttttgcgggaagatcaaattcccaggggcttccctaccattgacatgggcccacagttgaaggtggttgagcgtactcgcacggccaccatgctttgtgcagccagtggtaatccggatccagaaatcacttggtttaaagatttcttacctgtggacacaagcaacaacaatggtcgtattaagcagttacgatcagaatctattggagcccttcagattgagcagagtgaagagtctgaccaaggaaaatatgagtgtgttgccaccaacagcgcgggcactcgctattccgctcctgccaatttatatgtcagagttcgccgtgtcccaccaagattctctatcccacccactaatcatgaaatcatgccaggcggaagcgttaatatcacctgtgtggccgtggggtcaccaatgccttatgtaaagtggatgttgggggcagaagatctgacacctgaagatgatatgccaataggaagaaatgtgctagaactgaatgatgtaagacagtcagcaaattacacctgtgttgctatgtcaacactgggtgtcattgaagcaatagcacagatcactgtcaaagccttacccaaacctccaggaactcctgtagtgaccgagagcacagctacaagcatcacactgacgtgggactctgggaaccctgagcctgtttcttattacataattcagcataaacctaaaaactctgaggaactttacaaagaaattgatggggtggcgaccacacgctacagtgtcgctggactaagtccctactcggattatgaattcagggttgttgctgtcaataacattgggcgggggcctcccagcgaacctgtgctaacacaaacctcagagcaagcaccatccagtgccccgagggatgtccaggcacgaatgttgagttcgaccaccattttggtacagtggaaggaacctgaagagccaaatggacagatccaaggatatagagtttattatacaatggatcccactcaacatgtcaacaactggatgaaacacaatgtagctgacagccaaatcactactattggcaacttagtgccccagaaaacatattctgtcaaagtcctggcttttacctcaattggagatggtcccctttcaagtgacatacaagtcatcactcagacaggagtaccagggcagccactaaacttcaaagcagaacctgagtctgaaacaagtattttgctctcttggacacctccacgttcagataccattgccaactatgaactggtctacaaagatggggagcatggagaggagcaacgaattaccattgagccagggacatcatataggctgcaaggactgaaaccaaacagcttatactatttccgtctggctgcacgctcccctcaaggcctgggtgcttctactgcagaaatatcagctagaaccatgcagtcaatgtttgcaaaaaattttcatgtcaaagcagtaatgaagacttccgtgttgctgtcttgggagattccagagaattataactccgccatgcctttcaaaattctttatgatgatgggaaaatggtagaagaagtggatggccgagccacacagaagttaattgtcaacctgaagcctgagaaatcatattcatttgtgctgacaaatcgtggaaacagtgctggtgggctgcagcacagggtcacggcaaagactgcaccagatgtattacgtaccaagcctgccttcattgggaagaccaacttggatggcatgattactgtgcaactgcctgaagtacctgcaaatgagaatataaaaggttactacataataattgtgcctttgaagaaatctcgcgggaaatttatcaagccatgggagagtccagatgaaatggaattagatgagctgcttaaggagatatctaggaagcgcagaagcatccgttatgggagagaagttgaattaaagccatatattgccgctcactttgatgtccttcccactgagttcaccctgggggatgacaagcattatggtggatttacaaacaagcaactccaaagtggtcaagaatatgtcttctttgtgttagcagtaatggaacatgcagagtctaagatgtatgcaaccagcccttactccgaccccgtggtgtcaatggatctggatccgcagccaatcacggatgaagaagaaggcttgatctgggttgtaggtcctgtccttgcagtggtctttatcatctgcattgtcattgctattcttctttataaaaggaagagggcagagtccgactctagaaaaagcagcataccgaacaataaggagatcccttcacaccacccaacagaccctgtagaactgaggcgccttaactttcaaacaccgggttcagatgattccggttaccctggtaaccttcattcttcaagtatggctagccatcctccaatacccatcttggaacttgcagaccacattgaaagattgaaagcaaatgacaacttgaagttttcccaggaatatgagtcaattgaccctggccagcagttcacttgggaacattcaaacttggaagtaaacaaaccaaagaatagatacgcgaatgtaatcgcatatgatcattcccgggttctcctatcagctatagaagggatcccaggaagtgactatgtgaatgccaactacatagatgggtataggaagcaaaatgcctatattgcaacacagggatctctccccgaaacatttggggacttttggagaatgatatgggaacaacggagtgccacagttgtcatgatgacaaaactagaagaaagatcaagggtgaagtgtgaccagtattggcctagcagaggcacagaaacccacggactcgttcaagtaacgctgcttgatactgtggagctggccacatattgtgttcgaacatttgcactttacaagaatggttcaagtgagaagagagaagtgagacaattccagttcaccgcctggcctgatcatggtgttccagaacaccctacaccttttctagctttcttacgtagagtcaaaacctgtaaccctcccgatgctggtccgatggttgtgcactgcagtgcgggagttggccggactggttgcttcatcgtcatagatgccatgttagaaagaataaagcatgaaaaaactgtagatatttatggccatgtaactttaatgagagcccagaggaactatatggttcaaacagaagaccaatacatctttatccatgatgcactgttagaagcagtgacttgtggaaataccgaagtgccagctagaaacttgtatgcctacattcagaagctgacacaaatagaaacgggagagaatgtcacaggaatggagctcgaatttaagcgtctagccagctcaaaagctcacacctcaaggtttatcagtgccaatcttccatgtaataaattcaaaaatcgccttgttaatattatgccatatgaatccacaagggtatgcctgcagcctatccgtggagtagaaggatctgattacatcaatgccagttttattgatggatacagacaacagaaagcctacatcgctacccaggggcccttggcagagaccactgaagacttctggcggatgctctgggaacacaattccaccatagttgtgatgctcaccaagctgcgtgaaatgggcagagagaaatgtcaccaatactggccagcagaacggtctgcaagataccagtactttgttgtagatcccatggctgagtacaacatgccacagtatatcctaagggaattcaaggtcacagatgccagggacggccagtcccgaacagtaaggcagttccagttcactgactggccagagcaaggagtgccaaagtccggagaaggatttattgacttcatcggccaagtccataaaacaaaagaacagtttggccaagatggacccatttcagtccattgcagcgcgggcgttggaagaactggagtcttcataacgctaagcattgttttggaaagaatgagatatgaaggagttgtagatatcttccagactgtcaaaatgttaagaacacaacgaccagctatggtacagacagaggatcaatatcagttttcctatcgtgccgcactagagtacctgggcagctttgaccactatgcaacgtagaaacccctgacccattctggatttttactacaggcccttcaatatccatggagtctcttctgagccatacagggcacttgagaagtccttcttaacttctagctaacaactacttagtgggactattacacacaaaacaaattaaaaacaaattattccaggtggaccaagaattcacagtttaataatctaacctgaaaaataatgaagagaatcctgactgatgaggcatctgaaggattttatttacagatacctcaaggattcaaaatcaagggaagaagaaatcacagcaaagaaccaccatcttattcaggattgcttgaaaggtgcaaggagaaattgccagaatgctgcagttcagcacaagatatgtgctggtgtggcttctcacaatgaaacggactctgctttgacatcgccccttcccaccatactgctcataataacattttagggggaaagggga

SEQ ID NO: 171760 - DNA, 8242 bp, Homo sapiens
  Payload ID: 13759
  Gene Symbol: PTPRD
  Gene Name: protein tyrosine phosphatase, receptor type, D
  Uniprot ID: P23468
  ENST ID: ENST00000397611
  CDS Start-End: 107-4615
caggctctgaaagtgttccagctgaaatttcagatcggacagactcgctgcggctccggaggcagtgattccaagctgctcgcgcacgctgctgccaagctgcaggatggtgcacgtagccaggctgctgctgctgctcctcactttcttcctccgcacggatgctgagacacctccaaggtttacacgaacacccgttgatcagacaggggtctctggcggagttgcctctttcatctgccaagctacgggagacccaagacctaaaattgtctggaacaaaaaaggaaagaaagtcagcaatcagagatttgaggtaatagagtttgacgatgggtctggatcagttctcagaatacaacccttacggactccgagggatgaggccatttatgaatgtgtggcctcaaataatgtgggagaaataagtgtatccaccagactcacagttttgcgggaagatcaaattcccaggggcttccctaccattgacatgggcccacagttgaaggtggttgagcgtactcgcacggccaccatgctttgtgcagccagtggtaatccggatccagaaatcacttggtttaaagatttcttacctgtggacacaagcaacaacaatggtcgtattaagcagttacgatcaggtggtacaccaataagaggagcccttcagattgagcagagtgaagagtctgaccaaggaaaatatgagtgtgttgccaccaacagcgcgggcactcgctattccgctcctgccaatttatatgtcagagagctgcgagaagttcgccgtgtcccaccaagattctctatcccacccactaatcatgaaatcatgccaggcggaagcgttaatatcacctgtgtggccgtggggtcaccaatgccttatgtaaagtggatgttgggggcagaagatctgacacctgaagatgatatgccaataggaagaaatgtgctagaactgaatgatgtaagacagtcagcaaattacacctgtgttgctatgtcaacactgggtgtcattgaagcaatagcacagatcactgtcaaagccttacccaaacctccaggaactcctgtagtgaccgagagcacagctacaagcatcacactgacgtgggactctgggaaccctgagcctgtttcttattacataattcagcataaacctaaaaactctgaggaactttacaaagaaattgatggggtggcgaccacacgctacagtgtcgctggactaagtccctactcggattatgaattcagggttgttgctgtcaataacattgggcgggggcctcccagcgaacctgtgctaacacaaacctcagagcaagcaccatccagtgccccgagggatgtccaggcacgaatgttgagttcgaccaccattttggtacagtggaaggaacctgaagagccaaatggacagatccaaggatatagagtttattatacaatggatcccactcaacatgtcaacaactggatgaaacacaatgtagctgacagccaaatcactactattggcaacttagtgccccagaaaacatattctgtcaaagtcctggcttttacctcaattggagatggtcccctttcaagtgacatacaagtcatcactcagacaggagtaccagggcagccactaaacttcaaagcagaacctgagtctgaaacaagtattttgctctcttggacacctccacgttcagataccattgccaactatgaactggtctacaaagatggggagcatggagaggagcaacgaattaccattgagccagggacatcatataggctgcaaggactgaaaccaaacagcttatactatttccgtctggctgcacgctcccctcaaggcctgggtgcttctactgcagaaatatcagctagaaccatgcagtcaatgtttgcaaaaaattttcatgtcaaagcagtaatgaagacttccgtgttgctgtcttgggagattccagagaattataactccgccatgcctttcaaaattctttatgatgatgggaaaatggtagaagaagtggatggccgagccacacagaagttaattgtcaacctgaagcctgagaaatcatattcatttgtgctgacaaatcgtggaaacagtgctggtgggctgcagcacagggtcacggcaaagactgcaccagatgtattacgtaccaagcctgccttcattgggaagaccaacttggatggcatgattactgtgcaactgcctgaagtacctgcaaatgagaatataaaaggttactacataataattgtgcctttgaagaaatctcgcgggaaatttatcaagccatgggagagtccagatgaaatggaattagatgagctgcttaaggagatatctaggaagcgcagaagcatccgttatgggagagaagttgaattaaagccatatattgccgctcactttgatgtccttcccactgagttcaccctgggggatgacaagcattatggtggatttacaaacaagcaactccaaagtggtcaagaatatgtcttctttgtgttagcagtaatggaacatgcagagtctaagatgtatgcaaccagcccttactccgaccccgtggtgtcaatggatctggatccgcagccaatcacggatgaagaagaaggcttgatctgggttgtaggtcctgtccttgcagtggtctttatcatctgcattgtcattgctattcttctttataaaagtaaacccgacaggaagagggcagagtccgactctagaaaaagcagcataccgaacaataaggagatcccttcacaccacccaacagaccctgtagaactgaggcgccttaactttcaaacaccgggtatggctagccatcctccaatacccatcttggaacttgcagaccacattgaaagattgaaagcaaatgacaacttgaagttttcccaggaatatgagtcaattgaccctggccagcagttcacttgggaacattcaaacttggaagtaaacaaaccaaagaatagatacgcgaatgtaatcgcatatgatcattcccgggttctcctatcagctatagaagggatcccaggaagtgactatgtgaatgccaactacatagatgggtataggaagcaaaatgcctatattgcaacacagggatctctccccgaaacatttggggacttttggagaatgatatgggaacaacggagtgccacagttgtcatgatgacaaaactagaagaaagatcaagggtgaagtgtgaccagtattggcctagcagaggcacagaaacccacggactcgttcaagtaacgctgcttgatactgtggagctggccacatattgtgttcgaacatttgcactttacaagaatggttcaagtgagaagagagaagtgagacaattccagttcaccgcctggcctgatcatggtgttccagaacaccctacaccttttctagctttcttacgtagagtcaaaacctgtaaccctcccgatgctggtccgatggttgtgcactgcagtgcgggagttggccggactggttgcttcatcgtcatagatgccatgttagaaagaataaagcatgaaaaaactgtagatatttatggccatgtaactttaatgagagcccagaggaactatatggttcaaacagaagaccaatacatctttatccatgatgcactgttagaagcagtgacttgtggaaataccgaagtgccagctagaaacttgtatgcctacattcagaagctgacacaaatagaaacgggagagaatgtcacaggaatggagctcgaatttaagcgtctagccagctcaaaagctcacacctcaaggtttatcagtgccaatcttccatgtaataaattcaaaaatcgccttgttaatattatgccatatgaatccacaagggtatgcctgcagcctatccgtggagtagaaggatctgattacatcaatgccagttttattgatggatacagacaacagaaagcctacatcgctacccaggggcccttggcagagaccactgaagacttctggcggatgctctgggaacacaattccaccatagttgtgatgctcaccaagctgcgtgaaatgggcagagagaaatgtcaccaatactggccagcagaacggtctgcaagataccagtactttgttgtagatcccatggctgagtacaacatgccacagtatatcctaagggaattcaaggtcacagatgccagggacggccagtcccgaacagtaaggcagttccagttcactgactggccagagcaaggagtgccaaagtccggagaaggatttattgacttcatcggccaagtccataaaacaaaagaacagtttggccaagatggacccatttcagtccattgcagcgcgggcgttggaagaactggagtcttcataacgctaagcattgttttggaaagaatgagatatgaaggagttgtagatatcttccagactgtcaaaatgttaagaacacaacgaccagctatggtacagacagaggatcaatatcagttttcctatcgtgccgcactagagtacctgggcagctttgaccactatgcaacgtagaaacccctgacccattctggatttttactacaggcccttcaatatccatggagtctcttctgagccatacagggcacttgagaagtccttcttaacttctagctaacaactacttagtgggactattacacacaaaacaaattaaaaacaaattattccaggtggaccaagaattcacagtttaataatctaacctgaaaaataatgaagagaatcctgactgatgaggcatctgaaggattttatttacagatacctcaaggattcaaaatcaagggaagaagaaatcacagcaaagaaccaccatcttattcaggattgcttgaaaggtgcaaggagaaattgccagaatgctgcagttcagcacaagatatgtgctggtgtggcttctcacaatgaaacggactctgctttgacatcgccccttcccaccatactgctcataataacattttagggggaaaggggagggaatgtttaaaaagaaagtccttgatttagttttttagtattgtaaagatactgctgacctgtgcttcatttctaactgtgtaaacttttttttaacaaaatgtatcattcgataaagtgaattttaaaaaagttacataactcttcatttttttatttccaaatcgtaggtttttttaagctgtagaactgttatctgtaatatcttgctgtagaaatatcaaatcatttgaaaatttgcacatttttgtgcaaaactcaatctacagtatcagtctcgtcagatatattaattttacacttcagttttgattggtgagaaagtacccattctcttcaaataatcaaagataattattattttgttttgtttttggaatcaacagggaggcgcaaagtataaagttgctgctaacatatatacatatatatccatattttataagggtgtctatgtatatatagacagtgtgtccacacaaaaaatagatacagttatcagtcagtcagttcttccatgatttagtttttttaaacgtagaaaagctattgtaaacatctctttccatttattcttaattttttgacatattggtatttctttaaagggaaatgaggaatgcacatcagtgattgattgtcaaacctcaccccctgatttcctacctaatctacccccacctaaccaatcaatcacatccacaaattgttttgtttgtttgttagtcaggcttccaacaaagttcaatatttctaacactctagtgcaataaaaattattattaaatagctaagaggtgtgcatgtgggaaaggtcagtgcatatccctttaggaggggagaatgttgtaatatatcagctatcgagttgtttaaaaaaagtgtattcaatcgtatattgtctatagtatgtgctatgaaatttgcatttatgatatgtaacaggggcaaagccaaattcatgttactctgttcagtcagaaacattttgtggcatacagcattcctgggaagtgctgtactttgtttcgttttggttttagttttgcatttagagtgccttataattgatgcctattttaatagcatttctttttagcttttggttcgtatttccattcactgttcgtatctgttactttctattaaagcattatctgtttaccacatgtacaaaaactctttgaataatatgcattcctagttttcagccaagtcggggatgttagtgattgtaccagcccaaagcacttggataatcagggcccttcttccttttataatcaatcatcaacatcagaaaaagctacttgttttatttatattcccttccaaatccgctctggaacatgcagtaactgcaccaaacttattttagtaacaaatatcattggcaactttggaatatatttgatattccattaggatttttctaaaaggggaaataaactatatatatatatgtatcttacccccaattcttccaacagaatttctataggaagccatggatgatggcataagtttgccacatattacatgattttaaataatcctcaaaatacccaaggaactcttaaagagttttggtatgagtatactactttggtttaattttagcttcatggatgttctgcatggaaggatttttgttttccacattttcccattgctagcagagtgaaatccaagagaccaaacatttgcaagcattgtatttgagcacttttgtaaaaaacaaagaaaaagaaaaaaaagaaaatatatataatactaaaaaaaagtatctagaaggctacctcagaatgagactctctaacctacatcagaaccagagaagaatgtgcactatgtgggtctgttatcattattttcttttagtttgtatctttttggagatttatccaagtgccagattactcagtgctataattttcttttagttaaacaaagggggtcagacagacattgcatcatccagacatgccttgttggacatgtagaatccgatggagcactgcacaccagaatgattggccaatgagcagcttctctccctgaaacaataactgcccatttggcaaagggaaagatgacaataatcagaagaagaaaatgaatgggatgcataccatagacgaacgaggcggagactattgcgggaatcttactgttcaggagctgttcctagaactaactcccttactgtcattgatgtgcattccactctgtgcttttctgtacaaccattcaagttttaatttcccaggtgaaccatctttatctgccattaccacaagctttcaagtttccagttattttcatcatcataaccagtacggtgctattatttacctatgtacgtgtagttatgtataattttgtaattagttacaatggtaaaaaaaatcaaaatatataaaaagtgatttgtacagaactttattttagctcttttttaaaaatgatttgcatggttagaaaacggcgaggacagccaggggagggaagggcctctagggaactttgcactttctatacctttgtactatgcactgccctattgattctacacccaataatgatattacttgaacccatctgtaagaaactgcttcggaaattcatttgtgtgtatgtaaataacacaacatagaaacaggaagggaaaaaagtctgcagtaatgcacgtattttttttctttcctgtttattttcggttttgctttaagtccttttatttttaattccctttttgtttttctttttgggttttggttccttttgggtttatgggtgccctgatactccagcagagatcagaaggctacagatccattctatccatccgttatgtggctttgccatcccagcttggagtgtctttacaaagataataacagttgtgttctttgctctcgttttggatgcatagactgaaaaattaaaacaaataacttgtaaaatggcttgttaaaaaatacaattacctctaattagtagtacgcgtaaatgttttacagaatgaaaggcgtgctttttattttcttacttcgttacattggtggcgaaagaagtctgtatgaaaatcagttctttgctgacacaagttccatttgttacaaatgaattctaataaaaatgtcagtgttatgc

SEQ ID NO: 171761 - DNA, 8248 bp, Homo sapiens
  Payload ID: 13759
  Gene Symbol: PTPRD
  Gene Name: protein tyrosine phosphatase, receptor type, D
  ENST ID: ENST00000397617
  CDS Start-End: 104-4621
gctctgaaagtgttccagctgaaatttcagatcggacagactcgctgcggctccggaggcagtgattccaagctgctcgcgcacgctgctgccaagctgcaggatggtgcacgtagccaggctgctgctgctgctcctcactttcttcctccgcacggatgctgagacacctccaaggtttacacgaacacccgttgatcagacaggggtctctggcggagttgcctctttcatctgccaagctacgggagacccaagacctaaaattgtctggaacaaaaaaggaaagaaagtcagcaatcagagatttgaggtaatagagtttgacgatgggtctggatcagttctcagaatacaacccttacggactccgagggatgaggccatttatgaatgtgtggcctcaaataatgtgggagaaataagtgtatccaccagactcacagttttgcgggaagatcaaattcccaggggcttccctaccattgacatgggcccacagttgaaggtggttgagcgtactcgcacggccaccatgctttgtgcagccagtggtaatccggatccagaaatcacttggtttaaagatttcttacctgtggacacaagcaacaacaatggtcgtattaagcagttacgatcagtatccataggagcccttcagattgagcagagtgaagagtctgaccaaggaaaatatgagtgtgttgccaccaacagcgcgggcactcgctattccgctcctgccaatttatatgtcagagttcgccgtgtcccaccaagattctctatcccacccactaatcatgaaatcatgccaggcggaagcgttaatatcacctgtgtggccgtggggtcaccaatgccttatgtaaagtggatgttgggggcagaagatctgacacctgaagatgatatgccaataggaagaaatgtgctagaactgaatgatgtaagacagtcagcaaattacacctgtgttgctatgtcaacactgggtgtcattgaagcaatagcacagatcactgtcaaagccttacccaaacctccaggaactcctgtagtgaccgagagcacagctacaagcatcacactgacgtgggactctgggaaccctgagcctgtttcttattacataattcagcataaacctaaaaactctgaggaactttacaaagaaattgatggggtggcgaccacacgctacagtgtcgctggactaagtccctactcggattatgaattcagggttgttgctgtcaataacattgggcgggggcctcccagcgaacctgtgctaacacaaacctcagagcaagcaccatccagtgccccgagggatgtccaggcacgaatgttgagttcgaccaccattttggtacagtggaaggaacctgaagagccaaatggacagatccaaggatatagagtttattatacaatggatcccactcaacatgtcaacaactggatgaaacacaatgtagctgacagccaaatcactactattggcaacttagtgccccagaaaacatattctgtcaaagtcctggcttttacctcaattggagatggtcccctttcaagtgacatacaagtcatcactcagacaggagtaccagggcagccactaaacttcaaagcagaacctgagtctgaaacaagtattttgctctcttggacacctccacgttcagataccattgccaactatgaactggtctacaaagatggggagcatggagaggagcaacgaattaccattgagccagggacatcatataggctgcaaggactgaaaccaaacagcttatactatttccgtctggctgcacgctcccctcaaggcctgggtgcttctactgcagaaatatcagctagaaccatgcagtcaatgtttgcaaaaaattttcatgtcaaagcagtaatgaagacttccgtgttgctgtcttgggagattccagagaattataactccgccatgcctttcaaaattctttatgatgatgggaaaatggtagaagaagtggatggccgagccacacagaagttaattgtcaacctgaagcctgagaaatcatattcatttgtgctgacaaatcgtggaaacagtgctggtgggctgcagcacagggtcacggcaaagactgcaccagatgtattacgtaccaagcctgccttcattgggaagaccaacttggatggcatgattactgtgcaactgcctgaagtacctgcaaatgagaatataaaaggttactacataataattgtgcctttgaagaaatctcgcgggaaatttatcaagccatgggagagtccagatgaaatggaattagatgagctgcttaaggagatatctaggaagcgcagaagcatccgttatgggagagaagttgaattaaagccatatattgccgctcactttgatgtccttcccactgagttcaccctgggggatgacaagcattatggtggatttacaaacaagcaactccaaagtggtcaagaatatgtcttctttgtgttagcagtaatggaacatgcagagtctaagatgtatgcaaccagcccttactccgaccccgtggtgtcaatggatctggatccgcagccaatcacggatgaagaagaaggcttgatctgggttgtaggtcctgtccttgcagtggtctttatcatctgcattgtcattgctattcttctttataaaaggaagagggcagagtccgactctagaaaaagcagcataccgaacaataaggagatcccttcacaccacccaacagaccctgtagaactgaggcgccttaactttcaaacaccgggttcagatgattccggttaccctggtaaccttcattcttcaagtatggctagccatcctccaatacccatcttggaacttgcagaccacattgaaagattgaaagcaaatgacaacttgaagttttcccaggaatatgagtcaattgaccctggccagcagttcacttgggaacattcaaacttggaagtaaacaaaccaaagaatagatacgcgaatgtaatcgcatatgatcattcccgggttctcctatcagctatagaagggatcccaggaagtgactatgtgaatgccaactacatagatgggtataggaagcaaaatgcctatattgcaacacagggatctctccccgaaacatttggggacttttggagaatgatatgggaacaacggagtgccacagttgtcatgatgacaaaactagaagaaagatcaagggtgaagtgtgaccagtattggcctagcagaggcacagaaacccacggactcgttcaagtaacgctgcttgatactgtggagctggccacatattgtgttcgaacatttgcactttacaagaatggttcaagtgagaagagagaagtgagacaattccagttcaccgcctggcctgatcatggtgttccagaacaccctacaccttttctagctttcttacgtagagtcaaaacctgtaaccctcccgatgctggtccgatggttgtgcactgcagtgcgggagttggccggactggttgcttcatcgtcatagatgccatgttagaaagaataaagcatgaaaaaactgtagatatttatggccatgtaactttaatgagagcccagaggaactatatggttcaaacagaagaccaatacatctttatccatgatgcactgttagaagcagtgacttgtggaaataccgaagtgccagctagaaacttgtatgcctacattcagaagctgacacaaatagaaacgggagagaatgtcacaggaatggagctcgaatttaagcgtctagccagctcaaaagctcacacctcaaggtttatcagtgccaatcttccatgtaataaattcaaaaatcgccttgttaatattatgccatatgaatccacaagggtatgcctgcagcctatccgtggagtagaaggatctgattacatcaatgccagttttattgatggatacagacaacagaaagcctacatcgctacccaggggcccttggcagagaccactgaagacttctggcggatgctctgggaacacaattccaccatagttgtgatgctcaccaagctgcgtgaaatgggcagagagaaatgtcaccaatactggccagcagaacggtctgcaagataccagtactttgttgtagatcccatggctgagtacaacatgccacagtatatcctaagggaattcaaggtcacagatgccagggacggccagtcccgaacagtaaggcagttccagttcactgactggccagagcaaggagtgccaaagtccggagaaggatttattgacttcatcggccaagtccataaaacaaaagaacagtttggccaagatggacccatttcagtccattgcagcgcgggcgttggaagaactggagtcttcataacgctaagcattgttttggaaagaatgagatatgaaggagttgtagatatcttccagactgtcaaaatgttaagaacacaacgaccagctatggtacagacagaggatcaatatcagttttcctatcgtgccgcactagagtacctgggcagctttgaccactatgcaacgtagaaacccctgacccattctggatttttactacaggcccttcaatatccatggagtctcttctgagccatacagggcacttgagaagtccttcttaacttctagctaacaactacttagtgggactattacacacaaaacaaattaaaaacaaattattccaggtggaccaagaattcacagtttaataatctaacctgaaaaataatgaagagaatcctgactgatgaggcatctgaaggattttatttacagatacctcaaggattcaaaatcaagggaagaagaaatcacagcaaagaaccaccatcttattcaggattgcttgaaaggtgcaaggagaaattgccagaatgctgcagttcagcacaagatatgtgctggtgtggcttctcacaatgaaacggactctgctttgacatcgccccttcccaccatactgctcataataacattttagggggaaaggggagggaatgtttaaaaagaaagtccttgatttagttttttagtattgtaaagatactgctgacctgtgcttcatttctaactgtgtaaacttttttttaacaaaatgtatcattcgataaagtgaattttaaaaaagttacataactcttcatttttttatttccaaatcgtaggtttttttaagctgtagaactgttatctgtaatatcttgctgtagaaatatcaaatcatttgaaaatttgcacatttttgtgcaaaactcaatctacagtatcagtctcgtcagatatattaattttacacttcagttttgattggtgagaaagtacccattctcttcaaataatcaaagataattattattttgttttgtttttggaatcaacagggaggcgcaaagtataaagttgctgctaacatatatacatatatatccatattttataagggtgtctatgtatatatagacagtgtgtccacacaaaaaatagatacagttatcagtcagtcagttcttccatgatttagtttttttaaacgtagaaaagctattgtaaacatctctttccatttattcttaattttttgacatattggtatttctttaaagggaaatgaggaatgcacatcagtgattgattgtcaaacctcaccccctgatttcctacctaatctacccccacctaaccaatcaatcacatccacaaattgttttgtttgtttgttagtcaggcttccaacaaagttcaatatttctaacactctagtgcaataaaaattattattaaatagctaagaggtgtgcatgtgggaaaggtcagtgcatatccctttaggaggggagaatgttgtaatatatcagctatcgagttgtttaaaaaaagtgtattcaatcgtatattgtctatagtatgtgctatgaaatttgcatttatgatatgtaacaggggcaaagccaaattcatgttactctgttcagtcagaaacattttgtggcatacagcattcctgggaagtgctgtactttgtttcgttttggttttagttttgcatttagagtgccttataattgatgcctattttaatagcatttctttttagcttttggttcgtatttccattcactgttcgtatctgttactttctattaaagcattatctgtttaccacatgtacaaaaactctttgaataatatgcattcctagttttcagccaagtcggggatgttagtgattgtaccagcccaaagcacttggataatcagggcccttcttccttttataatcaatcatcaacatcagaaaaagctacttgttttatttatattcccttccaaatccgctctggaacatgcagtaactgcaccaaacttattttagtaacaaatatcattggcaactttggaatatatttgatattccattaggatttttctaaaaggggaaataaactatatatatatatgtatcttacccccaattcttccaacagaatttctataggaagccatggatgatggcataagtttgccacatattacatgattttaaataatcctcaaaatacccaaggaactcttaaagagttttggtatgagtatactactttggtttaattttagcttcatggatgttctgcatggaaggatttttgttttccacattttcccattgctagcagagtgaaatccaagagaccaaacatttgcaagcattgtatttgagcacttttgtaaaaaacaaagaaaaagaaaaaaaagaaaatatatataatactaaaaaaaagtatctagaaggctacctcagaatgagactctctaacctacatcagaaccagagaagaatgtgcactatgtgggtctgttatcattattttcttttagtttgtatctttttggagatttatccaagtgccagattactcagtgctataattttcttttagttaaacaaagggggtcagacagacattgcatcatccagacatgccttgttggacatgtagaatccgatggagcactgcacaccagaatgattggccaatgagcagcttctctccctgaaacaataactgcccatttggcaaagggaaagatgacaataatcagaagaagaaaatgaatgggatgcataccatagacgaacgaggcggagactattgcgggaatcttactgttcaggagctgttcctagaactaactcccttactgtcattgatgtgcattccactctgtgcttttctgtacaaccattcaagttttaatttcccaggtgaaccatctttatctgccattaccacaagctttcaagtttccagttattttcatcatcataaccagtacggtgctattatttacctatgtacgtgtagttatgtataattttgtaattagttacaatggtaaaaaaaatcaaaatatataaaaagtgatttgtacagaactttattttagctcttttttaaaaatgatttgcatggttagaaaacggcgaggacagccaggggagggaagggcctctagggaactttgcactttctatacctttgtactatgcactgccctattgattctacacccaataatgatattacttgaacccatctgtaagaaactgcttcggaaattcatttgtgtgtatgtaaataacacaacatagaaacaggaagggaaaaaagtctgcagtaatgcacgtattttttttctttcctgtttattttcggttttgctttaagtccttttatttttaattccctttttgtttttctttttgggttttggttccttttgggtttatgggtgccctgatactccagcagagatcagaaggctacagatccattctatccatccgttatgtggctttgccatcccagcttggagtgtctttacaaagataataacagttgtgttctttgctctcgttttggatgcatagactgaaaaattaaaacaaataacttgtaaaatggcttgttaaaaaatacaattacctctaattagtagtacgcgtaaatgttttacagaatgaaaggcgtgctttttattttcttacttcgttacattggtggcgaaagaagtctgtatgaaaatcagttctttgctgacacaagttccatttgttacaaatgaattctaataaaaatgtcagtgttatgc

SEQ ID NO: 171762 - DNA, 5039 bp, Homo sapiens
  Payload ID: 13759
  Gene Symbol: PTPRD
  Gene Name: protein tyrosine phosphatase, receptor type, D
  Uniprot ID: P23468
  ENST ID: ENST00000486161
  CDS Start-End: 52-4569
ccggaggcagtgattccaagctgctcgcgcacgctgctgccaagctgcaggatggtgcacgtagccaggctgctgctgctgctcctcactttcttcctccgcacggatgctgagacacctccaaggtttacacgaacacccgttgatcagacaggggtctctggcggagttgcctctttcatctgccaagctacgggagacccaagacctaaaattgtctggaacaaaaaaggaaagaaagtcagcaatcagagatttgaggtaatagagtttgacgatgggtctggatcagttctcagaatacaacccttacggactccgagggatgaggccatttatgaatgtgtggcctcaaataatgtgggagaaataagtgtatccaccagactcacagttttgcgggaagatcaaattcccaggggcttccctaccattgacatgggcccacagttgaaggtggttgagcgtactcgcacggccaccatgctttgtgcagccagtggtaatccggatccagaaatcacttggtttaaagatttcttacctgtggacacaagcaacaacaatggtcgtattaagcagttacgatcagaatctattggtggtacaccaataagaggagcccttcagattgagcagagtgaagagtctgaccaaggaaaatatgagtgtgttgccaccaacagcgcgggcactcgctattccgctcctgccaatttatatgtcagagagctgcgagaagttcgccgtgtcccaccaagattctctatcccacccactaatcatgaaatcatgccaggcggaagcgttaatatcacctgtgtggccgtggggtcaccaatgccttatgtaaagtggatgttgggggcagaagatctgacacctgaagatgatatgccaataggaagaaatgtgctagaactgaatgatgtaagacagtcagcaaattacacctgtgttgctatgtcaacactgggtgtcattgaagcaatagcacagatcactgtcaaagccttacccaaacctccaggaactcctgtagtgaccgagagcacagctacaagcatcacactgacgtgggactctgggaaccctgagcctgtttcttattacataattcagcataaacctaaaaactctgaggaactttacaaagaaattgatggggtggcgaccacacgctacagtgtcgctggactaagtccctactcggattatgaattcagggttgttgctgtcaataacattgggcgggggcctcccagcgaacctgtgctaacacaaacctcagagcaagcaccatccagtgccccgagggatgtccaggcacgaatgttgagttcgaccaccattttggtacagtggaaggaacctgaagagccaaatggacagatccaaggatatagagtttattatacaatggatcccactcaacatgtcaacaactggatgaaacacaatgtagctgacagccaaatcactactattggcaacttagtgccccagaaaacatattctgtcaaagtcctggcttttacctcaattggagatggtcccctttcaagtgacatacaagtcatcactcagacaggagtaccagggcagccactaaacttcaaagcagaacctgagtctgaaacaagtattttgctctcttggacacctccacgttcagataccattgccaactatgaactggtctacaaagatggggagcatggagaggagcaacgaattaccattgagccagggacatcatataggctgcaaggactgaaaccaaacagcttatactatttccgtctggctgcacgctcccctcaaggcctgggtgcttctactgcagaaatatcagctagaaccatgcagtcaatgtttgcaaaaaattttcatgtcaaagcagtaatgaagacttccgtgttgctgtcttgggagattccagagaattataactccgccatgcctttcaaaattctttatgatgatgggaaaatggtagaagaagtggatggccgagccacacagaagttaattgtcaacctgaagcctgagaaatcatattcatttgtgctgacaaatcgtggaaacagtgctggtgggctgcagcacagggtcacggcaaagactgcaccagatgtattacgtaccaagcctgccttcattgggaagaccaacttggatggcatgattactgtgcaactgcctgaagtacctgcaaatgagaatataaaaggttactacataataattgtgcctttgaagaaatctcgcgggaaatttatcaagccatgggagagtccagatgaaatggaattagatgagctgcttaaggagatatctaggaagcgcagaagcatccgttatgggagagaagttgaattaaagccatatattgccgctcactttgatgtccttcccactgagttcaccctgggggatgacaagcattatggtggatttacaaacaagcaactccaaagtggtcaagaatatgtcttctttgtgttagcagtaatggaacatgcagagtctaagatgtatgcaaccagcccttactccgaccccgtggtgtcaatggatctggatccgcagccaatcacggatgaagaagaaggcttgatctgggttgtaggtcctgtccttgcagtggtctttatcatctgcattgtcattgctattcttctttataaaagtaaacccgacaggaagagggcagagtccgactctagaaaaagcagcataccgaacaataaggagatcccttcacaccacccaacagaccctgtagaactgaggcgccttaactttcaaacaccgggtatggctagccatcctccaatacccatcttggaacttgcagaccacattgaaagattgaaagcaaatgacaacttgaagttttcccaggaatatgagtcaattgaccctggccagcagttcacttgggaacattcaaacttggaagtaaacaaaccaaagaatagatacgcgaatgtaatcgcatatgatcattcccgggttctcctatcagctatagaagggatcccaggaagtgactatgtgaatgccaactacatagatgggtataggaagcaaaatgcctatattgcaacacagggatctctccccgaaacatttggggacttttggagaatgatatgggaacaacggagtgccacagttgtcatgatgacaaaactagaagaaagatcaagggtgaagtgtgaccagtattggcctagcagaggcacagaaacccacggactcgttcaagtaacgctgcttgatactgtggagctggccacatattgtgttcgaacatttgcactttacaagaatggttcaagtgagaagagagaagtgagacaattccagttcaccgcctggcctgatcatggtgttccagaacaccctacaccttttctagctttcttacgtagagtcaaaacctgtaaccctcccgatgctggtccgatggttgtgcactgcagtgcgggagttggccggactggttgcttcatcgtcatagatgccatgttagaaagaataaagcatgaaaaaactgtagatatttatggccatgtaactttaatgagagcccagaggaactatatggttcaaacagaagaccaatacatctttatccatgatgcactgttagaagcagtgacttgtggaaataccgaagtgccagctagaaacttgtatgcctacattcagaagctgacacaaatagaaacgggagagaatgtcacaggaatggagctcgaatttaagcgtctagccagctcaaaagctcacacctcaaggtttatcagtgccaatcttccatgtaataaattcaaaaatcgccttgttaatattatgccatatgaatccacaagggtatgcctgcagcctatccgtggagtagaaggatctgattacatcaatgccagttttattgatggatacagacaacagaaagcctacatcgctacccaggggcccttggcagagaccactgaagacttctggcggatgctctgggaacacaattccaccatagttgtgatgctcaccaagctgcgtgaaatgggcagagagaaatgtcaccaatactggccagcagaacggtctgcaagataccagtactttgttgtagatcccatggctgagtacaacatgccacagtatatcctaagggaattcaaggtcacagatgccagggacggccagtcccgaacagtaaggcagttccagttcactgactggccagagcaaggagtgccaaagtccggagaaggatttattgacttcatcggccaagtccataaaacaaaagaacagtttggccaagatggacccatttcagtccattgcagcgcgggcgttggaagaactggagtcttcataacgctaagcattgttttggaaagaatgagatatgaaggagttgtagatatcttccagactgtcaaaatgttaagaacacaacgaccagctatggtacagacagaggatcaatatcagttttcctatcgtgccgcactagagtacctgggcagctttgaccactatgcaacgtagaaacccctgacccattctggatttttactacaggcccttcaatatccatggagtctcttctgagccatacagggcacttgagaagtccttcttaacttctagctaacaactacttagtgggactattacacacaaaacaaattaaaaacaaattattccaggtggaccaagaattcacagtttaataatctaacctgaaaaataatgaagagaatcctgactgatgaggcatctgaaggattttatttacagatacctcaaggattcaaaatcaagggaagaagaaatcacagcaaagaaccaccatcttattcaggattgcttgaaaggtgcaaggagaaattgccagaatgctgcagttcagcacaagatatgtgctggtgtggcttctcacaatgaaacggactctgctttgacatcgccccttcccaccatactgctcataataacattttagggggaaaggggag

SEQ ID NO: 171763 - DNA, 1697 bp, Homo sapiens
  Payload ID: 13759
  Gene Symbol: PTPRD
  Gene Name: protein tyrosine phosphatase, receptor type, D
  ENST ID: ENST00000463477
  CDS Start-End: 816-1424
cggcgccgccagccagcctcggcggggagagtgcagtttattctgggcctgtgtggaatagaaagacaattctttatttgactggtaggaaagaaaagagaagactcctcagggtttccaaggaggactggagcggctgctttagtgaagaagtgaagaatcaaggaagtaaaggacctgtctcaaagtcacacaactaggaaatcttgaggagtctgatacttttcatcctccagctataaaatcatcttgtagggggaagctgtacattggtggaaaataaaaggcaagcagttcctggcccgtgatattccagttagaggtgtctgactgacagcatgttggcaccgagggaagcgatgggcttcggctccaggtttctgtcctgagaccacagcagaatgtgccttggacaaaggcttggactccttgatcttctggtaacttcaaaaatctggtctcagggtggtgaactttttcttcgaattcctaacctgtgagcttacgaaaaagggagcatgcctgtcttattctcagtgcctcatgggaaataaaagattgggagatgatagctacctgatgatggtgcctgtccattaactgaacaactgtggttttgaacttcttgaggccagggactgtgtctgaaaacaccgacggtggctaactcaagggagacgtctggtgaacacccgtgggatctaaagaacaagctctgaaagtgttccagctgaaatttcagatcggacagactcgctgcggctccggaggcagtgattccaagctgctcgcgcacgctgctgccaagctgcaggatggtgcacgtagccaggctgctgctgctgctcctcactttcttcctccgcacggatgctgagacacctccaaggtttacacgaacacccgttgatcagacaggggtctctggcggagttgcctctttcatctgccaagctacgggagacccaagacctaaaattgtctggaacaaaaaaggaaagaaagtcagcaatcagagatttgaggtaatagagtttgacgatgggtctggatcagttctcagaatacaacccttacggactccgagggatgaggccatttatgaatgtgtggcctcaaataatgtgggagaaataagtgtatccaccagactcacagttttgcgggaagatcaaattcccaggggcttccctaccattgacatgggcccacagttgaaggtggttgagcgtactcgcacggccaccatgctttgtgcagccagtggtaatccggatccagaaatcacttggtttaaagatttcttacctgtggacacaagcaacaacaatggtcgtattaagcagttacgatcaggtactgatttttctccctcttctctttctctgttacttaatgggtggtccatgtttgtgatgtcatagcctgtttcagagtctgtctttctccttttctctgtgtgttttgcagcttctgtttaatccacattgctcactgctgtgactgtatttttggtaattttttaatttactgctttttcgcagtatttgatggatccattttctcctctttctttcttctttctctgttttcttttgaaacaaatttatttcaacattggacttcattcagaacttgcaaggagatccaatggttgtatccattaaaaaataaaatgttcatattaaaccctaaaa

SEQ ID NO: 171764 - DNA, 521 bp, Homo sapiens
  Payload ID: 13759
  Gene Symbol: PTPRD
  Gene Name: protein tyrosine phosphatase, receptor type, D
  ENST ID: ENST00000481079
  CDS Start-End: 243-521
gcggccgctgctccgcgggattaaattggccgcccggaggcggcggcgcggccgtggcggggcgcgaaggcgctggaggaaagtgttggcggcggcgcgggaggcggtggcggcggctgcccggggccaacatgaccaggctctgaaagtgttccagctgaaatttcagatcggacagactcgctgcggctccggaggcagtgattccaagctgctcgcgcacgctgctgccaagctgcaggatggtgcacgtagccaggctgctgctgctgctcctcactttcttcctccgcacggatgctgagacacctccaaggtttacacgaacacccgttgatcagacaggggtctctggcggagttgcctctttcatctgccaagctacgggagacccaagacctaaaattgtctggaacaaaaaaggaaagaaagtcagcaatcagagatttgaggtaatagagtttgacgatgggtctggatcagttctcagaatacaacccttacggactccgagggatgag

SEQ ID NO: 171765 - DNA, 6210 bp, Homo sapiens
  Payload ID: 13759
  Gene Symbol: PTPRD
  Gene Name: protein tyrosine phosphatase, receptor type, D
  Uniprot ID: P23468
  ENST ID: ENST00000540109
  CDS Start-End: 107-5845
caggctctgaaagtgttccagctgaaatttcagatcggacagactcgctgcggctccggaggcagtgattccaagctgctcgcgcacgctgctgccaagctgcaggatggtgcacgtagccaggctgctgctgctgctcctcactttcttcctccgcacggatgctgagacacctccaaggtttacacgaacacccgttgatcagacaggggtctctggcggagttgcctctttcatctgccaagctacgggagacccaagacctaaaattgtctggaacaaaaaaggaaagaaagtcagcaatcagagatttgaggtaatagagtttgacgatgggtctggatcagttctcagaatacaacccttacggactccgagggatgaggccatttatgaatgtgtggcctcaaataatgtgggagaaataagtgtatccaccagactcacagttttgcgggaagatcaaattcccaggggcttccctaccattgacatgggcccacagttgaaggtggttgagcgtactcgcacggccaccatgctttgtgcagccagtggtaatccggatccagaaatcacttggtttaaagatttcttacctgtggacacaagcaacaacaatggtcgtattaagcagttacgatcagaatctattggtggtacaccaataagaggagcccttcagattgagcagagtgaagagtctgaccaaggaaaatatgagtgtgttgccaccaacagcgcgggcactcgctattccgctcctgccaatttatatgtcagagagctgcgagaagttcgccgtgtcccaccaagattctctatcccacccactaatcatgaaatcatgccaggcggaagcgttaatatcacctgtgtggccgtggggtcaccaatgccttatgtaaagtggatgttgggggcagaagatctgacacctgaagatgatatgccaataggaagaaatgtgctagaactgaatgatgtaagacagtcagcaaattacacctgtgttgctatgtcaacactgggtgtcattgaagcaatagcacagatcactgtcaaagccttacccaaacctccaggaactcctgtagtgaccgagagcacagctacaagcatcacactgacgtgggactctgggaaccctgagcctgtttcttattacataattcagcataaacctaaaaactctgaggaactttacaaagaaattgatggggtggcgaccacacgctacagtgtcgctggactaagtccctactcggattatgaattcagggttgttgctgtcaataacattgggcgggggcctcccagcgaacctgtgctaacacaaacctcagagcaagcaccatccagtgccccgagggatgtccaggcacgaatgttgagttcgaccaccattttggtacagtggaaggaacctgaagagccaaatggacagatccaaggatatagagtttattatacaatggatcccactcaacatgtcaacaactggatgaaacacaatgtagctgacagccaaatcactactattggcaacttagtgccccagaaaacatattctgtcaaagtcctggcttttacctcaattggagatggtcccctttcaagtgacatacaagtcatcactcagacaggagtaccagggcagccactaaacttcaaagcagaacctgagtctgaaacaagtattttgctctcttggacacctccacgttcagataccattgccaactatgaactggtctacaaagatggggagcatggagaggagcaacgaattaccattgagccagggacatcatataggctgcaaggactgaaaccaaacagcttatactatttccgtctggctgcacgctcccctcaaggcctgggtgcttctactgcagaaatatcagctagaaccatgcagtcaaagccgtcagctcctcctcaagacattagttgcaccagcccaagttccactagtattttggtaagttggcaacctccaccagtggaaaaacagaatggcattatcactgaatactccatcaagtacactgcagtggatggggaagatgacaagcctcacgagattttgggaattccttcggacactaccaaataccttttggaacagctggaaaaatggactgaataccggatcactgtgacagcccatacagatgtcggccctggccctgagagcttgtccgtgttgattcgaaccaatgaagatgttcctagtggtcctcctcgcaaagtcgaggtagaggctgtcaactcaacatctgttaaagtctcatggcgctcacccgtgcccaataaacagcatggccagataagaggatatcaggtgcattatgtgaggatggaaaatggtgagcccaagggccagcccatgctgaaagatgtcatgctggctgatgcacagtgggaatttgatgatactactgaacatgacatgatcatttctgggctccagcctgaaacttcctactccctcaccgtcacagcctacacaaccaaaggagatggtgctcgcagcaagcccaaactggtgtccaccactggggcagttccagggaaacctcggcttgtgattaaccacactcagatgaatactgctcttattcagtggcaccctccggtggacacatttggacctcttcagggctaccgtctaaaatttggccgcaaggatatggagccacttactactcttgagttctctgaaaaagaagatcactttacagctacagacatccacaagggagcatcatacgtcttcaggctctcagccagaaacaaagtgggctttggggaggagatggtgaaggagatttccattccagaagaagtaccaactggattccctcaaaaccttcactcagaaggcaccacttcaacctccgtccagttatcttggcaaccacctgtcctggcagagagaaatggcattatcaccaagtatacccttctttatagggatatcaacatcccccttctcccgatggagcagcttattgttccagctgacaccactatgacactcactggcttaaaaccagataccacatacgatgtaaaagtacgtgctcatacgagcaaagggcccgggccatatagtcccagtgtccagttcaggacactgcctgtggatcaagtgtttgcaaaaaattttcatgtcaaagcagtaatgaagacttccgtgttgctgtcttgggagattccagagaattataactccgccatgcctttcaaaattctttatgatgatgggaaaatggtagaagaagtggatggccgagccacacagaagttaattgtcaacctgaagcctgagaaatcatattcatttgtgctgacaaatcgtggaaacagtgctggtgggctgcagcacagggtcacggcaaagactgcaccagatgtattacgtaccaagcctgccttcattgggaagaccaacttggatggcatgattactgtgcaactgcctgaagtacctgcaaatgagaatataaaaggttactacataataattgtgcctttgaagaaatctcgcgggaaatttatcaagccatgggagagtccagatgaaatggaattagatgagctgcttaaggagatatctaggaagcgcagaagcatccgttatgggagagaagttgaattaaagccatatattgccgctcactttgatgtccttcccactgagttcaccctgggggatgacaagcattatggtggatttacaaacaagcaactccaaagtggtcaagaatatgtcttctttgtgttagcagtaatggaacatgcagagtctaagatgtatgcaaccagcccttactccgaccccgtggtgtcaatggatctggatccgcagccaatcacggatgaagaagaaggcttgatctgggttgtaggtcctgtccttgcagtggtctttatcatctgcattgtcattgctattcttctttataaaaggaagagggcagagtccgactctagaaaaagcagcataccgaacaataaggagatcccttcacaccacccaacagaccctgtagaactgaggcgccttaactttcaaacaccgggtatggctagccatcctccaatacccatcttggaacttgcagaccacattgaaagattgaaagcaaatgacaacttgaagttttcccaggaatatgagtcaattgaccctggccagcagttcacttgggaacattcaaacttggaagtaaacaaaccaaagaatagatacgcgaatgtaatcgcatatgatcattcccgggttctcctatcagctatagaagggatcccaggaagtgactatgtgaatgccaactacatagatgggtataggaagcaaaatgcctatattgcaacacagggatctctccccgaaacatttggggacttttggagaatgatatgggaacaacggagtgccacagttgtcatgatgacaaaactagaagaaagatcaagggtgaagtgtgaccagtattggcctagcagaggcacagaaacccacggactcgttcaagtaacgctgcttgatactgtggagctggccacatattgtgttcgaacatttgcactttacaagaatggttcaagtgagaagagagaagtgagacaattccagttcaccgcctggcctgatcatggtgttccagaacaccctacaccttttctagctttcttacgtagagtcaaaacctgtaaccctcccgatgctggtccgatggttgtgcactgcagtgcgggagttggccggactggttgcttcatcgtcatagatgccatgttagaaagaataaagcatgaaaaaactgtagatatttatggccatgtaactttaatgagagcccagaggaactatatggttcaaacagaagaccaatacatctttatccatgatgcactgttagaagcagtgacttgtggaaataccgaagtgccagctagaaacttgtatgcctacattcagaagctgacacaaatagaaacgggagagaatgtcacaggaatggagctcgaatttaagcgtctagccagctcaaaagctcacacctcaaggtttatcagtgccaatcttccatgtaataaattcaaaaatcgccttgttaatattatgccatatgaatccacaagggtatgcctgcagcctatccgtggagtagaaggatctgattacatcaatgccagttttattgatggatacagacaacagaaagcctacatcgctacccaggggcccttggcagagaccactgaagacttctggcggatgctctgggaacacaattccaccatagttgtgatgctcaccaagctgcgtgaaatgggcagagagaaatgtcaccaatactggccagcagaacggtctgcaagataccagtactttgttgtagatcccatggctgagtacaacatgccacagtatatcctaagggaattcaaggtcacagatgccagggacggccagtcccgaacagtaaggcagttccagttcactgactggccagagcaaggagtgccaaagtccggagaaggatttattgacttcatcggccaagtccataaaacaaaagaacagtttggccaagatggacccatttcagtccattgcagcgcgggcgttggaagaactggagtcttcataacgctaagcattgttttggaaagaatgagatatgaaggagttgtagatatcttccagactgtcaaaatgttaagaacacaacgaccagctatggtacagacagaggatcaatatcagttttcctatcgtgccgcactagagtacctgggcagctttgaccactatgcaacgtagaaacccctgacccattctggatttttactacaggcccttcaatatccatggagtctcttctgagccatacagggcacttgagaagtccttcttaacttctagctaacaactacttagtgggactattacacacaaaacaaattaaaaacaaattattccaggtggaccaaggactctgctttgacatcgccccttcccaccatactgctcataataacattttagggggaaaggggagggaatgtttaaaaagaaagtccttgatttagttttttagtattgtaaagatactgctgacctgtgcttcatttctaactgtgtaaacttttttttaacaaaatgtatcattcgataaagtgaatttt

SEQ ID NO: 171766 - DNA, 8224 bp, Homo sapiens
  Payload ID: 13759
  Gene Symbol: PTPRD
  Gene Name: protein tyrosine phosphatase, receptor type, D
  ENST ID: ENST00000537002
  CDS Start-End: 107-4597
caggctctgaaagtgttccagctgaaatttcagatcggacagactcgctgcggctccggaggcagtgattccaagctgctcgcgcacgctgctgccaagctgcaggatggtgcacgtagccaggctgctgctgctgctcctcactttcttcctccgcacggatgctgagacacctccaaggtttacacgaacacccgttgatcagacaggggtctctggcggagttgcctctttcatctgccaagctacgggagacccaagacctaaaattgtctggaacaaaaaaggaaagaaagtcagcaatcagagatttgaggtaatagagtttgacgatgggtctggatcagttctcagaatacaacccttacggactccgagggatgaggccatttatgaatgtgtggcctcaaataatgtgggagaaataagtgtatccaccagactcacagttttgcgggaagatcaaattcccaggggcttccctaccattgacatgggcccacagttgaaggtggttgagcgtactcgcacggccaccatgctttgtgcagccagtggtaatccggatccagaaatcacttggtttaaagatttcttacctgtggacacaagcaacaacaatggtcgtattaagcagttacgatcagaatctattggagcccttcagattgagcagagtgaagagtctgaccaaggaaaatatgagtgtgttgccaccaacagcgcgggcactcgctattccgctcctgccaatttatatgtcagagagctgcgagaagttcgccgtgtcccaccaagattctctatcccacccactaatcatgaaatcatgccaggcggaagcgttaatatcacctgtgtggccgtggggtcaccaatgccttatgtaaagtggatgttgggggcagaagatctgacacctgaagatgatatgccaataggaagaaatgtgctagaactgaatgatgtaagacagtcagcaaattacacctgtgttgctatgtcaacactgggtgtcattgaagcaatagcacagatcactgtcaaagccttacccaaacctccaggaactcctgtagtgaccgagagcacagctacaagcatcacactgacgtgggactctgggaaccctgagcctgtttcttattacataattcagcataaacctaaaaactctgaggaactttacaaagaaattgatggggtggcgaccacacgctacagtgtcgctggactaagtccctactcggattatgaattcagggttgttgctgtcaataacattgggcgggggcctcccagcgaacctgtgctaacacaaacctcagagcaagcaccatccagtgccccgagggatgtccaggcacgaatgttgagttcgaccaccattttggtacagtggaaggaacctgaagagccaaatggacagatccaaggatatagagtttattatacaatggatcccactcaacatgtcaacaactggatgaaacacaatgtagctgacagccaaatcactactattggcaacttagtgccccagaaaacatattctgtcaaagtcctggcttttacctcaattggagatggtcccctttcaagtgacatacaagtcatcactcagacaggagtaccagggcagccactaaacttcaaagcagaacctgagtctgaaacaagtattttgctctcttggacacctccacgttcagataccattgccaactatgaactggtctacaaagatggggagcatggagaggagcaacgaattaccattgagccagggacatcatataggctgcaaggactgaaaccaaacagcttatactatttccgtctggctgcacgctcccctcaaggcctgggtgcttctactgcagaaatatcagctagaaccatgcagtcaacagtgtttgcaaaaaattttcatgtcaaagcagtaatgaagacttccgtgttgctgtcttgggagattccagagaattataactccgccatgcctttcaaaattctttatgatgatgggaaaatggtagaagaagtggatggccgagccacacagaagttaattgtcaacctgaagcctgagaaatcatattcatttgtgctgacaaatcgtggaaacagtgctggtgggctgcagcacagggtcacggcaaagactgcaccagatgtattacgtaccaagcctgccttcattgggaagaccaacttggatggcatgattactgtgcaactgcctgaagtacctgcaaatgagaatataaaaggttactacataataattgtgcctttgaagaaatctcgcgggaaatttatcaagccatgggagagtccagatgaaatggaattagatgagctgcttaaggagatatctaggaagcgcagaagcatccgttatgggagagaagttgaattaaagccatatattgccgctcactttgatgtccttcccactgagttcaccctgggggatgacaagcattatggtggatttacaaacaagcaactccaaagtggtcaagaatatgtcttctttgtgttagcagtaatggaacatgcagagtctaagatgtatgcaaccagcccttactccgaccccgtggtgtcaatggatctggatccgcagccaatcacggatgaagaagaaggcttgatctgggttgtaggtcctgtccttgcagtggtctttatcatctgcattgtcattgctattcttctttataaaaggaagagggcagagtccgactctagaaaaagcagcataccgaacaataaggagatcccttcacaccacccaacagaccctgtagaactgaggcgccttaactttcaaacaccgggtatggctagccatcctccaatacccatcttggaacttgcagaccacattgaaagattgaaagcaaatgacaacttgaagttttcccaggaatatgagtcaattgaccctggccagcagttcacttgggaacattcaaacttggaagtaaacaaaccaaagaatagatacgcgaatgtaatcgcatatgatcattcccgggttctcctatcagctatagaagggatcccaggaagtgactatgtgaatgccaactacatagatgggtataggaagcaaaatgcctatattgcaacacagggatctctccccgaaacatttggggacttttggagaatgatatgggaacaacggagtgccacagttgtcatgatgacaaaactagaagaaagatcaagggtgaagtgtgaccagtattggcctagcagaggcacagaaacccacggactcgttcaagtaacgctgcttgatactgtggagctggccacatattgtgttcgaacatttgcactttacaagaatggttcaagtgagaagagagaagtgagacaattccagttcaccgcctggcctgatcatggtgttccagaacaccctacaccttttctagctttcttacgtagagtcaaaacctgtaaccctcccgatgctggtccgatggttgtgcactgcagtgcgggagttggccggactggttgcttcatcgtcatagatgccatgttagaaagaataaagcatgaaaaaactgtagatatttatggccatgtaactttaatgagagcccagaggaactatatggttcaaacagaagaccaatacatctttatccatgatgcactgttagaagcagtgacttgtggaaataccgaagtgccagctagaaacttgtatgcctacattcagaagctgacacaaatagaaacgggagagaatgtcacaggaatggagctcgaatttaagcgtctagccagctcaaaagctcacacctcaaggtttatcagtgccaatcttccatgtaataaattcaaaaatcgccttgttaatattatgccatatgaatccacaagggtatgcctgcagcctatccgtggagtagaaggatctgattacatcaatgccagttttattgatggatacagacaacagaaagcctacatcgctacccaggggcccttggcagagaccactgaagacttctggcggatgctctgggaacacaattccaccatagttgtgatgctcaccaagctgcgtgaaatgggcagagagaaatgtcaccaatactggccagcagaacggtctgcaagataccagtactttgttgtagatcccatggctgagtacaacatgccacagtatatcctaagggaattcaaggtcacagatgccagggacggccagtcccgaacagtaaggcagttccagttcactgactggccagagcaaggagtgccaaagtccggagaaggatttattgacttcatcggccaagtccataaaacaaaagaacagtttggccaagatggacccatttcagtccattgcagcgcgggcgttggaagaactggagtcttcataacgctaagcattgttttggaaagaatgagatatgaaggagttgtagatatcttccagactgtcaaaatgttaagaacacaacgaccagctatggtacagacagaggatcaatatcagttttcctatcgtgccgcactagagtacctgggcagctttgaccactatgcaacgtagaaacccctgacccattctggatttttactacaggcccttcaatatccatggagtctcttctgagccatacagggcacttgagaagtccttcttaacttctagctaacaactacttagtgggactattacacacaaaacaaattaaaaacaaattattccaggtggaccaagaattcacagtttaataatctaacctgaaaaataatgaagagaatcctgactgatgaggcatctgaaggattttatttacagatacctcaaggattcaaaatcaagggaagaagaaatcacagcaaagaaccaccatcttattcaggattgcttgaaaggtgcaaggagaaattgccagaatgctgcagttcagcacaagatatgtgctggtgtggcttctcacaatgaaacggactctgctttgacatcgccccttcccaccatactgctcataataacattttagggggaaaggggagggaatgtttaaaaagaaagtccttgatttagttttttagtattgtaaagatactgctgacctgtgcttcatttctaactgtgtaaacttttttttaacaaaatgtatcattcgataaagtgaattttaaaaaagttacataactcttcatttttttatttccaaatcgtaggtttttttaagctgtagaactgttatctgtaatatcttgctgtagaaatatcaaatcatttgaaaatttgcacatttttgtgcaaaactcaatctacagtatcagtctcgtcagatatattaattttacacttcagttttgattggtgagaaagtacccattctcttcaaataatcaaagataattattattttgttttgtttttggaatcaacagggaggcgcaaagtataaagttgctgctaacatatatacatatatatccatattttataagggtgtctatgtatatatagacagtgtgtccacacaaaaaatagatacagttatcagtcagtcagttcttccatgatttagtttttttaaacgtagaaaagctattgtaaacatctctttccatttattcttaattttttgacatattggtatttctttaaagggaaatgaggaatgcacatcagtgattgattgtcaaacctcaccccctgatttcctacctaatctacccccacctaaccaatcaatcacatccacaaattgttttgtttgtttgttagtcaggcttccaacaaagttcaatatttctaacactctagtgcaataaaaattattattaaatagctaagaggtgtgcatgtgggaaaggtcagtgcatatccctttaggaggggagaatgttgtaatatatcagctatcgagttgtttaaaaaaagtgtattcaatcgtatattgtctatagtatgtgctatgaaatttgcatttatgatatgtaacaggggcaaagccaaattcatgttactctgttcagtcagaaacattttgtggcatacagcattcctgggaagtgctgtactttgtttcgttttggttttagttttgcatttagagtgccttataattgatgcctattttaatagcatttctttttagcttttggttcgtatttccattcactgttcgtatctgttactttctattaaagcattatctgtttaccacatgtacaaaaactctttgaataatatgcattcctagttttcagccaagtcggggatgttagtgattgtaccagcccaaagcacttggataatcagggcccttcttccttttataatcaatcatcaacatcagaaaaagctacttgttttatttatattcccttccaaatccgctctggaacatgcagtaactgcaccaaacttattttagtaacaaatatcattggcaactttggaatatatttgatattccattaggatttttctaaaaggggaaataaactatatatatatatgtatcttacccccaattcttccaacagaatttctataggaagccatggatgatggcataagtttgccacatattacatgattttaaataatcctcaaaatacccaaggaactcttaaagagttttggtatgagtatactactttggtttaattttagcttcatggatgttctgcatggaaggatttttgttttccacattttcccattgctagcagagtgaaatccaagagaccaaacatttgcaagcattgtatttgagcacttttgtaaaaaacaaagaaaaagaaaaaaaagaaaatatatataatactaaaaaaaagtatctagaaggctacctcagaatgagactctctaacctacatcagaaccagagaagaatgtgcactatgtgggtctgttatcattattttcttttagtttgtatctttttggagatttatccaagtgccagattactcagtgctataattttcttttagttaaacaaagggggtcagacagacattgcatcatccagacatgccttgttggacatgtagaatccgatggagcactgcacaccagaatgattggccaatgagcagcttctctccctgaaacaataactgcccatttggcaaagggaaagatgacaataatcagaagaagaaaatgaatgggatgcataccatagacgaacgaggcggagactattgcgggaatcttactgttcaggagctgttcctagaactaactcccttactgtcattgatgtgcattccactctgtgcttttctgtacaaccattcaagttttaatttcccaggtgaaccatctttatctgccattaccacaagctttcaagtttccagttattttcatcatcataaccagtacggtgctattatttacctatgtacgtgtagttatgtataattttgtaattagttacaatggtaaaaaaaatcaaaatatataaaaagtgatttgtacagaactttattttagctcttttttaaaaatgatttgcatggttagaaaacggcgaggacagccaggggagggaagggcctctagggaactttgcactttctatacctttgtactatgcactgccctattgattctacacccaataatgatattacttgaacccatctgtaagaaactgcttcggaaattcatttgtgtgtatgtaaataacacaacatagaaacaggaagggaaaaaagtctgcagtaatgcacgtattttttttctttcctgtttattttcggttttgctttaagtccttttatttttaattccctttttgtttttctttttgggttttggttccttttgggtttatgggtgccctgatactccagcagagatcagaaggctacagatccattctatccatccgttatgtggctttgccatcccagcttggagtgtctttacaaagataataacagttgtgttctttgctctcgttttggatgcatagactgaaaaattaaaacaaataacttgtaaaatggcttgttaaaaaatacaattacctctaattagtagtacgcgtaaatgttttacagaatgaaaggcgtgctttttattttcttacttcgttacattggtggcgaaagaagtctgtatgaaaatcagttctttgctgacacaagttccatttgttacaaatgaattctaataaaaatgtcagtgttatgc

SEQ ID NO: 171767 - DNA, 5331 bp, Homo sapiens
  Payload ID: 13760
  Gene Symbol: PTPRE
  Gene Name: protein tyrosine phosphatase, receptor type, E
  Uniprot ID: P23469
  ENST ID: ENST00000254667
  CDS Start-End: 280-2382
agccggagctggagccgaggcggcggcgggacgcggccggccggacaaatttcctgctaggctgcggacagcgggcggcaggagccggcgcgagcggcttcaggaacccacggcctctgcgcgtccccgcgacccttcttcgcgcccggcgaagacagccgggcgccccggagggcggcgggcaggcgcccgggagatgcggagcctccgctgcagcgcgatctgcgcgaccagaccggcccccccgagactatagccttcactttccctcggtccaccatggagcccttgtgtccactcctgctggtgggttttagcttgccgctcgccagggctctcaggggcaacgagaccactgccgacagcaacgagacaaccacgacctcaggccctccggacccgggcgcctcccagccgctgctggcctggctgctactgccgctgctgctcctcctcctcgtgctccttctcgccgcctacttcttcaggttcaggaagcagaggaaagctgtggtcagcaccagcgacaagaagatgcccaacggaatcttggaggagcaagagcagcaaagggtgatgctgctcagcaggtcaccctcagggcccaagaagtattttcccatccccgtggagcacctggaggaggagatccgtatcagatccgccgacgactgcaagcagtttcgggaggagttcaactcattgccatctggacacatacaaggaacttttgaactggcaaataaagaagaaaacagagaaaaaaacagatatcccaacatccttcccaatgaccattctagggtgattctgagccaactggatggaattccctgttcagactacatcaatgcttcctacatagatggttacaaagagaagaataaattcatagcagctcaaggtcccaaacaggaaacggttaacgacttctggagaatggtctgggagcaaaagtctgcgaccatcgtcatgttaacaaacttgaaagaaaggaaagaggaaaagtgccatcagtactggcccgaccaaggctgctggacctatggaaacatccgggtgtgcgtggaggactgcgtggttttggtcgactacaccatccggaagttctgcatacagccacagctccccgacggctgcaaagcccccaggctggtctcacagctgcacttcaccagctggcccgacttcggagtgccttttacccccattgggatgctgaagttcctcaagaaagtaaagacgctcaaccccgtgcacgctgggcccatcgtggtccactgtagcgcgggcgtgggccggacgggcaccttcattgtgatcgatgccatgatggccatgatgcacgcggagcagaaggtggatgtgtttgaatttgtgtctcgaatccgtaatcagcgccctcagatggttcaaacggatatgcagtacacgttcatctaccaagccttactcgagtactacctctacggggacacagagctggacgtgtcctccctggagaagcacctgcagaccatgcacggcaccaccacccacttcgacaagatcgggctggaggaggagttcaggaaattgacaaatgtccggatcatgaaggagaacatgaggacgggcaacttgccggcaaacatgaagaaggccagggtcatccagatcatcccgtatgacttcaaccgagtgatcctttccatgaaaaggggtcaagaatacacagactacatcaacgcatccttcatagacggctaccgacagaaggactatttcatcgccacccaggggccactggcacacacggttgaggacttctggaggatgatctgggaatggaaatcccacactatcgtgatgctgacggaggtgcaggagagagagcaggataaatgctaccagtattggccaaccgagggctcagttactcatggagaaataacgattgagataaagaatgataccctttcagaagccatcagtatacgagactttctggtcactctcaatcagccccaggcccgccaggaggagcaggtccgagtagtgcgccagtttcacttccacggctggcctgagatcgggattcccgccgagggcaaaggcatgattgacctcatcgcagccgtgcagaagcagcagcagcagacaggcaaccaccccatcaccgtgcactgcagtgccggagctgggcgaacaggtacattcatagccctcagcaacattttggagcgagtaaaagccgagggacttttagatgtatttcaagctgtgaagagtttacgacttcagagaccacatatggtgcaaaccctggaacagtatgaattctgctacaaagtggtacaagattttattgatatattttctgattatgctaatttcaaatgaagattcctgccttaaaatattttttaatttaatggtcagtatattttgtaaaaatcatgttaatttatttcatagttgacattaatatcttccctaatttctttgtatatattttgttatgccttaaaggccacctgctatacagttgttaaatcttaaatatgctttttaaaaattggaataatgtattaaggtcaaataatatcccataaaatatatatttctgctaatattagtaaatatcttaatttttcattagattcatatcatttaatttcacatattcaacacctttaaatgttgtaatcttaatatgcgaagtgtgcctctgcaagatactaacacaaagctcatgttaagaaaacagttgaggactcagaagtcagttcgaaaatgcactttcctaacagtgaattcacaaccctgaacagcagcatttttggaaggcaaactgttcgtgatggtacaatgtaaatggggacttctgtaaagttctcagtttcggtccatgtggtttatctttacattttaaagatcaaagaagtctttacaacctgaatccaggtctaaaacacactagagtagctggtgactataaataatattttaaaatgctgtgtctacaccatcaagactgtgtctacactatcttggctgaacgagaagagatgtaaatgctgggtggtcccgttgacccacggcgttgggtacaacaaaaccagccatcggagttacaccccaaagcaccatttgctgtccagctgcctgtcgtttggcccagaccaccctcagaaaaaaaccagctgcctctcccattctcccctcccgttctgccacagcggcctgggctggtccagtgctatgcctggaggctcaacacaaaacttcccatccaaacattcagatgaactgagcgtcttacacacgcagtacagaggagcacacattaggatagaaacagtagaataaccacgggcaattaaactttaaattttctgagcagcattttggtatttaaacatttcttgtaaaaagctgagacagtttgtaagaaaagaatccttaaaatctagatttataccattttttaaagtcccacctttcaatgtttaataaaacaaaaagagaaatccttaatctaaaagctaaattatttttgaatggaaatactactgagaccattgacactggataacagtaatgatcccattaccagataagattgactgacggggaaaaaaaaaaaaaaagaatggggtgtgaatgtaccaacactgaatcttacagcagttatctttctatggccattaggtacctagcagatgtgcacaatataaacaaaaagatatctggcctaccttactactaaaagcatttaacacgtgcatttttggtacttttttttttgttttctaaaagctacataaaggccttatttgacattttcactgataactgatcgcaccctcatgttgcagtgttcgtcccctattcattaacagtgtgtgcaaatgcaaccccaggacacattattgttctgatagatgctcacagggaatcaagcttctcgcccactccacggctctgagccccatccaagggcaagacttggtgcccagctggaaggacgaaagcacactttgtgaccgccatcctcaccagctgcatgcctgggctgcacactgctgaacgtgctcctctctccttctctgtacaatgattcagcatctcggcggaagaggaaaatggagctttttgaggctcgccaggtcccttttgttttcaccattaaaattccaaacccaaagcctttgtttgactgaaggagaagagagggaagtaagcttctgttcagcacctgaaccctagaaaaagagccagtttgctacgatgaaggtgacatttctctggtcatttatttgagagttcgaagtcaaagtcgaggggcaccggctttggttcatgtctaggagccctctgtcagaatccttgaagccctttaatggtctaactggcatctcttgtatcaagaagtacctttaaggtagaccttttcagggtgccctcaggaaagggccctgctcatgtttttttcctgtccccttagaccaaccccaggtgtccactgcaggggttctgcctgttcccaaactttttccattccaggaacaaaggagaagccactttccccaggacgcaagactctcccctccactgtccgggacagcgttcgccctttagcggggaggtcattacagcctcatggcctctaccaaggccccagatcacaggatctcctgggccttggagcacctcacgctgggggaatcaatccctgagggactcagaatcttctccgtgcaacctggaaagttcatctcttgtttccttcagtcaaagaaagtccattgtacataacaaaacagcccccaaacagcccagtgccgacaccattgttcctttcacactttcctttgttgcatgcagttgggttcaaatgccaaatagtgattagaagacgaccattctgatctgtgtgtgatctggtcactatgtgactgcctttacggtttctctccatgtgctatatgaatgaagaatgcataccagtgttttaaaaggtatttttatgtgtttttaaacacttttttaaatgagcctgacacctgtgtttcagcatttggagacatccccatgttattcttttaagtgtataattactgatacttttttgtttgtttgtttaactaagttgtgtttaacttatgtgcagtctttataatgtatgtatgttattacagtttcaactatcatattttctttgattacatttataatttgatcttgctctgattataatgccagtgaatgttgctgaactctttgtatatgcaaattgcaagatttaaaccattctgatgcaaggataaacctttactttgactacca

SEQ ID NO: 171768 - DNA, 4957 bp, Homo sapiens
  Payload ID: 13760
  Gene Symbol: PTPRE
  Gene Name: protein tyrosine phosphatase, receptor type, E
  Uniprot ID: P23469
  ENST ID: ENST00000306042
  CDS Start-End: 80-2008
gtgcagcagagggcagctgagaggctgggtggctgggcctgggagacacacagaggccaggccttagcgcggctcagccatgagcaacaggagtagcttttcccggctcacctggttcaggaagcagaggaaagctgtggtcagcaccagcgacaagaagatgcccaacggaatcttggaggagcaagagcagcaaagggtgatgctgctcagcaggtcaccctcagggcccaagaagtattttcccatccccgtggagcacctggaggaggagatccgtatcagatccgccgacgactgcaagcagtttcgggaggagttcaactcattgccatctggacacatacaaggaacttttgaactggcaaataaagaagaaaacagagaaaaaaacagatatcccaacatccttcccaatgaccattctagggtgattctgagccaactggatggaattccctgttcagactacatcaatgcttcctacatagatggttacaaagagaagaataaattcatagcagctcaaggtcccaaacaggaaacggttaacgacttctggagaatggtctgggagcaaaagtctgcgaccatcgtcatgttaacaaacttgaaagaaaggaaagaggaaaagtgccatcagtactggcccgaccaaggctgctggacctatggaaacatccgggtgtgcgtggaggactgcgtggttttggtcgactacaccatccggaagttctgcatacagccacagctccccgacggctgcaaagcccccaggctggtctcacagctgcacttcaccagctggcccgacttcggagtgccttttacccccattgggatgctgaagttcctcaagaaagtaaagacgctcaaccccgtgcacgctgggcccatcgtggtccactgtagcgcgggcgtgggccggacgggcaccttcattgtgatcgatgccatgatggccatgatgcacgcggagcagaaggtggatgtgtttgaatttgtgtctcgaatccgtaatcagcgccctcagatggttcaaacggatatgcagtacacgttcatctaccaagccttactcgagtactacctctacggggacacagagctggacgtgtcctccctggagaagcacctgcagaccatgcacggcaccaccacccacttcgacaagatcgggctggaggaggagttcaggaaattgacaaatgtccggatcatgaaggagaacatgaggacgggcaacttgccggcaaacatgaagaaggccagggtcatccagatcatcccgtatgacttcaaccgagtgatcctttccatgaaaaggggtcaagaatacacagactacatcaacgcatccttcatagacggctaccgacagaaggactatttcatcgccacccaggggccactggcacacacggttgaggacttctggaggatgatctgggaatggaaatcccacactatcgtgatgctgacggaggtgcaggagagagagcaggataaatgctaccagtattggccaaccgagggctcagttactcatggagaaataacgattgagataaagaatgataccctttcagaagccatcagtatacgagactttctggtcactctcaatcagccccaggcccgccaggaggagcaggtccgagtagtgcgccagtttcacttccacggctggcctgagatcgggattcccgccgagggcaaaggcatgattgacctcatcgcagccgtgcagaagcagcagcagcagacaggcaaccaccccatcaccgtgcactgcagtgccggagctgggcgaacaggtacattcatagccctcagcaacattttggagcgagtaaaagccgagggacttttagatgtatttcaagctgtgaagagtttacgacttcagagaccacatatggtgcaaaccctggaacagtatgaattctgctacaaagtggtacaagattttattgatatattttctgattatgctaatttcaaatgaagattcctgccttaaaatattttttaatttaatggtcagtatattttgtaaaaatcatgttaatttatttcatagttgacattaatatcttccctaatttctttgtatatattttgttatgccttaaaggccacctgctatacagttgttaaatcttaaatatgctttttaaaaattggaataatgtattaaggtcaaataatatcccataaaatatatatttctgctaatattagtaaatatcttaatttttcattagattcatatcatttaatttcacatattcaacacctttaaatgttgtaatcttaatatgcgaagtgtgcctctgcaagatactaacacaaagctcatgttaagaaaacagttgaggactcagaagtcagttcgaaaatgcactttcctaacagtgaattcacaaccctgaacagcagcatttttggaaggcaaactgttcgtgatggtacaatgtaaatggggacttctgtaaagttctcagtttcggtccatgtggtttatctttacattttaaagatcaaagaagtctttacaacctgaatccaggtctaaaacacactagagtagctggtgactataaataatattttaaaatgctgtgtctacaccatcaagactgtgtctacactatcttggctgaacgagaagagatgtaaatgctgggtggtcccgttgacccacggcgttgggtacaacaaaaccagccatcggagttacaccccaaagcaccatttgctgtccagctgcctgtcgtttggcccagaccaccctcagaaaaaaaccagctgcctctcccattctcccctcccgttctgccacagcggcctgggctggtccagtgctatgcctggaggctcaacacaaaacttcccatccaaacattcagatgaactgagcgtcttacacacgcagtacagaggagcacacattaggatagaaacagtagaataaccacgggcaattaaactttaaattttctgagcagcattttggtatttaaacatttcttgtaaaaagctgagacagtttgtaagaaaagaatccttaaaatctagatttataccattttttaaagtcccacctttcaatgtttaataaaacaaaaagagaaatccttaatctaaaagctaaattatttttgaatggaaatactactgagaccattgacactggataacagtaatgatcccattaccagataagattgactgacggggaaaaaaaaaaaaaaagaatggggtgtgaatgtaccaacactgaatcttacagcagttatctttctatggccattaggtacctagcagatgtgcacaatataaacaaaaagatatctggcctaccttactactaaaagcatttaacacgtgcatttttggtacttttttttttgttttctaaaagctacataaaggccttatttgacattttcactgataactgatcgcaccctcatgttgcagtgttcgtcccctattcattaacagtgtgtgcaaatgcaaccccaggacacattattgttctgatagatgctcacagggaatcaagcttctcgcccactccacggctctgagccccatccaagggcaagacttggtgcccagctggaaggacgaaagcacactttgtgaccgccatcctcaccagctgcatgcctgggctgcacactgctgaacgtgctcctctctccttctctgtacaatgattcagcatctcggcggaagaggaaaatggagctttttgaggctcgccaggtcccttttgttttcaccattaaaattccaaacccaaagcctttgtttgactgaaggagaagagagggaagtaagcttctgttcagcacctgaaccctagaaaaagagccagtttgctacgatgaaggtgacatttctctggtcatttatttgagagttcgaagtcaaagtcgaggggcaccggctttggttcatgtctaggagccctctgtcagaatccttgaagccctttaatggtctaactggcatctcttgtatcaagaagtacctttaaggtagaccttttcagggtgccctcaggaaagggccctgctcatgtttttttcctgtccccttagaccaaccccaggtgtccactgcaggggttctgcctgttcccaaactttttccattccaggaacaaaggagaagccactttccccaggacgcaagactctcccctccactgtccgggacagcgttcgccctttagcggggaggtcattacagcctcatggcctctaccaaggccccagatcacaggatctcctgggccttggagcacctcacgctgggggaatcaatccctgagggactcagaatcttctccgtgcaacctggaaagttcatctcttgtttccttcagtcaaagaaagtccattgtacataacaaaacagcccccaaacagcccagtgccgacaccattgttcctttcacactttcctttgttgcatgcagttgggttcaaatgccaaatagtgattagaagacgaccattctgatctgtgtgtgatctggtcactatgtgactgcctttacggtttctctccatgtgctatatgaatgaagaatgcataccagtgttttaaaaggtatttttatgtgtttttaaacacttttttaaatgagcctgacacctgtgtttcagcatttggagacatccccatgttattcttttaagtgtataattactgatacttttttgtttgtttgtttaactaagttgtgtttaacttatgtgcagtctttataatgtatgtatgttattacagtttcaactatcatattttctttgattacatttataatttgatcttgctctgattataatgccagtgaatgttgctgaactctttgtatatgcaaattgcaagatttaaaccattctgatgcaaggataaacctttactttgactacca

SEQ ID NO: 171769 - DNA, 779 bp, Homo sapiens
  Payload ID: 13760
  Gene Symbol: PTPRE
  Gene Name: protein tyrosine phosphatase, receptor type, E
  ENST ID: ENST00000442830
  CDS Start-End: 360-779
gagcggcttcaggaacccacggcctctgcgcgtccccgcgacccttcttcgcgcccggcgaagacagccgggcgccccggagggcggcgggcaggcgcccgggagatgcggagcctccgctgcagcgcgatctgcgcgaccagaccggcccccccgagtaagcgcttgcagccagttgtctagttgtcagaagccgagctcatcagcgggctcctggtgtcggcgttctgctgctggaaggtcagggagttccctggaccccacggaagaagctgtctccatgaaggacagggaccgtgccgtgaaccttttattctcccactgacatgactatagccttcactttccctcggtccaccatggagcccttgtgtccactcctgctggtgggttttagcttgccgctcgccagggctctcaggggcaacgagaccactgccgacagcaacgagacaaccacgacctcaggccctccggacccgggcgcctcccagccgctgctggcctggctgctactgccgctgctgctcctcctcctcgtgctccttctcgccgcctacttcttcaggttcaggaagcagaggaaagctgtggtcagcaccagcgacaagaagatgcccaacggaatcttggaggagcaagagcagcaaagggtgatgctgctcagcaggtcaccctcagggcccaagaagtattttcccatccccgtggagcacctggaggaggagatccgtatcagatccgccgacgactgcaagcagtttcgggaggagttcaac

SEQ ID NO: 171770 - DNA, 2304 bp, Homo sapiens
  Payload ID: 13760
  Gene Symbol: PTPRE
  Gene Name: protein tyrosine phosphatase, receptor type, E
  ENST ID: ENST00000455661
  CDS Start-End: 1844-2304
atctcaaatcctgttgcagtcagtagcgctggctgtctgcagtagagatggttttcaatgattgtttcagaaattccttatcaacagaaaatgaacgagacggggagttttcagaaaataaatggatttgcagacaacttaacgtcatcatcgaagtcaccaaagaaagcaaagcagcgactggggaagctgaggctgaagtagcaagggcatgccacccaggctgctattccagtcgctgtgaaagcctggtcactgtctttgccacgcagaacacatctctgggaatgctgtcgatctatgcctccatcttttaaaggctttccatttctgtctggattttttctttatgggaggcagaaataatagtgaattgaatgaaatggagtatataagtgtctagcacagtccttggcacatagaaagtgctctgtaaacagtacttcgcatcaaattcttgggatgaatgaaagtgagtgcctggcgctgcacataagaaaagacgtggcagcaaaccatcctcccgacatgacgtgctgcgttggtgcgtttacgtccctgttccttctgaaagactcaaaattgtgttggagctactggtgcacctttgtaagacctgcactaacgaccgcgccactgggaagggcacttctttatgaagtcgccgtattcccagggagactggtcaacccatacaatgtgaaaaaaaaagaagctatgtgaaaaaatattcccctttgtcatagagaaggagaacttggtgaggctgggcagctgcaggagcctcagtttttcagataacagaacagagtagaccttgagggtccatttccctttttgttttaggaagtgctgtagaagggggcaaagagatctttgatatgagaaggtatttcttcaaagcagcatcgtgcctgaaatagcattgttctttacgctgagagaggaggaaatgggaatttggtgttcaacgggtttaaagtttcagttacaagaaatggacaagtccgagagctctgctgtgccacatcatgcctaaagtcaccgagactgtgttgtacacttttttgttaaaaggtaaatctcatgttaaatgttgttactacaattaaaaagaagccctaggctgtgtttgcagaaaggcactaaccatacatgtgctcaagagcccttttgtgttttcttcacttcatgttgtagttcaatttagttttgctttgcaaggatcctcggaaagtgtatcatcagcaatgacttttattttagaactaaatgtgaaccacggggggaatcatgatcgacattgctcgttgtcctttcttcctccctgtgggctgtgaatccaactcgtcctgggagcagggcgctctcgccttctgttcctctccgagctcagtgcacagaagcattctgcttacccagctgggactgctgactgcaccatcgagcacgcaggttgcactgttctcagcagctacactggattatatgccgcctttcttactgactgattatgaacttaaaacaaattcactctgctgctgtgaattatacatttatttttaagcatttatttcaactcgagatgagcggtctctcctgtaaatttctccctgctggatctttgctctggtttctggtgacatagtgtgagtgccggcagccgcgagcctcagaaggaaaattacaaagggaatactcagtaaatgatgtattgcctttcgcatcagtagcctgcttggaaatgttcaaattatcagcccaggagactccagtgctgtggacatgggtctgaacgaattgatcacctaggggctactgagaacgcggtgctctgtccaccatggagcccttgtgtccactcctgctggtgggttttagcttgccgctcgccagggctctcaggggcaacgagaccactgccgacagcaacgagacaaccacgacctcaggccctccggacccgggcgcctcccagccgctgctggcctggctgctactgccgctgctgctcctcctcctcgtgctccttctcgccgcctacttcttcaggttcaggaagcagaggaaagctgtggtcagcaccagcgacaagaagatgcccaacggaatcttggaggagcaagagcagcaaagggtgatgctgctcagcaggtcaccctcagggcccaagaagtattttcccatccccgtggagcacctggaggaggagatccgtatcagatccgccgacgactgcaagcagtttcgggaggagttcaactcattgccatctggacacatacaaggaacttttgaactggc

SEQ ID NO: 171771 - DNA, 5736 bp, Homo sapiens
  Payload ID: 13760
  Gene Symbol: PTPRE
  Gene Name: protein tyrosine phosphatase, receptor type, E
  ENST ID: ENST00000479896
  CDS Start-End: 19-1629
ccttagcgcggctcagccatgagcaacaggagtagcttttcccggctcacctggttcaggaagcagaggaaagctgtggtcagcaccagcgacaagaagatgcccaacggaatcttggaggagcaagagcagcaaagggtgatgctgctcagcaggtcaccctcagggcccaagaagtattttcccatccccgtggagcacctggaggaggagatccgtatcagatccgccgacgactgcaagcagtttcgggaggagttcaactcattgccatctggacacatacaaggaacttttgaactggcaaataaagaagaaaacagagaaaaaaacagatatcccaacatccttcccaatgaccattctagggtgattctgagccaactggatggaattccctgttcagactacatcaatgcttcctacatagatggttacaaagagaagaataaattcatagcagctcaaggtcccaaacaggaaacggttaacgacttctggagaatggtctgggagcaaaagtctgcgaccatcgtcatgttaacaaacttgaaagaaaggaaagaggaaaagtgccatcagtactggcccgaccaaggctgctggacctatggaaacatccgggtgtgcgtggaggactgcgtggttttggtcgactacaccatccggaagttctgcatacagccacagctccccgacggctgcaaagcccccaggctggtctcacagctgcacttcaccagctggcccgacttcggagtgccttttacccccattgggatgctgaagttcctcaagaaagtaaagacgctcaaccccgtgcacgctgggcccatcgtggtccactgtagcgcgggcgtgggccggacgggcaccttcattgtgatcgatgccatgatggccatgatgcacgcggagcagaaggtggatgtgtttgaatttgtgtctcgaatccgtaatcagcgccctcagatggttcaaacggatatgcagtacacgttcatctaccaagccttactcgagtactacctctacggggacacagagctggacgtgtcctccctggagaagcacctgcagaccatgcacggcaccaccacccacttcgacaagatcgggctggaggaggagttcaggaaattgacaaatgtccggatcatgaaggagaacatgaggacgggcaacttgccggcaaacatgaagaaggccagggtcatccagatcatcccgtgtaaggcacccgtggcgtggcttgggcagggctggggcggggctggtgccggaggctttcatcctggagaagccattgaccgcttacccctgtgcaccagggtcaaaagcagggtgtcctctggcctcaggctaagggctcctgtgtgctgtaccaaatgtcaggtagaaaagacacctgtgaagcaccagctgacccagacagtcctgcatgggtctcaggcaagctgcttcggatatgagcttgcagatgcgggagggcagccgaggctgatttcaggggagggcttcacagaagctggagatttgcggcaggcacgacttgggattccttgtctcattccttgtctccccaagcctgggcagaggcccgcctcccccttacacagaggggcctgagccacccagccgaggccatgcaggtgaactcagctgagaccacctaggaaaaggctgtggccttgaggaggacaagaaatgggcctagggtagagtcaggacactggtctgccacccaggtcatgggagagggaaggaggacctggcaggtgtgggaggagtggaggcaaagctggcaagaagacagggccacatgcagtgggcaggggagtgggaatcgggaggctcaccaagtgggaaaaagagaaacttgagaaacccggccccaaagcagactccacagggatccgaggaactagggagggaggtgggagatgccccgcttgggaggagggtgtgcctcgttatagacttgtcctcgacagagtcacagctcaacaaacaccatctggaaacagctgggagcaggcctgctgcagcagggtctccccgagcactgcagatgacttcaaccgagtgatcctttccatgaaaaggggtcaagaatacacagactacatcaacgcatccttcatagacggctaccgacagaaggactatttcatcgccacccaggggccactggcacacacggttgaggacttctggaggatgatctgggaatggaaatcccacactatcgtgatgctgacggaggtgcaggagagagagcaggataaatgctaccagtattggccaaccgagggctcagttactcatggagaaataacgattgagataaagaatgataccctttcagaagccatcagtatacgagactttctggtcactctcaatcagccccaggcccgccaggaggagcaggtccgagtagtgcgccagtttcacttccacggctggcctgagatcgggattcccgccgagggcaaaggcatgattgacctcatcgcagccgtgcagaagcagcagcagcagacaggcaaccaccccatcaccgtgcactgcagtgccggagctgggcgaacaggtacattcatagccctcagcaacattttggagcgagtaaaagccgagggacttttagatgtatttcaagctgtgaagagtttacgacttcagagaccacatatggtgcaaaccctggaacagtatgaattctgctacaaagtggtacaagattttattgatatattttctgattatgctaatttcaaatgaagattcctgccttaaaatattttttaatttaatggtcagtatattttgtaaaaatcatgttaatttatttcatagttgacattaatatcttccctaatttctttgtatatattttgttatgccttaaaggccacctgctatacagttgttaaatcttaaatatgctttttaaaaattggaataatgtattaaggtcaaataatatcccataaaatatatatttctgctaatattagtaaatatcttaatttttcattagattcatatcatttaatttcacatattcaacacctttaaatgttgtaatcttaatatgcgaagtgtgcctctgcaagatactaacacaaagctcatgttaagaaaacagttgaggactcagaagtcagttcgaaaatgcactttcctaacagtgaattcacaaccctgaacagcagcatttttggaaggcaaactgttcgtgatggtacaatgtaaatggggacttctgtaaagttctcagtttcggtccatgtggtttatctttacattttaaagatcaaagaagtctttacaacctgaatccaggtctaaaacacactagagtagctggtgactataaataatattttaaaatgctgtgtctacaccatcaagactgtgtctacactatcttggctgaacgagaagagatgtaaatgctgggtggtcccgttgacccacggcgttgggtacaacaaaaccagccatcggagttacaccccaaagcaccatttgctgtccagctgcctgtcgtttggcccagaccaccctcagaaaaaaaccagctgcctctcccattctcccctcccgttctgccacagcggcctgggctggtccagtgctatgcctggaggctcaacacaaaacttcccatccaaacattcagatgaactgagcgtcttacacacgcagtacagaggagcacacattaggatagaaacagtagaataaccacgggcaattaaactttaaattttctgagcagcattttggtatttaaacatttcttgtaaaaagctgagacagtttgtaagaaaagaatccttaaaatctagatttataccattttttaaagtcccacctttcaatgtttaataaaacaaaaagagaaatccttaatctaaaagctaaattatttttgaatggaaatactactgagaccattgacactggataacagtaatgatcccattaccagataagattgactgacggggaaaaaaaaaaaaaaagaatggggtgtgaatgtaccaacactgaatcttacagcagttatctttctatggccattaggtacctagcagatgtgcacaatataaacaaaaagatatctggcctaccttactactaaaagcatttaacacgtgcatttttggtacttttttttttgttttctaaaagctacataaaggccttatttgacattttcactgataactgatcgcaccctcatgttgcagtgttcgtcccctattcattaacagtgtgtgcaaatgcaaccccaggacacattattgttctgatagatgctcacagggaatcaagcttctcgcccactccacggctctgagccccatccaagggcaagacttggtgcccagctggaaggacgaaagcacactttgtgaccgccatcctcaccagctgcatgcctgggctgcacactgctgaacgtgctcctctctccttctctgtacaatgattcagcatctcggcggaagaggaaaatggagctttttgaggctcgccaggtcccttttgttttcaccattaaaattccaaacccaaagcctttgtttgactgaaggagaagagagggaagtaagcttctgttcagcacctgaaccctagaaaaagagccagtttgctacgatgaaggtgacatttctctggtcatttatttgagagttcgaagtcaaagtcgaggggcaccggctttggttcatgtctaggagccctctgtcagaatccttgaagccctttaatggtctaactggcatctcttgtatcaagaagtacctttaaggtagaccttttcagggtgccctcaggaaagggccctgctcatgtttttttcctgtccccttagaccaaccccaggtgtccactgcaggggttctgcctgttcccaaactttttccattccaggaacaaaggagaagccactttccccaggacgcaagactctcccctccactgtccgggacagcgttcgccctttagcggggaggtcattacagcctcatggcctctaccaaggccccagatcacaggatctcctgggccttggagcacctcacgctgggggaatcaatccctgagggactcagaatcttctccgtgcaacctggaaagttcatctcttgtttccttcagtcaaagaaagtccattgtacataacaaaacagcccccaaacagcccagtgccgacaccattgttcctttcacactttcctttgttgcatgcagttgggttcaaatgccaaatagtgattagaagacgaccattctgatctgtgtgtgatctggtcactatgtgactgcctttacggtttctctccatgtgctatatgaatgaagaatgcataccagtgttttaaaaggtatttttatgtgtttttaaacacttttttaaatgagcctgacacctgtgtttcagcatttggagacatccccatgttattcttttaagtgtataattactgatacttttttgtttgtttgtttaactaagttgtgtttaacttatgtgcagtctttataatgtatgtatgttattacagtttcaactatcatattttctttgattacatttataatttgatcttgctctgattataatgccagtgaatgttgctgaactctttgtatatgcaaattgcaagatttaaaccattctgatgcaaggataaacctttactttgactacca

SEQ ID NO: 171772 - DNA, 522 bp, Homo sapiens
  Payload ID: 13760
  Gene Symbol: PTPRE
  Gene Name: protein tyrosine phosphatase, receptor type, E
  ENST ID: ENST00000471218
  CDS Start-End: 60-509
ggattctccaaggccaggatggtttcccagcgtcttcccaggaagacaagaggtccaccatggagcccttgtgtccactcctgctggtgggttttagcttgccgctcgccagggctctcaggggcaacgagaccactgccgacagcaacgagacaaccacgacctcaggccctccggacccgggcgcctcccagccgctgctggcctggctgctactgccgctgctgctcctcctcctcgtgctccttctcgccgcctacttcttcaggttcaggaagcagaggaaagctgtggtcagcaccagcgacaagaagatgcccaacggaatcttggaggagcaagcaaagggtgatgctgctcagcaggtcaccctcagggcccaagaagtattttcccatccccgtggagcacctggaggaggagatccgtatcagatccgccgacgactgcaagcagtttcgggaggagttcaactcattgccatctggacacatacaaggaacttttgaactggcaaataaa

SEQ ID NO: 171773 - DNA, 338 bp, Homo sapiens
  Payload ID: 13760
  Gene Symbol: PTPRE
  Gene Name: protein tyrosine phosphatase, receptor type, E
  ENST ID: ENST00000467366
  CDS Start-End: 1-324
cgcctcccagccgctgctggcctggctgctactgccgctgctgctcctcctcctcgtgctccttctcgccgcctacttcttcaggaagcagaggaaagctgtggtcagcaccagcgacaagaagatgcccaacggaatcttggaggagcaagagcagcaaagggtgatgctgctcagcaggtcaccctcagggcccaagaagtattttcccatccccgtggagcacctggaggaggagatccgtatcagatccgccgacgactgcaagcagtttcgggaggagttcaactcattgccatctggacacatacaaggaacttttgaactggcaaataaag

SEQ ID NO: 171774 - DNA, 987 bp, Homo sapiens
  Payload ID: 13760
  Gene Symbol: PTPRE
  Gene Name: protein tyrosine phosphatase, receptor type, E
  ENST ID: ENST00000495530
  CDS Start-End: 21-377
ggccttagcgcggctcagccatgagcaacaggagtagcttttcccggctcacctggttcaggaagcagaggaaagctgtggtcagcaccagcgacaagaagatgcccaacggaatcttggaggagcaagagcagcaaagggtgatgctgctcagcaggtcaccctcagggcccaagaagtattttcccatccccgtggagcacctggaggaggagatccgtatcagatccgccgacgactgcaagcagtttcgggaggagttcaactcattgccatctggacacatacaaggaacttttgaactggcaaataaagaagaaaacagagaaaaaaacagatatcccaacatccttcccaggttacaaagagaagaataaattcatagcagctcaaggtcccaaacaggaaacggttaacgacttctggagaatggtctgggagcaaaagtctgcgaccatcgtcatgttaacaaacttgaaagaaaggaaagaggaaaagtgccatcagtactggcccgaccaaggctgctggacctatggaaacatccgggtgtgcgtggaggactgcgtggttttggtcgactacaccatccggaagttctgcatacagccacagctccccgacggctgcaaagcccccaggctggtctcacagctgcacttcaccagctggcccgacttcggagtgccttttacccccattgggatgctgaagttcctcaagaaagtaaagacgctcaaccccgtgcacgctgggcccatcgtggtccactgtagcgcgggcgtgggccggacgggcaccttcattgtgatcgatgccatgatggccatgatgcacgcggagcagaaggtggatgtgtttgaatttgtgtctcgaatccgtaatcagcgccctcagatggttcaaacggatatgcagtacacgttcatctaccaagccttactcgagtactacctctacggggacacagagctggacgtgtcctcc

SEQ ID NO: 171775 - DNA, 7727 bp, Homo sapiens
  Payload ID: 13761
  Gene Symbol: PTPRF
  Gene Name: protein tyrosine phosphatase, receptor type, F
  Uniprot ID: P10586
  ENST ID: ENST00000359947
  CDS Start-End: 341-6064
cgggagcggcgggagcggtggcggcggcagaggcggcggctccagcttcggctccggctcgggctcgggctccggctccggctccggctccggctccagctcgggtggcggtggcgggagcgggaccaggtggaggcggcggcggcagaggagtgggagcagcggccctagcggcttgcggggggacatgcggaccgacggcccctggataggcggaaggagtggaggccctggtgcccggcccttggtgctgagtatccagcaagagtgaccggggtgaagaagcaaagactcggttgattgtcctgggctgtggctggctgtggagctagagccctggatggcccctgagccagccccagggaggacgatggtgccccttgtgcctgcactggtgatgcttggtttggtggcaggcgcccatggtgacagcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgagtgcgccgcgtggctcctcgtttctccatccctcccagcagccaggaggtgatgccaggcggcagcgtgaacctgacatgcgtggcagtgggtgcacccatgccctacgtgaagtggatgatgggggccgaggagctcaccaaggaggatgagatgccagttggccgcaacgtcctggagctcagcaatgtcgtacgctctgccaactacacctgtgtggccatctcctcgctgggcatgatcgaggccacagcccaggtcacagtgaaagctcttccaaagcctccgattgatcttgtggtgacagagacaactgccaccagtgtcaccctcacctgggactctgggaactcggagcctgtaacctactatggcatccagtaccgcgcagcgggcacggagggcccctttcaggaggtggatggtgtggccaccacccgctacagcattggcggcctcagccctttctcggaatatgccttccgcgtgctggcggtgaacagcatcgggcgagggccgcccagcgaggcagtgcgggcacgcacgggagaacaggcgccctccagcccaccgcgccgcgtgcaggcacgcatgctgagcgccagcaccatgctggtgcagtgggagcctcccgaggagcccaacggcctggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaggtgaccttcgacccaacctcctcctacacactagaggacctgaagcctgacacactctaccgcttccagctggctgcacgctcggatatgggggtgggcgtcttcacccccaccattgaggcccgcacagcccagtccaccccctccgcccctccccagaaggtgatgtgtgtgagcatgggctccaccacggtccgggtaagttgggtcccgccgcctgccgacagccgcaacggcgttatcacccagtactccgtggcctacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacgtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccagtggcggccagaggagtccgaggactatgaaaccactatcagcggcctgaccccggagaccacctactccgttactgttgctgcctataccaccaagggggatggtgcccgcagcaagcccaaaattgtcactacaacaggtgcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaagtgtttgccaagaacttccgggtggcggctgcaatgaagacgtctgtgctgctcagctgggaggttcccgactcctataagtcagctgtgccctttaagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtggttctacattgttgtggtgcccattgaccgtgtgggcgggagcatgctgacgccaaggtggagcacacccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggtgatttctggaggatggtgtgggaacagcgcacggccactgtggtcatgatgacacggctggaggagaagtcccgggtaaaatgtgatcagtactggccagcccgtggcaccgagacctgtggccttattcaggtgaccctgttggacacagtggagctggccacatacactgtgcgcaccttcgcactccacaagagtggctccagtgagaagcgcgagctgcgtcagtttcagttcatggcctggccagaccatggagttcctgagtacccaactcccatcctggccttcctacgacgggtcaaggcctgcaaccccctagacgcagggcccatggtggtgcactgcagcgcgggcgtgggccgcaccggctgcttcatcgtgattgatgccatgttggagcggatgaagcacgagaagacggtggacatctatggccacgtgacctgcatgcgatcacagaggaactacatggtgcagacggaggaccagtacgtgttcatccatgaggcgctgctggaggctgccacgtgcggccacacagaggtgcctgcccgcaacctgtatgcccacatccagaagctgggccaagtgcctccaggggagagtgtgaccgccatggagctcgagttcaagttgctggccagctccaaggcccacacgtcccgcttcatcagcgccaacctgccctgcaacaagttcaagaaccggctggtgaacatcatgccctacgaattgacccgtgtgtgtctgcagcccatccgtggtgtggagggctctgactacatcaatgccagcttcctggatggttatagacagcagaaggcctacatagctacacaggggcctctggcagagagcaccgaggacttctggcgcatgctatgggagcacaattccaccatcatcgtcatgctgaccaagcttcgggagatgggcagggagaaatgccaccagtactggccagcagagcgctctgctcgctaccagtactttgttgttgacccgatggctgagtacaacatgccccagtatatcctgcgtgagttcaaggtcacggatgcccgggatgggcagtcaaggacaatccggcagttccagttcacagactggccagagcagggcgtgcccaagacaggcgagggattcattgacttcatcgggcaggtgcataagaccaaggagcagtttggacaggatgggcctatcacggtgcactgcagtgctggcgtgggccgcaccggggtgttcatcactctgagcatcgtcctggagcgcatgcgctacgagggcgtggtcgacatgtttcagaccgtgaagaccctgcgtacacagcgtcctgccatggtgcagacagaggaccagtatcagctgtgctaccgtgcggccctggagtacctcggcagctttgaccactatgcaacgtaactaccgctcccctctcctccgccacccccgccgtggggctccggaggggacccagctcctctgagccataccgaccatcgtccagccctcctacgcagatgctgtcactggcagagcacagcccacggggatcacagcgtttcaggaacgttgccacaccaatcagagagcctagaacatccctgggcaagtggatggcccagcaggcaggcactgtggcccttctgtccaccagacccacctggagcccgcttcaagctctctgttgcgctcccgcatttctcatgcttcttctcatggggtggggttggggcaaagcctcctttttaatacattaagtggggtagactgagggattttagcctcttccctctgatttttcctttcgcgaatccgtatctgcagaatgggccactgtaggggttggggtttattttgttttgtttttttttttcttgagttcactttggatccttattttgtatgacttctgctgaaggacagaacattgccttcctcgtgcagagctggggctgccagcctgagcggaggctcggccgtgggccgggaggcagtgctgatccggctgctcctccagcccttcagacgagatcctgtttcagctaaatgcagggaaactcaatgtttttttaagttttgttttccctttaaagcctttttttaggccacattgacagtggtgggcggggagaagatagggaacactcatccctggtcgtctatcccagtgtgtgtttaacattcacagcccagaaccacagatgtgtctgggagagcctggcaaggcattcctcatcaccatcgtgtttgcaaaggttaaaacaaaaacaaaaaaccacaaaaataaaaaacaaaaaaaacaaaaaacccaagaaaaaaaaaaagagtcagcccttggcttctgcttcaaaccctcaagaggggaagcaactccgtgtgcctggggttcccgagggagctgctggctgacctgggcccacagagcctggctttggtccccagcattgcagtatggtgtggtgtttgtaggctgtggggtctggctgtgtggccaaggtgaatagcacaggttagggtgtgtgccacaccccatgcacctcagggccaagcgggggcgtggctggcctttcaggtccaggccagtgggcctggtagcacatgtctgtcctcagagcaggggccagatgattttcctccctggtttgcagctgttttcaaagcccccgataatcgctcttttccactccaagatgccctcataaaccaatgtggcaagactactggacttctatcaatggtactctaatcagtccttattatcccagcttgctgaggggcagggagagcgcctcttcctctgggcagcgctatctagataggtaagtgggggcggggaagggtgcatagctgttttagctgagggacgtggtgccgacgtccccaaacctagctaggctaagtcaagatcaacattccagggttggtaatgttggatgatgaaacattcatttttaccttgtggatgctagtgctgtagagttcactgttgtacacagtctgttttctatttgttaagaaaaactacagcatcattgcataattcttgatggtaataaatttgaataatcagatttcttacaaa

SEQ ID NO: 171776 - DNA, 4600 bp, Homo sapiens
  Payload ID: 13761
  Gene Symbol: PTPRF
  Gene Name: protein tyrosine phosphatase, receptor type, F
  ENST ID: ENST00000372407
  CDS Start-End: 1-2940
acctacgtgcggctggagaatggcgagccccgtggactccccatcatccaagacgtcatgctagccgaggcccagtggcggccagaggagtccgaggactatgaaaccactatcagcggcctgaccccggagaccacctactccgttactgttgctgcctataccaccaagggggatggtgcccgcagcaagcccaaaattgtcactacaacaggtgcagtgtttgccaagaacttccgggtggcggctgcaatgaagacgtctgtgctgctcagctgggaggttcccgactcctataagtcagctgtgccctttaagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtggttctacattgttgtggtgcccattgaccgtgtgggcgggagcatgctgacgccaaggtggagcacacccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggttccagtgtccccagttgcccgaatacctcaagtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggtgatttctggaggatggtgtgggaacagcgcacggccactgtggtcatgatgacacggctggaggagaagtcccgggtaaaatgtgatcagtactggccagcccgtggcaccgagacctgtggccttattcaggtgaccctgttggacacagtggagctggccacatacactgtgcgcaccttcgcactccacaagagtggctccagtgagaagcgcgagctgcgtcagtttcagttcatggcctggccagaccatggagttcctgagtacccaactcccatcctggccttcctacgacgggtcaaggcctgcaaccccctagacgcagggcccatggtggtgcactgcagcgcgggcgtgggccgcaccggctgcttcatcgtgattgatgccatgttggagcggatgaagcacgagaagacggtggacatctatggccacgtgacctgcatgcgatcacagaggaactacatggtgcagacggaggaccagtacgtgttcatccatgaggcgctgctggaggctgccacgtgcggccacacagaggtgcctgcccgcaacctgtatgcccacatccagaagctgggccaagtgcctccaggggagagtgtgaccgccatggagctcgagttcaagttgctggccagctccaaggcccacacgtcccgcttcatcagcgccaacctgccctgcaacaagttcaagaaccggctggtgaacatcatgccctacgaattgacccgtgtgtgtctgcagcccatccgtggtgtggagggctctgactacatcaatgccagcttcctggatggttatagacagcagaaggcctacatagctacacaggggcctctggcagagagcaccgaggacttctggcgcatgctatgggagcacaattccaccatcatcgtcatgctgaccaagcttcgggagatgggcagggagaaatgccaccagtactggccagcagagcgctctgctcgctaccagtactttgttgttgacccgatggctgagtacaacatgccccagtatatcctgcgtgagttcaaggtcacggatgcccgggatgggcagtcaaggacaatccggcagttccagttcacagactggccagagcagggcgtgcccaagacaggcgagggattcattgacttcatcgggcaggtgcataagaccaaggagcagtttggacaggatgggcctatcacggtgcactgcagtgctggcgtgggccgcaccggggtgttcatcactctgagcatcgtcctggagcgcatgcgctacgagggcgtggtcgacatgtttcagaccgtgaagaccctgcgtacacagcgtcctgccatggtgcagacagaggaccagtatcagctgtgctaccgtgcggccctggagtacctcggcagctttgaccactatgcaacgtaactaccgctcccctctcctccgccacccccgccgtggggctccggaggggacccagctcctctgagccataccgaccatcgtccagccctcctacgcagatgctgtcactggcagagcacagcccacggggatcacagcgtttcaggaacgttgccacaccaatcagagagcctagaacatccctgggcaagtggatggcccagcaggcaggcactgtggcccttctgtccaccagacccacctggagcccgcttcaagctctctgttgcgctcccgcatttctcatgcttcttctcatggggtggggttggggcaaagcctcctttttaatacattaagtggggtagactgagggattttagcctcttccctctgatttttcctttcgcgaatccgtatctgcagaatgggccactgtaggggttggggtttattttgttttgtttttttttttcttgagttcactttggatccttattttgtatgacttctgctgaaggacagaacattgccttcctcgtgcagagctggggctgccagcctgagcggaggctcggccgtgggccgggaggcagtgctgatccggctgctcctccagcccttcagacgagatcctgtttcagctaaatgcagggaaactcaatgtttttttaagttttgttttccctttaaagcctttttttaggccacattgacagtggtgggcggggagaagatagggaacactcatccctggtcgtctatcccagtgtgtgtttaacattcacagcccagaaccacagatgtgtctgggagagcctggcaaggcattcctcatcaccatcgtgtttgcaaaggttaaaacaaaaacaaaaaaccacaaaaataaaaaacaaaaaaaacaaaaaacccaagaaaaaaaaaaagagtcagcccttggcttctgcttcaaaccctcaagaggggaagcaactccgtgtgcctggggttcccgagggagctgctggctgacctgggcccacagagcctggctttggtccccagcattgcagtatggtgtggtgtttgtaggctgtggggtctggctgtgtggccaaggtgaatagcacaggttagggtgtgtgccacaccccatgcacctcagggccaagcgggggcgtggctggcctttcaggtccaggccagtgggcctggtagcacatgtctgtcctcagagcaggggccagatgattttcctccctggtttgcagctgttttcaaagcccccgataatcgctcttttccactccaagatgccctcataaaccaatgtggcaagactactggacttctatcaatggtactctaatcagtccttattatcccagcttgctgaggggcagggagagcgcctcttcctctgggcagcgctatctagataggtaagtgggggcggggaagggtgcatagctgttttagctgagggacgtggtgccgacgtccccaaacctagctaggctaagtcaagatcaacattccagggttggtaatgttggatgatgaaacattcatttttaccttgtggatgctagtgctgtagagttcactgttgtacacagtctgttttctatttgttaagaaaaactacagcatcattgcataattcttgatggtaataaatttgaataatcagatttcttac

SEQ ID NO: 171777 - DNA, 4154 bp, Homo sapiens
  Payload ID: 13761
  Gene Symbol: PTPRF
  Gene Name: protein tyrosine phosphatase, receptor type, F
  ENST ID: ENST00000412568
  CDS Start-End: 1-3874
cagtgtcaccctcacctgggactctgggaactcggagcctgtaacctactatggcatccagtaccgcgcagcgggcacggagggcccctttcaggaggtggatggtgtggccaccacccgctacagcattggcggcctcagccctttctcggaatatgccttccgcgtgctggcggtgaacagcatcgggcgagggccgcccagcgaggcagtgcgggcacgcacgggagaacaggcgccctccagcccaccgcgccgcgtgcaggcacgcatgctgagcgccagcaccatgctggtgcagtgggagcctcccgaggagcccaacggcctggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaggtgaccttcgacccaacctcctcctacacactagaggacctgaagcctgacacactctaccgcttccagctggctgcacgctcggatatgggggtgggcgtcttcacccccaccattgaggcccgcacagcccagtccatgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccagtggcggccagaggagtccgaggactatgaaaccactatcagcggcctgaccccggagaccacctactccgttactgttgctgcctataccaccaagggggatggtgcccgcagcaagcccaaaattgtcactacaacaggtgcagtgtttgccaagaacttccgggtggcggctgcaatgaagacgtctgtgctgctcagctgggaggttcccgactcctataagtcagctgtgccctttaagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtggttctacattgttgtggtgcccattgaccgtgtgggcgggagcatgctgacgccaaggtggagcacacccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggttccagtgtccccagttgcccgaatacctcaagtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggtgatttctggaggatggtgtgggaacagcgcacggccactgtggtcatgatgacacggctggaggagaagtcccgggtaaaatgtgatcagtactggccagcccgtggcaccgagacctgtggccttattcaggtgaccctgttggacacagtggagctggccacatacactgtgcgcaccttcgcactccacaagagtggctccagtgagaagcgcgagctgcgtcagtttcagttcatggcctggccagaccatggagttcctgagtacccaactcccatcctggccttcctacgacgggtcaaggcctgcaaccccctagacgcagggcccatggtggtgcactgcagcgcgggcgtgggccgcaccggctgcttcatcgtgattgatgccatgttggagcggatgaagcacgagaagacggtggacatctatggccacgtgacctgcatgcgatcacagaggaactacatggtgcagacggaggaccagtacgtgttcatccatgaggcgctgctggaggctgccacgtgcggccacacagaggtgcctgcccgcaacctgtatgcccacatccagaagctgggccaagtgcctccaggggagagtgtgaccgccatggagctcgagttcaagttgctggccagctccaaggcccacacgtcccgcttcatcagcgccaacctgccctgcaacaagttcaagaaccggctggtgaacatcatgccctacgaattgacccgtgtgtgtctgcagcccatccgtggtgtggagggctctgactacatcaatgccagcttcctggatggttatagacagcagaaggcctacatagctacacaggggcctctggcagagagcaccgaggacttctggcgcatgctatgggagcacaattccaccatcatcgtcatgctgaccaagcttcgggagatgggcagggagaaatgccaccagtactggccagcagagcgctctgctcgctaccagtactttgttgttgacccgatggctgagtacaacatgccccagtatatcctgcgtgagttcaaggtcacggatgcccgggatgggcagtcaaggacaatccggcagttccagttcacagactggccagagcagggcgtgcccaagacaggcgagggattcattgacttcatcgggcaggtgcataagaccaaggagcagtttggacaggatgggcctatcacggtgcactgcagtgctggcgtgggccgcaccggggtgttcatcactctgagcatcgtcctggagcgcatgcgctacgagggcgtggtcgacatgtttcagaccgtgaagaccctgcgtacacagcgtcctgccatggtgcagacagaggaccagtatcagctgtgctaccgtgcggccctggagtacctcggcagctttgaccactatgcaacgtaactaccgctcccctctcctccgccacccccgccgtggggctccggaggggacccagctcctctgagccataccgaccatcgtccagccctcctacgcagatgctgtcactggcagagcacagcccacggggatcacagcgtttcaggaacgttgccacaccaatcagagagcctagaacatccctgggcaagtggatggcccagcaggcaggcactgtggcccttctgtccaccagacccacctggagcccgcttcaagctctctgttgcgctcccgcatt

SEQ ID NO: 171778 - DNA, 6377 bp, Homo sapiens
  Payload ID: 13761
  Gene Symbol: PTPRF
  Gene Name: protein tyrosine phosphatase, receptor type, F
  Uniprot ID: P10586
  ENST ID: ENST00000438120
  CDS Start-End: 327-6023
gcggtggcggcggcagaggcggcggctccagcttcggctccggctcgggctcgggctccggctccggctccggctccggctccagctcgggtggcggtggcgggagcgggaccaggtggaggcggcggcggcagaggagtgggagcagcggccctagcggcttgcggggggacatgcggaccgacggcccctggataggcggaaggagtggaggccctggtgcccggcccttggtgctgagtatccagcaagagtgaccggggtgaagaagcaaagactcggttgattgtcctgggctgtggctggctgtggagctagagccctggatggcccctgagccagccccagggaggacgatggtgccccttgtgcctgcactggtgatgcttggtttggtggcaggcgcccatggtgacagcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgagtgcgccgcgtggctcctcgtttctccatccctcccagcagccaggaggtgatgccaggcggcagcgtgaacctgacatgcgtggcagtgggtgcacccatgccctacgtgaagtggatgatgggggccgaggagctcaccaaggaggatgagatgccagttggccgcaacgtcctggagctcagcaatgtcgtacgctctgccaactacacctgtgtggccatctcctcgctgggcatgatcgaggccacagcccaggtcacagtgaaagctcttccaaagcctccgattgatcttgtggtgacagagacaactgccaccagtgtcaccctcacctgggactctgggaactcggagcctgtaacctactatggcatccagtaccgcgcagcgggcacggagggcccctttcaggaggtggatggtgtggccaccacccgctacagcattggcggcctcagccctttctcggaatatgccttccgcgtgctggcggtgaacagcatcgggcgagggccgcccagcgaggcagtgcgggcacgcacgggagaacaggcgccctccagcccaccgcgccgcgtgcaggcacgcatgctgagcgccagcaccatgctggtgcagtgggagcctcccgaggagcccaacggcctggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaggtgaccttcgacccaacctcctcctacacactagaggacctgaagcctgacacactctaccgcttccagctggctgcacgctcggatatgggggtgggcgtcttcacccccaccattgaggcccgcacagcccagtccaccccctccgcccctccccagaaggtgatgtgtgtgagcatgggctccaccacggtccgggtaagttgggtcccgccgcctgccgacagccgcaacggcgttatcacccagtactccgtggcctacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacgtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccaggaaaccactatcagcggcctgaccccggagaccacctactccgttactgttgctgcctataccaccaagggggatggtgcccgcagcaagcccaaaattgtcactacaacaggtgcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaagtgtttgccaagaacttccgggtggcggctgcaatgaagacgtctgtgctgctcagctgggaggttcccgactcctataagtcagctgtgccctttaagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtggttctacattgttgtggtgcccattgaccgtgtgggcgggagcatgctgacgccaaggtggagcacacccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggtgatttctggaggatggtgtgggaacagcgcacggccactgtggtcatgatgacacggctggaggagaagtcccgggtaaaatgtgatcagtactggccagcccgtggcaccgagacctgtggccttattcaggtgaccctgttggacacagtggagctggccacatacactgtgcgcaccttcgcactccacaagagtggctccagtgagaagcgcgagctgcgtcagtttcagttcatggcctggccagaccatggagttcctgagtacccaactcccatcctggccttcctacgacgggtcaaggcctgcaaccccctagacgcagggcccatggtggtgcactgcagcgcgggcgtgggccgcaccggctgcttcatcgtgattgatgccatgttggagcggatgaagcacgagaagacggtggacatctatggccacgtgacctgcatgcgatcacagaggaactacatggtgcagacggaggaccagtacgtgttcatccatgaggcgctgctggaggctgccacgtgcggccacacagaggtgcctgcccgcaacctgtatgcccacatccagaagctgggccaagtgcctccaggggagagtgtgaccgccatggagctcgagttcaagttgctggccagctccaaggcccacacgtcccgcttcatcagcgccaacctgccctgcaacaagttcaagaaccggctggtgaacatcatgccctacgaattgacccgtgtgtgtctgcagcccatccgtggtgtggagggctctgactacatcaatgccagcttcctggatggttatagacagcagaaggcctacatagctacacaggggcctctggcagagagcaccgaggacttctggcgcatgctatgggagcacaattccaccatcatcgtcatgctgaccaagcttcgggagatgggcagggagaaatgccaccagtactggccagcagagcgctctgctcgctaccagtactttgttgttgacccgatggctgagtacaacatgccccagtatatcctgcgtgagttcaaggtcacggatgcccgggatgggcagtcaaggacaatccggcagttccagttcacagactggccagagcagggcgtgcccaagacaggcgagggattcattgacttcatcgggcaggtgcataagaccaaggagcagtttggacaggatgggcctatcacggtgcactgcagtgctggcgtgggccgcaccggggtgttcatcactctgagcatcgtcctggagcgcatgcgctacgagggcgtggtcgacatgtttcagaccgtgaagaccctgcgtacacagcgtcctgccatggtgcagacagaggaccagtatcagctgtgctaccgtgcggccctggagtacctcggcagctttgaccactatgcaacgtaactaccgctcccctctcctccgccacccccgccgtggggctccggaggggacccagctcctctgagccataccgaccatcgtccagccctcctacgcagatgctgtcactggcagagcacagcccacggggatcacagcgtttcaggaacgttgccacaccaatcagagagcctagaacatccctgggcaagtggatggcccagcaggcaggcactgtggcccttctgtccaccagacccacctggagcccgcttcaagctctctgttgcgctcccgcatttctcatgcttcttctcatggggtggggttggggcaaagcctcctttttaatacattaagtggggtagactgagg

SEQ ID NO: 171779 - DNA, 6312 bp, Homo sapiens
  Payload ID: 13761
  Gene Symbol: PTPRF
  Gene Name: protein tyrosine phosphatase, receptor type, F
  ENST ID: ENST00000429895
  CDS Start-End: 1-4661
cggagcctgtaacctactatggcatccagtaccgcgcagcgggcacggagggcccctttcaggaggtggatggtgtggccaccacccgctacagcattggcggcctcagccctttctcggaatatgccttccgcgtgctggcggtgaacagcatcgggcgagggccgcccagcgaggcagtgcgggcacgcacgggagaacaggcgccctccagcccaccgcgccgcgtgcaggcacgcatgctgagcgccagcaccatgctggtgcagtgggagcctcccgaggagcccaacggcctggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaggtgaccttcgacccaacctcctcctacacactagaggacctgaagcctgacacactctaccgcttccagctggctgcacgctcggatatgggggtgggcgtcttcacccccaccattgaggcccgcacagcccagtccaccccctccgcccctccccagaaggtgatgtgtgtgagcatgggctccaccacggtccgggtaagttgggtcccgccgcctgccgacagccgcaacggcgttatcacccagtactccgtggcctacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacgtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccaggaaaccactatcagcggcctgaccccggagaccacctactccgttactgttgctgcctataccaccaagggggatggtgcccgcagcaagcccaaaattgtcactacaacagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaagtgtttgccaagaacttccgggtggcggctgcaatgaagacgtctgtgctgctcagctgggaggttcccgactcctataagtcagctgtgccctttaagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtggttctacattgttgtggtgcccattgaccgtgtgggcgggagcatgctgacgccaaggtggagcacacccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggtgatttctggaggatggtgtgggaacagcgcacggccactgtggtcatgatgacacggctggaggagaagtcccgggtaaaatgtgatcagtactggccagcccgtggcaccgagacctgtggccttattcaggtgaccctgttggacacagtggagctggccacatacactgtgcgcaccttcgcactccacaagagtggctccagtgagaagcgcgagctgcgtcagtttcagttcatggcctggccagaccatggagttcctgagtacccaactcccatcctggccttcctacgacgggtcaaggcctgcaaccccctagacgcagggcccatggtggtgcactgcagcgcgggcgtgggccgcaccggctgcttcatcgtgattgatgccatgttggagcggatgaagcacgagaagacggtggacatctatggccacgtgacctgcatgcgatcacagaggaactacatggtgcagacggaggaccagtacgtgttcatccatgaggcgctgctggaggctgccacgtgcggccacacagaggtgcctgcccgcaacctgtatgcccacatccagaagctgggccaagtgcctccaggggagagtgtgaccgccatggagctcgagttcaagttgctggccagctccaaggcccacacgtcccgcttcatcagcgccaacctgccctgcaacaagttcaagaaccggctggtgaacatcatgccctacgaattgacccgtgtgtgtctgcagcccatccgtggtgtggagggctctgactacatcaatgccagcttcctggatggttatagacagcagaaggcctacatagctacacaggggcctctggcagagagcaccgaggacttctggcgcatgctatgggagcacaattccaccatcatcgtcatgctgaccaagcttcgggagatgggcagggagaaatgccaccagtactggccagcagagcgctctgctcgctaccagtactttgttgttgacccgatggctgagtacaacatgccccagtatatcctgcgtgagttcaaggtcacggatgcccgggatgggcagtcaaggacaatccggcagttccagttcacagactggccagagcagggcgtgcccaagacaggcgagggattcattgacttcatcgggcaggtgcataagaccaaggagcagtttggacaggatgggcctatcacggtgcactgcagtgctggcgtgggccgcaccggggtgttcatcactctgagcatcgtcctggagcgcatgcgctacgagggcgtggtcgacatgtttcagaccgtgaagaccctgcgtacacagcgtcctgccatggtgcagacagaggaccagtatcagctgtgctaccgtgcggccctggagtacctcggcagctttgaccactatgcaacgtaactaccgctcccctctcctccgccacccccgccgtggggctccggaggggacccagctcctctgagccataccgaccatcgtccagccctcctacgcagatgctgtcactggcagagcacagcccacggggatcacagcgtttcaggaacgttgccacaccaatcagagagcctagaacatccctgggcaagtggatggcccagcaggcaggcactgtggcccttctgtccaccagacccacctggagcccgcttcaagctctctgttgcgctcccgcatttctcatgcttcttctcatggggtggggttggggcaaagcctcctttttaatacattaagtggggtagactgagggattttagcctcttccctctgatttttcctttcgcgaatccgtatctgcagaatgggccactgtaggggttggggtttattttgttttgtttttttttttcttgagttcactttggatccttattttgtatgacttctgctgaaggacagaacattgccttcctcgtgcagagctggggctgccagcctgagcggaggctcggccgtgggccgggaggcagtgctgatccggctgctcctccagcccttcagacgagatcctgtttcagctaaatgcagggaaactcaatgtttttttaagttttgttttccctttaaagcctttttttaggccacattgacagtggtgggcggggagaagatagggaacactcatccctggtcgtctatcccagtgtgtgtttaacattcacagcccagaaccacagatgtgtctgggagagcctggcaaggcattcctcatcaccatcgtgtttgcaaaggttaaaacaaaaacaaaaaaccacaaaaataaaaaacaaaaaaaacaaaaaacccaagaaaaaaaaaaagagtcagcccttggcttctgcttcaaaccctcaagaggggaagcaactccgtgtgcctggggttcccgagggagctgctggctgacctgggcccacagagcctggctttggtccccagcattgcagtatggtgtggtgtttgtaggctgtggggtctggctgtgtggccaaggtgaatagcacaggttagggtgtgtgccacaccccatgcacctcagggccaagcgggggcgtggctggcctttcaggtccaggccagtgggcctggtagcacatgtctgtcctcagagcaggggccagatgattttcctccctggtttgcagctgttttcaaagcccccgataatcgctcttttccactccaagatgccctcataaaccaatgtggcaagactactggacttctatcaatggtactctaatcagtccttattatcccagcttgctgaggggcagggagagcgcctcttcctctgggcagcgctatctagataggtaagtgggggcggggaagggtgcatagctgttttagctgagggacgtggtgccgacgtccccaaacctagctaggctaagtcaagatcaacattccagggttggtaatgttggatgatgaaacattcatttttaccttgtggatgctagtgctgtagagttcactgttgtacacagtctgttttctatttgttaagaaaaactacagcatcattgcataattcttgatggtaataaatttgaataatcag

SEQ ID NO: 171780 - DNA, 788 bp, Homo sapiens
  Payload ID: 13761
  Gene Symbol: PTPRF
  Gene Name: protein tyrosine phosphatase, receptor type, F
  ENST ID: ENST00000437607
  CDS Start-End: 1-788
atggcccctgagccagccccagggaggacgatggtgccccttgtgcctgcactggtgatgcttggtttggtggcaggcgcccatggtgacagcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgaggtcttgccgcatgggcccggagccccatgggaatttggagccatccaatccgacttcttggtgtatgtgcatgtgtgtgtgcacacacgggcacacttatctgtgtgta

SEQ ID NO: 171781 - DNA, 4836 bp, Homo sapiens
  Payload ID: 13761
  Gene Symbol: PTPRF
  Gene Name: protein tyrosine phosphatase, receptor type, F
  ENST ID: ENST00000414879
  CDS Start-End: 1-3997
cagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaggtgaccttcgacccaacctcctcctacacactagaggacctgaagcctgacacactctaccgcttccagctggctgcacgctcggatatgggggtgggcgtcttcacccccaccattgaggcccgcacagcccagtccatgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccaggaaaccactatcagcggcctgaccccggagaccacctactccgttactgttgctgcctataccaccaagggggatggtgcccgcagcaagcccaaaattgtcactacaacaggtgcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaagtgtttgccaagaacttccgggtggcggctgcaatgaagacgtctgtgctgctcagctgggaggttcccgactcctataagtcagctgtgccctttaagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtggttctacattgttgtggtgcccattgaccgtgtgggcgggagcatgctgacgccaaggtggagcacacccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggttccagtgtccccagttgcccgaatacctcaagtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggtgatttctggaggatggtgtgggaacagcgcacggccactgtggtcatgatgacacggctggaggagaagtcccgggtaaaatgtgatcagtactggccagcccgtggcaccgagacctgtggccttattcaggtgaccctgttggacacagtggagctggccacatacactgtgcgcaccttcgcactccacaagagtggctccagtgagaagcgcgagctgcgtcagtttcagttcatggcctggccagaccatggagttcctgagtacccaactcccatcctggccttcctacgacgggtcaaggcctgcaaccccctagacgcagggcccatggtggtgcactgcagcgcgggcgtgggccgcaccggctgcttcatcgtgattgatgccatgttggagcggatgaagcacgagaagacggtggacatctatggccacgtgacctgcatgcgatcacagaggaactacatggtgcagacggaggaccagtacgtgttcatccatgaggcgctgctggaggctgccacgtgcggccacacagaggtgcctgcccgcaacctgtatgcccacatccagaagctgggccaagtgcctccaggggagagtgtgaccgccatggagctcgagttcaagttgctggccagctccaaggcccacacgtcccgcttcatcagcgccaacctgccctgcaacaagttcaagaaccggctggtgaacatcatgccctacgaattgacccgtgtgtgtctgcagcccatccgtggtgtggagggctctgactacatcaatgccagcttcctggatggttatagacagcagaaggcctacatagctacacaggggcctctggcagagagcaccgaggacttctggcgcatgctatgggagcacaattccaccatcatcgtcatgctgaccaagcttcgggagatgggcagggagaaatgccaccagtactggccagcagagcgctctgctcgctaccagtactttgttgttgacccgatggctgagtacaacatgccccagtatatcctgcgtgagttcaaggtcacggatgcccgggatgggcagtcaaggacaatccggcagttccagttcacagactggccagagcagggcgtgcccaagacaggcgagggattcattgacttcatcgggcaggtgcataagaccaaggagcagtttggacaggatgggcctatcacggtgcactgcagtgctggcgtgggccgcaccggggtgttcatcactctgagcatcgtcctggagcgcatgcgctacgagggcgtggtcgacatgtttcagaccgtgaagaccctgcgtacacagcgtcctgccatggtgcagacagaggaccagtatcagctgtgctaccgtgcggccctggagtacctcggcagctttgaccactatgcaacgtaactaccgctcccctctcctccgccacccccgccgtggggctccggaggggacccagctcctctgagccataccgaccatcgtccagccctcctacgcagatgctgtcactggcagagcacagcccacggggatcacagcgtttcaggaacgttgccacaccaatcagagagcctagaacatccctgggcaagtggatggcccagcaggcaggcactgtggcccttctgtccaccagacccacctggagcccgcttcaagctctctgttgcgctcccgcatttctcatgcttcttctcatggggtggggttggggcaaagcctcctttttaatacattaagtggggtagactgagggattttagcctcttccctctgatttttcctttcgcgaatccgtatctgcagaatgggccactgtaggggttggggtttattttgttttgtttttttttttcttgagttcactttggatccttattttgtatgacttctgctgaaggacagaacattgccttcctcgtgcagagctggggctgccagcctgagcggaggctcggccgtgggccgggaggcagtgctgatccggctgctcctccagcccttcagacgagatcctgtttcagctaaatgcagggaaactcaatgtttttttaagttttgttttccctttaaagcctttttttaggccacattgacagtggtgggcggggagaagatagggaacactcatccctggtcgtctatcccagtgtgtgtttaacattcacagcccagaaccacagatgtgtctgggagagcctggcaaggcattcctcatcaccatcgtgtttgcaaaggtt

SEQ ID NO: 171782 - DNA, 1129 bp, Homo sapiens
  Payload ID: 13761
  Gene Symbol: PTPRF
  Gene Name: protein tyrosine phosphatase, receptor type, F
  ENST ID: ENST00000617451
  CDS Start-End: 341-1129
cgggagcggcgggagcggtggcggcggcagaggcggcggctccagcttcggctccggctcgggctcgggctccggctccggctccggctccggctccagctcgggtggcggtggcgggagcgggaccaggtggaggcggcggcggcagaggagtgggagcagcggccctagcggcttgcggggggacatgcggaccgacggcccctggataggcggaaggagtggaggccctggtgcccggcccttggtgctgagtatccagcaagagtgaccggggtgaagaagcaaagactcggttgattgtcctgggctgtggctggctgtggagctagagccctggatggcccctgagccagccccagggaggacgatggtgccccttgtgcctgcactggtgatgcttggtttggtggcaggcgcccatggtgacagcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgaggtcttgccgcatgggcccggagccccatgggaatttggagccatccaatccgacttcttggtgtatgtgcatgtgtgtgtgcacacacgggcacacttatctgtgtgtaa

SEQ ID NO: 171783 - DNA, 5234 bp, Homo sapiens
  Payload ID: 13762
  Gene Symbol: PPFIA1
  Gene Name: protein tyrosine phosphatase, receptor type, f polypeptide (PTPRF), interacting protein (liprin), alpha 1
  Uniprot ID: Q13136
  ENST ID: ENST00000253925
  CDS Start-End: 216-3824
gccgcgcagccgggcccgctcctcctccgctccgccagtgtccggccgcgggccggccttagtgactggggcggcgggccccggggccgcggcgtggggcgggcaggcggacgccggccgcgggctgctttcgtcggctcccaagctctcccggagcgagcagccgcccgcgagccgccgcggagcctcctcgcccgctcccgccggcgagcaagatgatgtgcgaggtgatgccgaccatcagcgaagcagaaggcccccctggaggaggtggaggccatggttccggctccccttcacagccagatgcagattcacattttgaacagttgatggtctccatgctagaagaaagggaccgccttcttgatacactgagagagactcaagaaacgctggccttaacccaggggaagttacacgaggttggtcatgaaagagattccttgcagagacagctcaacacggcacttccacaggagttcgcagcacttactaaagaactcaatgtatgcagggaacagctccttgaaagggaagaagaaattgctgaactgaaagcagaaaggaataacaccaggctgctgttagagcatttggaatgccttgtctccaggcatgagcggtctcttaggatgaccgtggtgaagagacaagcgcagtctccagcaggcgtgtccagcgaagtggaagtgctgaaagcactgaagtccttatttgaacaccacaaagctctggatgaaaaggtgagagagcgattacgagtagcacttgaaagatgtagtttgttagaagaggaattaggtgccacacacaaagagctaatgattcttaaagaacagaataatcagaaaaaaactctaacagatggagtgctggacataaaccatgaacaagaaaatacaccaagcacgagtggaaagagatcttctgatggttctttaagccacgaggaagaccttgctaaagtaattgagctccaagaaatcataagtaagcagtcaagggaacagagccaaatgaaagaacgcctggcttccctttccagtcatgtgacagaactggaagaggatctggacacggctagaaaagatctcatcaaatctgaagaaatgaacacaaaattgcaacgagatgtccgtgaagccatggcccaaaaggaagatatggaagagagaatcactactcttgaaaaacgctacctcgctgcacagcgtgaagccacatctgtgcatgacctcaatgataaacttgaaaatgaaattgcaaataaagattctatgcatcgacagactgaagataaaaaccgccagttacaggagcgcttggaattggcagagcaaaagctgcaacagacactgaggaaggcagagacgctcccggaggtggaggcggagctggcccagagggtggcagcgctttccaaggctgaagagagacacggcaacattgaagaaaggttacgacagatggaagcacagttggaggagaagaatcaagaactgcagcgggcaaggcaaagagaaaaaatgaacgaagaacataataaacgtttatcagacactgttgacaagctgctttcagaatctaatgagaggcttcaacttcatcttaaagagagaatggctgctttggaagataagaactctcttttaagagaagttgaaagtgcaaaaaagcagttagaagaaacacaacacgataaggatcagcttgtcctaaacattgaagcactgagggctgaactagaccacatgagactaagaggtgcttcacttcatcatggccgaccccacttgggcagtgtcccagatttcaggttccccatggcagacggccacacagactcctacagcaccagtgcagtgctgcggcgcccacagaaaggccggctggcagccctgcgagatgagccttccaaggtacaaactcttaatgagcaggattgggaacgtgcccagcaagctagtgtcttggcaaatgtagcacaagcattcgagagtgatgctgacgtgtctgatggtgaagatgacagggacactctcctcagctcagttgacctgctatcgcccagcgggcaggccgacgcgcacacactagccatgatgcttcaggagcagctggacgccatcaacaaagagatcaggttgattcaggaagaaaaagaaaatacagagcagcgggcagaggagattgaaagtcgagttggcagtggaagtctagacaatcttggtcgttttagatcaatgagctccattcccccctaccctgcttcctcgcttgctagctcctcccctccgggcagtgggcgctccaccccacgaaggatccctcacagcccagctcgggaagtggacagactgggcgtcatgacccttttgccaccttccagagaagaggtacgagatgacaagacaaccataaagtgtgaaacctccccgccttcctccccgagagcccttcggttagaccggctgcacaaaggggcgctgcacaccgtcagccacgaggacatcagggacataaggaactccacaggctcccaggatggtcccgtgagcaaccccagcagtagcaacagtagccaggactcgctccacaaagccccaaagaagaaaggcattaagtcctccattggccgcttgtttggcaagaaagaaaagggccgacctggacaaactggcaaagaagcattaggacaagctggtgtttccgagacggataactcatctcaggatgccttgggacttagcaaattggggggacaggctgaaaaaaatcgtaaacttcaaaaaaagcatgaattgctggaggaagcccggagacaaggtttaccttttgcccaatgggacgggccaacggttgtggtctggctagagctctgggttgggatgccagcctggtatgtggctgcctgccgagcaaacgtgaaaagcggggccatcatgtcggccctgtccgacacagagatccagcgtgagattggcatcagcaaccccctgcacaggctgaagctgaggctggccatccaggagatcatgtcgctgaccagcccgtctgccccgcccacatctagaacgacactcgcctatggggacatgaaccacgagtggatcggcaacgagtggctccccagcctgggcctcccccagtaccgcagctacttcatggagtgccttgtagacgccaggatgctggaccacttgaccaagaaagaccttcgagggcagctgaaaatggtcgacagttttcacagaaacagtttccagtgtggaattatgtgcctgagaaggttaaattatgaccggaaagaactggaaagaaaaagagaagaaagtcagagtgaaataaaagacgtgcttgtttggagcaatgatcgagtgattcgctggatcctgtcaattggccttaaagaatatgcaaacaatcttatagagagtggtgttcacggagcacttctggccttagatgaaaccttcgacttcagtgcactggcactgctgttacagatcccgacgcagaacacacaggctcgtgctgtcttggaaagagaatttaacaaccttttggtcatggggactgatagaaggtttgatgaagatgatgataaaagctttaggagagcaccttcatggagaaaaaagtttagaccaaaggacattcgtggcttagctgctgggtcagcagagactctccctgcaaacttccgggtgacttcttctatgtcttccccctctatgcagccaaagaagatgcagatggacggcaatgtatcaggaacacagaggttggattctgctacagtcaggacttactcctgctaaagtctcctgttgtttacccacactacttctacagatgattatgcagcatttgaatccaacaaagactacattttggaatccagtggaatctttaatcttgttaatacttgttatatggaccctaagatattttattacagagtttttaattagtgaaaaattcatgaataccatagagaaaatattttagaatttaatgtttcttatatttatgtaaacttatgactcttcatttatatagttacttactttttcatgtatatccaggctataaatatcctttcaaatcatgttcttatacctaattttagtctttcaaatgaatgtactgtaatgcttgtatgtataaatcctatgaatagagggcttttgtaaattatgcatttattgtaattatcattaattttttaatgataaaccatgacaaaggattttacgtttataaaattatgacagaagccatgtgcattatcctttacggacgcagcctagctctacagcaatcatcctgaaataagcatacctaatttcaagcaattgttgtattttcatgactgaccttaactgtactttttctagcaagagatgctttattctgcagcatgaacagatttaaaatggctggtgttaaatatcagctcctaataagatgtggactgaaaacactatcacaacactatgagaagcccctagcactggttaacgctttcctagcctagtctctggatttggggagcttgtcttcagtggctgagactgtgagctgggagcagttctctcagctggagagactcgggatggggtaacctggggaccagtctagcccctgcaccctcttccctgcctctgctccttgggagcgggtggagagacacccatgtggctccccttagggccagcaccaagcaccacgctctcatcctgcaagtcggcgcacacagtggatgaaggcaggagacccagaaagcagtgcagtgcagctctaataaaggccttatttttcttatgtaaatcatctttttacatttgtttgtaaacatgtttaaagaacgaacctagtgggacatttttagactttgatgctctagccattttggattgtgtaagttgcagatgtggcttttactttttaaatggcatattaacaagccagcaaagtgtgtcagaccatggcgtggtatttattgtgcagcagatccagagacagaggcagcctgtcttttcagttggtttctgcttttaatttacttgtacaattcattgttactgttctgtttttctattaatcttttgtcaacttcctgattatgtaacaaagtatgtacagtctacttttgaactatttttatcacagtattatttattgctttctttcaataaagtactgaagcattttccactgccaatgaa

SEQ ID NO: 171784 - DNA, 4133 bp, Homo sapiens
  Payload ID: 13762
  Gene Symbol: PPFIA1
  Gene Name: protein tyrosine phosphatase, receptor type, f polypeptide (PTPRF), interacting protein (liprin), alpha 1
  Uniprot ID: Q13136
  ENST ID: ENST00000389547
  CDS Start-End: 199-3756
gctcctcctccgctccgccagtgtccggccgcgggccggccttagtgactggggcggcgggccccggggccgcggcgtggggcgggcaggcggacgccggccgcgggctgctttcgtcggctcccaagctctcccggagcgagcagccgcccgcgagccgccgcggagcctcctcgcccgctcccgccggcgagcaagatgatgtgcgaggtgatgccgaccatcagcgaagcagaaggcccccctggaggaggtggaggccatggttccggctccccttcacagccagatgcagattcacattttgaacagttgatggtctccatgctagaagaaagggaccgccttcttgatacactgagagagactcaagaaacgctggccttaacccaggggaagttacacgaggttggtcatgaaagagattccttgcagagacagctcaacacggcacttccacaggagttcgcagcacttactaaagaactcaatgtatgcagggaacagctccttgaaagggaagaagaaattgctgaactgaaagcagaaaggaataacaccaggctgctgttagagcatttggaatgccttgtctccaggcatgagcggtctcttaggatgaccgtggtgaagagacaagcgcagtctccagcaggcgtgtccagcgaagtggaagtgctgaaagcactgaagtccttatttgaacaccacaaagctctggatgaaaaggtgagagagcgattacgagtagcacttgaaagatgtagtttgttagaagaggaattaggtgccacacacaaagagctaatgattcttaaagaacagaataatcagaaaaaaactctaacagatggagtgctggacataaaccatgaacaagaaaatacaccaagcacgagtggaaagagatcttctgatggttctttaagccacgaggaagaccttgctaaagtaattgagctccaagaaatcataagtaagcagtcaagggaacagagccaaatgaaagaacgcctggcttccctttccagtcatgtgacagaactggaagaggatctggacacggctagaaaagatctcatcaaatctgaagaaatgaacacaaaattgcaacgagatgtccgtgaagccatggcccaaaaggaagatatggaagagagaatcactactcttgaaaaacgctacctcgctgcacagcgtgaagccacatctgtgcatgacctcaatgataaacttgaaaatgaaattgcaaataaagattctatgcatcgacagactgaagataaaaaccgccagttacaggagcgcttggaattggcagagcaaaagctgcaacagacactgaggaaggcagagacgctcccggaggtggaggcggagctggcccagagggtggcagcgctttccaaggctgaagagagacacggcaacattgaagaaaggttacgacagatggaagcacagttggaggagaagaatcaagaactgcagcgggcaaggcaaagagaaaaaatgaacgaagaacataataaacgtttatcagacactgttgacaagctgctttcagaatctaatgagaggcttcaacttcatcttaaagagagaatggctgctttggaagataagaactctcttttaagagaagttgaaagtgcaaaaaagcagttagaagaaacacaacacgataaggatcagcttgtcctaaacattgaagcactgagggctgaactagaccacatgagactaagaggtgcttcacttcatcatggccgaccccacttgggcagtgtcccagatttcaggttccccatggcagacggccacacagactcctacagcaccagtgcagtgctgcggcgcccacagaaaggccggctggcagccctgcgagatgagccttccaaggtacaaactcttaatgagcaggattgggaacgtgcccagcaagctagtgtcttggcaaatgtagcacaagcattcgagagtgatgctgacgtgtctgatggtgaagatgacagggacactctcctcagctcagttgacctgctatcgcccagcgggcaggccgacgcgcacacactagccatgatgcttcaggagcagctggacgccatcaacaaagagatcaggttgattcaggaagaaaaagaaaatacagagcagcgggcagaggagattgaaagtcgagttggcagtggaagtctagacaatcttggtcgttttagatcaatgagctccattcccccctaccctgcttcctcgcttgctagctcctcccctccgggcagtgggcgctccaccccacgaaggatccctcacagcccagctcgggaagtggacagactgggcgtcatgacccttttgccaccttccagagaagaggtacgagatgacaagacaaccataaagtgtgaaacctccccgccttcctccccgagagcccttcggttagaccggctgcacaaaggggcgctgcacaccgtcagccacgaggacatcagggacataaggaactccacaggctcccaggatggtcccgtgagcaaccccagcagtagcaacagtagccaggactcgctccacaaagccccaaagaagaaaggcattaagtcctccattggccgcttgtttggcaagaaagaaaagggccgacctggacaaactggcaaagaagcattaggacaagctggtgtttccgagacggataactcatctcaggatgccttgggacttagcaaattggggggacaggctgaaaaaaatcgtaaacttcaaaaaaagcatgaattgctggaggaagcccggagacaaggtttaccttttgcccaatgggacgggccaacggttgtggtctggctagagctctgggttgggatgccagcctggtatgtggctgcctgccgagcaaacgtgaaaagcggggccatcatgtcggccctgtccgacacagagatccagcgtgagattggcatcagcaaccccctgcacaggctgaagctgaggctggccatccaggagatcatgtcgctgaccagcccgtctgccccgcccacatctagaacgacactcgcctatggggacatgaaccacgagtggatcggcaacgagtggctccccagcctgggcctcccccagtaccgcagctacttcatggagtgccttgtagacgccaggatgctggaccacttgaccaagaaagaccttcgagggcagctgaaaatggtcgacagttttcacagaaacagtttccagtgtggaattatgtgcctgagaaggttaaattatgaccggaaagaactggaaagaaaaagagaagaaagtcagagtgaaataaaagacgtgcttgtttggagcaatgatcgagtgattcgctggatcctgtcaattggccttaaagaatatgcaaacaatcttatagagagtggtgttcacggagcacttctggccttagatgaaaccttcgacttcagtgcactggcactgctgttacagatcccgacgcagaacacacaggctcgtgctgtcttggaaagagaatttaacaaccttttggtcatggggactgatagaaggtttgatgaagatgatgataaaagctttaggagagcaccttcatggagaaaaaagtttagaccaaaggacattcgtggcttagctgctgggtcagcagagactctccctgcaaacttccgggtgacttcttctatgtcttccccctctatgcagccaaagaagatgcagatggacggtatgtgatgggtcacactaacctgtcacttgttgggagcatgagcagctttctgtctggaacattaataatgatctaaaacggcctatttaatatgttacaaggcacttgagtatggttgcatgtccaaatataaatgtttttaaattaactctaacatttgtttataaaagtttaaccataataatagaatttttaaaacacgcttgtctggttgaatcttagcatatttttccaactaataaagctcagtattcgtctgtgttctcagagagagactgaggcatacttgtaaatttgtgtctgtgacaggccgtgctagaaagctctttcaggaaatagtagtgtagtagtagcttccaaaccacataatttactgctctcc

SEQ ID NO: 171785 - DNA, 563 bp, Homo sapiens
  Payload ID: 13762
  Gene Symbol: PPFIA1
  Gene Name: protein tyrosine phosphatase, receptor type, f polypeptide (PTPRF), interacting protein (liprin), alpha 1
  ENST ID: ENST00000532024
  CDS Start-End: 267-563
ggcttgcccttttttgtgagggtagtcctttgggatcttgaccccttccctggatttttgtctgtgttaatgtcttcatgttgtgtatttttgcacttaatatttgccctgtgtatgttttcccagcttatttacacacaaagcataacagatctgagcataatgagactgcccatctttttagctacagatacctgtaaagttgcatatttgtgggaacctgtattctgagcttaattactgtagcctgggtctttcatttcaagatgatgtgcgaggtgatgccgaccatcagcgaagcagaaggcccccctggaggaggtggaggccatggttccggctccccttcacagccagatgcagattcacattttgaacagttgatggtctccatgctagaagaaagggaccgccttcttgatacactgagagagactcaagaaacgctggccttaacccaggggaagttacacgaggttggtcatgaaagagattccttgcagagacagctcaacacggcacttccacaggagttcgcagcacttactaaagaactcaatgta

SEQ ID NO: 171786 - DNA, 575 bp, Homo sapiens
  Payload ID: 13762
  Gene Symbol: PPFIA1
  Gene Name: protein tyrosine phosphatase, receptor type, f polypeptide (PTPRF), interacting protein (liprin), alpha 1
  ENST ID: ENST00000530746
  CDS Start-End: 101-575
tcaacggtcctcaccccccggggttcggggcttccgccgcacctgatacaggaggggaggagtgcggctcgagcaggctggaggtcaccatccccatcagatgatgtgcgaggtgatgccgaccatcagcgaagcagaaggcccccctggaggaggtggaggccatggttccggctccccttcacagccagatgcagattcacattttgaacagttgatggtctccatgctagaagaaagggaccgccttcttgatacactgagagagactcaagaaacgctggccttaacccaggggaagttacacgaggttggtcatgaaagagattccttgcagagacagctcaacacggcacttccacaggagttcgcagcacttactaaagaactcaatgtatgcagggaacagctccttgaaagggaagaagaaattgctgaactgaaagcagaaaggaataacaccaggctgctgttagagcatttggaatgccttgtctccaggcatgagcggtctcttaggatgaccgtggtgaagagacaagcgcagtctccagcaggcgtgtccagcgaagtgg

SEQ ID NO: 171787 - DNA, 553 bp, Homo sapiens
  Payload ID: 13762
  Gene Symbol: PPFIA1
  Gene Name: protein tyrosine phosphatase, receptor type, f polypeptide (PTPRF), interacting protein (liprin), alpha 1
  ENST ID: ENST00000533894
  CDS Start-End: 1-100
acagaacactggagctcttcaggagtgcacggctccactccagtgttcctttccctgtgtgaagttaacatggacagtgagtgctcagattgcaggttgattcaggaagaaaaagaaaatacagagcagcgggcagaggagattgaaagtcgagttggcagtggaagtctagacaatcttggtcgttttagatcaatgagctccattcccccctaccctgcttcctcgcttgctagctcctcccctccgggcagtgggcgctccaccccacgaaggatccctcacagcccagctcgggaagtggacagactgggcgtcatgacccttttgccaccttccagagaagaggtacgagatgacaagacaaccataaagtgtgaaacctccccgccttcctccccgagagcccttcggttagaccggctgcacaaaggggcgctgcacaccgtcagccacgaggacatcagggacataaggaactccacaggctcccaggatggtcccgtgagcaaccccagcagtagcaacagtagccaggactcgctccacaaag

SEQ ID NO: 171788 - DNA, 710 bp, Homo sapiens
  Payload ID: 13762
  Gene Symbol: PPFIA1
  Gene Name: protein tyrosine phosphatase, receptor type, f polypeptide (PTPRF), interacting protein (liprin), alpha 1
  ENST ID: ENST00000530798
  CDS Start-End: 1-710
cactgttgacaagctgctttcagaatctaatgagaggcttcaacttcatcttaaagagagaatggctgctttggaagataagaactctcttttaagagaagttgaaagtgcaaaaaagcagttagaagaaacacaacacgataaggatcagcttgtcctaaacattgaagcactgagggctgaactagaccacatgagactaagaggtgcttcacttcatcatggccgaccccacttgggcagtgtcccagatttcaggttccccatggcagacggccacacagactcctacagcaccagtgcagtgctgcggcgcccacagaaaggccggctggcagccctgcgagatgagccttccaaggtacgagatgacaagacaaccataaagtgtgaaacctccccgccttcctccccgagagcccttcggttagaccggctgcacaaaggggcgctgcacaccgtcagccacgaggacatcagggacataaggaactccacaggctcccaggatggtcccgtgagcaaccccagcagtagcaacagtagccaggactcgctccacaaagccccaaagaagaaaggcattaagtcctccattggccgcttgtttggcaagaaagaaaagggccgacctggacaaactggcaaagaagcattaggacaagctggtgtttccgagacggataactcatctcaggatgccttgggac

SEQ ID NO: 171789 - DNA, 5159 bp, Homo sapiens
  Payload ID: 13762
  Gene Symbol: PPFIA1
  Gene Name: protein tyrosine phosphatase, receptor type, f polypeptide (PTPRF), interacting protein (liprin), alpha 1
  ENST ID: ENST00000532504
  CDS Start-End: 143-1894
gcgggccccggggccgcggcgtggggcgggcaggcggacgccggccgcgggctgctttcgtcggctcccaagctctcccggagcgagcagccgcccgcgagccgccgcggagcctcctcgcccgctcccgccggcgagcaagatgatgtgcgaggtgatgccgaccatcagcgaagcagaaggcccccctggaggaggtggaggccatggttccggctccccttcacagccagatgcagattcacattttgaacagttgatggtctccatgctagaagaaagggaccgccttcttgatacactgagagagactcaagaaacgctggccttaacccaggggaagttacacgaggttggtcatgaaagagattccttgcagagacagctcaacacggcacttccacaggagttcgcagcacttactaaagaactcaatgtatgcagggaacagctccttgaaagggaagaagaaattgctgaactgaaagcagaaaggaataacaccaggctgctgttagagcatttggaatgccttgtctccaggcatgagcggtctcttaggatgaccgtggtgaagagacaagcgcagtctccagcaggcgtgtccagcgaagtggaagtgctgaaagcactgaagtccttatttgaacaccacaaagctctggatgaaaaggtgagagagcgattacgagtagcacttgaaagatgtagtttgttagaagaggaattaggtgccacacacaaagagctaatgattcttaaagaacagaataatcagaaaaaaactctaacagatggagtgctggacataaaccatgaacaagaaaatacaccaagcacgagtggaaagagatcttctgatggttctttaagccacgaggaagaccttgctaaagtaattgagctccaagaaatcataagtaagcagtcaagggaacagagccaaatgaaagaacgcctggcttccctttccagtcatgtgacagaactggaagaggatctggacacggctagaaaagatctcatcaaatctgaagaaatgaacacaaaattgcaacgagatgtccgtgaagccatggcccaaaaggaagatatggaagagagaatcactactcttgaaaaacgctacctcgctgcacagcgtgaagccacatctgtgcatgacctcaatgataaacttgaaaatgaaattgcaaataaagattctatgcatcgacagactgaagataaaaaccgccagttacaggagcgcttggaattggcagagcaaaagctgcaacagacactgaggaaggcagagacgctcccggaggtggaggcggagctggcccagagggtggcagcgctttccaaggctgaagagagacacggcaacattgaagaaaggttacgacagatggaagcacagttggaggagaagaatcaagaactgcagcgggcaaggcaaagagaaaaaatgaacgaagaacataataaacgtttatcagacactgttgacaagctgctttcagaatctaatgagaggcttcaacttcatcttaaagagagaatggctgctttggaagataagaactctcttttaagagaagttgaaagtgcaaaaaagcagttagaagaaacacaacacgataaggatcagcttgtcctaaacattgaagcactgagggctgaactagaccacatgagactaagagccgaccccacttgggcagtgtcccagatttcaggttccccatggcagacggccacacagactcctacagcaccagtgcagtgctgcggcgcccacagaaaggccggctggcagccctgcgagatgagccttccaaggtacaaactcttaatgagcaggattgggaacgtgcccagcaagctagtgtcttggcaaatgtagcacaagcattcgagagtgatgctgacgtgtctgatggtgaagatgacagggacactctcctcagctcagttgacctgctatcgcccagcgggcaggccgacgcgcacacactagccatgatgcttcaggagcagctggacgccatcaacaaagagatcaggttgattcaggaagaaaaagaaaatacagagcagcgggcagaggagattgaaagtcgagttggcagtggaagtctagacaatcttggtcgttttagatcaatgagctccattcccccctaccctgcttcctcgcttgctagctcctcccctccgggcagtgggcgctccaccccacgaaggatccctcacagcccagctcgggaagtggacagactgggcgtcatgacccttcctagtgatttaaggaaacatcgtagaaagttgccaccttccagagaagaggtacgagatgacaagacaaccataaagtgtgaaacctccccgccttcctccccgagagcccttcggttagaccggctgcacaaaggggcgctgcacaccgtcagccacgaggacatcagggacataaggaactccacaggctcccaggatggtcccgtgagcaaccccagcagtagcaacagtagccaggactcgctccacaaagccccaaagaagaaaggcattaagtcctccattggccgcttgtttggcaagaaagaaaagggccgacctggacaaactggcaaagaagcattaggacaagctggtgtttccgagacggataactcatctcaggatgccttgggacttagcaaattggggggacaggctgaaaaaaatcgtaaacttcaaaaaaagcatgaattgctggaggaagcccggagacaaggtttaccttttgcccaatgggacgggccaacggttgtggtctggctagagctctgggttgggatgccagcctggtatgtggctgcctgccgagcaaacgtgaaaagcggggccatcatgtcggccctgtccgacacagagatccagcgtgagattggcatcagcaaccccctgcacaggctgaagctgaggctggccatccaggagatcatgtcgctgaccagcccgtctgccccgcccacatctagaacgacactcgcctatggggacatgaaccacgagtggatcggcaacgagtggctccccagcctgggcctcccccagtaccgcagctacttcatggagtgccttgtagacgccaggatgctggaccacttgaccaagaaagaccttcgagggcagctgaaaatggtcgacagttttcacagaaacagtttccagtgtggaattatgtgcctgagaaggttaaattatgaccggaaagaactggaaagaaaaagagaagaaagtcagagtgaaataaaagacgtgcttgtttggagcaatgatcgagtgattcgctggatcctgtcaattggccttaaagaatatgcaaacaatcttatagagagtggtgttcacggagcacttctggccttagatgaaaccttcgacttcagtgcactggcactgctgttacagatcccgacgcagaacacacaggctcgtgctgtcttggaaagagaatttaacaaccttttggtcatggggactgatagaaggtttgatgaagatgatgataaaagctttaggagagcaccttcatggagaaaaaagtttagaccaaaggacattcgtggcttagctgctgggtcagcagagactctccctgcaaacttccgggtgacttcttctatgtcttccccctctatgcagccaaagaagatgcagatggacggcaatgtatcaggaacacagaggttggattctgctacagtcaggacttactcctgctaaagtctcctgttgtttacccacactacttctacagatgattatgcagcatttgaatccaacaaagactacattttggaatccagtggaatctttaatcttgttaatacttgttatatggaccctaagatattttattacagagtttttaattagtgaaaaattcatgaataccatagagaaaatattttagaatttaatgtttcttatatttatgtaaacttatgactcttcatttatatagttacttactttttcatgtatatccaggctataaatatcctttcaaatcatgttcttatacctaattttagtctttcaaatgaatgtactgtaatgcttgtatgtataaatcctatgaatagagggcttttgtaaattatgcatttattgtaattatcattaattttttaatgataaaccatgacaaaggattttacgtttataaaattatgacagaagccatgtgcattatcctttacggacgcagcctagctctacagcaatcatcctgaaataagcatacctaatttcaagcaattgttgtattttcatgactgaccttaactgtactttttctagcaagagatgctttattctgcagcatgaacagatttaaaatggctggtgttaaatatcagctcctaataagatgtggactgaaaacactatcacaacactatgagaagcccctagcactggttaacgctttcctagcctagtctctggatttggggagcttgtcttcagtggctgagactgtgagctgggagcagttctctcagctggagagactcgggatggggtaacctggggaccagtctagcccctgcaccctcttccctgcctctgctccttgggagcgggtggagagacacccatgtggctccccttagggccagcaccaagcaccacgctctcatcctgcaagtcggcgcacacagtggatgaaggcaggagacccagaaagcagtgcagtgcagctctaataaaggccttatttttcttatgtaaatcatctttttacatttgtttgtaaacatgtttaaagaacgaacctagtgggacatttttagactttgatgctctagccattttggattgtgtaagttgcagatgtggcttttactttttaaatggcatattaacaagccagcaaagtgtgtcagaccatggcgtggtatttattgtgcagcagatccagagacagaggcagcctgtcttttcagttggtttctgcttttaatttacttgtacaattcattgttactgttctgtttttctattaatcttttgtcaacttcctgattatgtaacaaagtatgtacagtctacttttgaactatttttatcacagtattatttattgctttctttcaataaagtactgaagcattttc

SEQ ID NO: 171790 - DNA, 1168 bp, Homo sapiens
  Payload ID: 13762
  Gene Symbol: PPFIA1
  Gene Name: protein tyrosine phosphatase, receptor type, f polypeptide (PTPRF), interacting protein (liprin), alpha 1
  ENST ID: ENST00000528750
  CDS Start-End: 1-1168
atgctgacgtgtctgatggtgaagatgacagggacactctcctcagctcagttgacctgctatcgcccagcgggcaggccgacgcgcacacactagccatgatgcttcaggagcagctggacgccatcaacaaagagatcaggttgattcaggaagaaaaagaaaatacagagcagcgggcagaggagattgaaagtcgagttggcagtggaagtctagacaatcttggtcgttttagatcaatgagctccattcccccctaccctgcttcctcgcttgctagctcctcccctccgggcagtgggcgctccaccccacgaaggatccctcacagcccagctcgggaagtggacagactgggcgtcatgacccttccatctccagattcatttttaatccagacctcaggtccccatcagtcagtagtttactcatccacctcccctcccagttccaccccatgctatagcgattcttcacagcatgctcagttgccaccttccagagaagaggtacgagatgacaagacaaccataaagtgtgaaacctccccgccttcctccccgagagcccttcggttagaccggctgcacaaaggggcgctgcacaccgtcagccacgaggacatcagggacataaggaactccacaggctcccaggatggtcccgtgagcaaccccagcagtagcaacagtagccaggactcgctccacaaagccccaaagaagaaaggcattaagtcctccattggccgcttgtttggcaagaaagaaaagggccgacctggacaaactggcaaagaagcattaggacaagctggtgtttccgagacggataactcatctcaggatgccttgggacttagcaaattggggggacaggctgaaaaaaatcgtaaacttcaaaaaaagcatgaattgctggaggaagcccggagacaaggtttaccttttgcccaatgggacgggccaacggttgtggtctggctagagctctgggttgggatgccagcctggtatgtggctgcctgccgagcaaacgtgaaaagcggggccatcatgtcggccctgtccgacacagagatccagcgtgagattggcatcagcaaccccctgcacaggctgaagctgaggctggccatccaggagatcatgtcgctgaccagccc

SEQ ID NO: 171791 - DNA, 745 bp, Homo sapiens
  Payload ID: 13762
  Gene Symbol: PPFIA1
  Gene Name: protein tyrosine phosphatase, receptor type, f polypeptide (PTPRF), interacting protein (liprin), alpha 1
  ENST ID: ENST00000528853
  CDS Start-End: 1-296
agaccaaaggacattcgtggcttagctgctgggtcagcagagactctccctgcaaacttccgggtgacttcttctatgtcttccccctctatgcagccaaagaagatgcagatggacgtttacccacactacttctacagatgattatgcagcatttgaatccaacaaagactacattttggaatccagtggaatctttaatcttgttaatacttgttatatggaccctaagatattttattacagagtttttaattagtgaaaaattcatgaataccatagagaaaatattttagaatttaatgtttcttatatttatgtaaacttatgactcttcatttatatagttacttactttttcatgtatatccaggctataaatatcctttcaaatcatgttcttatacctaattttagtctttcaaatgaatgtactgtaatgcttgtatgtataaatcctatgaatagagggcttttgtaaattatgcatttattgtaattatcattaattttttaatgataaaccatgacaaaggattttacgtttataaaattatgacagaagccatgtgcattatcctttacggacgcagcctagctctacagcaatcatcctgaaataagcatacctaatttcaagcaattgttgtattttcatgactgaccttaactgtactttttctagcaagagatgctttattctgcagcatgaacagatttaaaatggctggtgttaaatatcagc

SEQ ID NO: 171792 - DNA, 4537 bp, Homo sapiens
  Payload ID: 13762
  Gene Symbol: PPFIA1
  Gene Name: protein tyrosine phosphatase, receptor type, f polypeptide (PTPRF), interacting protein (liprin), alpha 1
  ENST ID: ENST00000526262
  CDS Start-End: 1-1163
caccaagcacgagtggaaagagatcttctgatggttctttaagccacgaggaagaccttgctaaagtaattgagctccaagaaatcataagtaagcagtcaagggaacagagccaaatgaaagaacgcctggcttccctttccagtcatgtgacagaactggaagaggatctggacacggctagaaaagatctcatcaaatctgaagaaatgaacacaaaattgcaacgagatgtccgtgaagccatggcccaaaaggaagatatggaagagagaatcactactcttgaaaaacgctacctcgctgcacagcgtgaagccacatctgtgcatgacctcaatgataaacttgaaaatgaaattgcaaataaagattctatgcatcgacagactgaagataaaaaccgccagttacaggagcgcttggaattggcagagcaaaagctgcaacagacactgaggaaggcagagacgctcccggaggtggaggcggagctggcccagagggtggcagcgctttccaagtctgaccttttgtcttctgggagctctgctgctaaggaagctaaactgttggaacttacttccaagcttaggaaggctgaagagagacacggcaacattgaagaaaggttacgacagatggaagcacagttggaggagaagaatcaagaactgcagcgggcaaggcaaagagaaaaaatgaacgaagaacataataaacgtttatcagacactgttgacaagctgctttcagaatctaatgagaggcttcaacttcatcttaaagagagaatggctgctttggaagataagaactctcttttaagagaagttgaaagtgcaaaaaagcagttagaagaaacacaacacgataaggatcagcttgtcctaaacattgaagcactgagggctgaactagaccacatgagactaagaggtgcttcacttcatcatggccgaccccacttgggcagtgtcccagatttcaggttccccatggcagacggccacacagactcctacagcaccagtgcagtgctgcggcgcccacagaaaggccggctggcagccctgcgagatgagccttccaaggcaaggtacaaactcttaatgagcaggattgggaacgtgcccagcaagctagtgtcttggcaaatgtagcacaagcattcgagagtgatgctgacgtgtctgatggtgaagatgacagggacactctcctcagctcagttgacctgctatcgcccagcgggcaggccgacgcgcacacactagccatgatgcttcaggagcagctggacgccatcaacaaagagatcaggttgattcaggaagaaaaagaaaatacagagcagcgggcagaggagattgaaagtcgagttggcagtggaagtctagacaatcttggtcgttttagatcaatgagctccattcccccctaccctgcttcctcgcttgctagctcctcccctccgggcagtgggcgctccaccccacgaaggatccctcacagcccagctcgggaagtggacagactgggcgtcatgacccttcctagtgatttaaggaaacatcgtagaaagttgccaccttccagagaagaggtacgagatgacaagacaaccataaagtgtgaaacctccccgccttcctccccgagagcccttcggttagaccggctgcacaaaggggcgctgcacaccgtcagccacgaggacatcagggacataaggaactccacaggctcccaggatggtcccgtgagcaaccccagcagtagcaacagtagccaggactcgctccacaaagccccaaagaagaaaggcattaagtcctccattggccgcttgtttggcaagaaagaaaagggccgacctggacaaactggcaaagaagcattaggacaagctggtgtttccgagacggataactcatctcaggatgccttgggacttagcaaattggggggacaggctgaaaaaaatcgtaaacttcaaaaaaagcatgaattgctggaggaagcccggagacaaggtttaccttttgcccaatgggacgggccaacggttgtggtctggctagagctctgggttgggatgccagcctggtatgtggctgcctgccgagcaaacgtgaaaagcggggccatcatgtcggccctgtccgacacagagatccagcgtgagattggcatcagcaaccccctgcacaggctgaagctgaggctggccatccaggagatcatgtcgctgaccagcccgtctgccccgcccacatctagaacgaccacaggaaatgtctggttaacacacgaagagatggaaacgctcgcagccacgccgcaaacggaagatgaggagggaagctgggctcagcagacactcgcctatggggacatgaaccacgagtggatcggcaacgagtggctccccagcctgggcctcccccagtaccgcagctacttcatggagtgccttgtagacgccaggatgctggaccacttgaccaagaaagaccttcgagggcagctgaaaatggtcgacagttttcacagaaacagtttccagtgtggaattatgtgcctgagaaggttaaattatgaccggaaagaactggaaagaaaaagagaagaaagtcagagtgaaataaaagacgtgcttgtttggagcaatgatcgagtgattcgctggatcctgtcaattggccttaaagaatatgcaaacaatcttatagagagtggtgttcacggagcacttctggccttagatgaaaccttcgacttcagtgcactggcactgctgttacagatcccgacgcagaacacacaggctcgtgctgtcttggaaagagaatttaacaaccttttggtcatggggactgatagaaggtttgatgaagatgatgataaaagctttaggagagcaccttcatggagaaaaaagtttagaccaaaggacattcgtggcttagctgctgggtcagcagagactctccctgcaaacttccgggtgacttcttctatgtcttccccctctatgcagccaaagaagatgcagatggacggcaatgtatcaggaacacagaggttggattctgctacagtcaggacttactcctgctaaagtctcctgttgtttacccacactacttctacagatgattatgcagcatttgaatccaacaaagactacattttggaatccagtggaatctttaatcttgttaatacttgttatatggaccctaagatattttattacagagtttttaattagtgaaaaattcatgaataccatagagaaaatattttagaatttaatgtttcttatatttatgtaaacttatgactcttcatttatatagttacttactttttcatgtatatccaggctataaatatcctttcaaatcatgttcttatacctaattttagtctttcaaatgaatgtactgtaatgcttgtatgtataaatcctatgaatagagggcttttgtaaattatgcatttattgtaattatcattaattttttaatgataaaccatgacaaaggattttacgtttataaaattatgacagaagccatgtgcattatcctttacggacgcagcctagctctacagcaatcatcctgaaataagcatacctaatttcaagcaattgttgtattttcatgactgaccttaactgtactttttctagcaagagatgctttattctgcagcatgaacagatttaaaatggctggtgttaaatatcagctcctaataagatgtggactgaaaacactatcacaacactatgagaagcccctagcactggttaacgctttcctagcctagtctctggatttggggagcttgtcttcagtggctgagactgtgagctgggagcagttctctcagctggagagactcgggatggggtaacctggggaccagtctagcccctgcaccctcttccctgcctctgctccttgggagcgggtggagagacacccatgtggctccccttagggccagcaccaagcaccacgctctcatcctgcaagtcggcgcacacagtggatgaaggcaggagacccagaaagcagtgcagtgcagctctaataaaggccttatttttcttatgtaaatcatctttttacatttgtttgtaaacatgtttaaagaacgaacctagtgggacatttttagactttgatgctctagccattttggattgtgtaagttgcagatgtggcttttactttttaaatggcatattaacaagccagcaaagtgtgtcagaccatggcgtggtatttattgtgcagcagatccagagacagaggcagcctgtcttttcagttggtttctgcttttaatttacttgtacaattcattgttactgttctgtttttctattaatcttttgtcaacttcctgattatgtaacaaagtatgtacagtctacttttgaactatttttatcacagtattatttattgctttctttcaataaagtactgaagcattttccactgccaatgaagaa

SEQ ID NO: 171793 - DNA, 879 bp, Homo sapiens
  Payload ID: 13762
  Gene Symbol: PPFIA1
  Gene Name: protein tyrosine phosphatase, receptor type, f polypeptide (PTPRF), interacting protein (liprin), alpha 1
  ENST ID: ENST00000530390
  CDS Start-End: 1-141
tcacagcccagctcgggaagtggacagactgggcgtcatgacccttccatctccagattcatttttaatccagacctcaggtccccatcagtcagtagtttactcatccacctcccctcccagttccaccccatgctatagcgattcttcacagcatgctcagcctagtgatttaaggaaacatcgtagaaagttgccaccttccagagaagaggtacgagatgacaagacaaccataaagtgtgaaacctccccgccttcctccccgagagcccttcggttagaccggctgcacaaaggggcgctgcacaccgtcagccacgaggacatcagggacataaggaactccacaggctcccaggatggtcccgtgagcaaccccagcagtagcaacagtagccaggactcgctccacaaagccccaaagaagaaaggcattaagtcctccattggccgcttgtttggcaagaaagaaaagggccgacctggacaaactggcaaagaagcattaggacaagctggtgtttccgagacggataactcatctcaggatgccttgggacttagcaaattggggggacaggctgaaaaaaatcgtaaacttcaaaaaaagcatgaattgctggaggaagcccggagacaaggtttaccttttgcccaatgggacgggccaacggttgtggtctggctagagctctgggttgggatgccagcctggtatgtggctgcctgccgagcaaacgtgaaaagcggggccatcatgtcggccctgtccgacacagagatccagcgtgagattggcatcagcaaccccctgcacaggctgaagctgaggctggccatccaggagatcatgtcgctgaccagcccgtctgcccc

SEQ ID NO: 171794 - DNA, 564 bp, Homo sapiens
  Payload ID: 13762
  Gene Symbol: PPFIA1
  Gene Name: protein tyrosine phosphatase, receptor type, f polypeptide (PTPRF), interacting protein (liprin), alpha 1
  ENST ID: ENST00000526369
  CDS Start-End: 1-292
aaagcagttagaagaaacacaacacgataaggatcagcttgtcctaaacattgaagcactgagggctgaactagaccacatgagactaagagccgaccccacttgggcagtgtcccagatttcaggttccccatggcagacggccacacagactcctacagcaccagtgcagtgctgcggcgcccacagaaaggccggctggcagccctgcgagatgagccttccaaggtacaaactcttaatgagcaggattgggaacgtgcccagcaagctagtgtcttggcaaatgtagcacaagcattcgagagtgatgctgacgtgtctgatggtgaagatgacagggacactctcctcagctcagttgacctgctatcgcccagcgggcaggccgacgcgcacacactagccatgatgcttcaggagcagctggacgccatcaacaaagagatcaggttgattcaggaagaaaaagaaaatacagagcagcgggcagaggagattgaaagtcgagttggcagtggaagtctagacaatcttggtcgttttagatcaatgagctccatt

SEQ ID NO: 171795 - DNA, 5517 bp, Homo sapiens
  Payload ID: 13763
  Gene Symbol: PPFIA2
  Gene Name: protein tyrosine phosphatase, receptor type, f polypeptide (PTPRF), interacting protein (liprin), alpha 2
  Uniprot ID: O75334
  ENST ID: ENST00000333447
  CDS Start-End: 340-3798
gagaacagatgggcaggtccacagcactgccagattctgcacaagctccatttatcgttggttcttgcttttttccttctgtgtttttaattttttaaaaaacattgtatgttctagagaactagcttcacaaaaggtcggtggctgatgatctttcagctaagatttcaaatgtagaagaacaattcaaaatgctatcactgtgtatgtaagaaggatggggcagatttcattttaccctctagtctccctcaatgcatgcacggatttatctgtacgctaagctctctgctctgcatctgtagctccttgtggattatattgtctcagtgatcagaaatgattttctcggatatgaacaccgtttctggctcccctaaagtgcatcctcctaatgggacccggttttacacttttcaagaatttgctgcactgacaaaagaattaaatgcctgcagggaacaacttctagaaaaggaagaagaaatctctgaacttaaagctgaaagaaacaacacaagactattactggagcatttggagtgccttgtgtcacgacatgaaagatcactaagaatgacggtggtaaaacggcaagcccagtctccctcaggagtatccagtgaagttgaagttctcaaggcactgaaatctttgtttgagcaccacaaggccttggatgaaaagattgttgccttgcgtgaacaaaatgttcatatacaaagaaaaatggcatcaagcgagggatccacagagtcagaacatcttgaagggatggaacctggacagaaagtccatgagaagcgtttgtccaatggttctatagactcaaccgatgaaactagtcaaatagttgaactacaagaattgcttgaaaagcaaaactatgaaatggcccagatgaaagaacgtttagcagccctttcttcccgagtgggagaggtggaacaggaagcagagacagcaagaaaggatctcattaaaacagaagaaatgaacaccaagtatcaaagggacattagggaggccatggcacaaaaggaagatatggaagaaagaattacaacccttgaaaagcgttacctcagtgctcagagagaatctacctccatacatgacatgaatgataaactagaaaatgagttagcaaataaagaagctatcctgcggcagatggaagagaaaaacagacagttacaagaacgtcttgagctagctgaacaaaagttgcagcagaccatgagaaaggctgaaaccttgcctgaagtagaggctgaactggctcagagaattgcagccctaaccaaggctgaagagagacatggaaatattgaagaacgtatgagacatttagagggtcaacttgaagagaagaatcaagaacttcaaagagctaggcaaagagagaaaatgaatgaggagcataacaagagattatcggatacggttgatagacttctgactgaatccaatgaacgcctacaactacacttaaaggaaagaatggctgctctagaagaaaagaatgttttaattcaagaatcagaaactttcagaaagaatcttgaagaatctttacatgataaggaaagattagcagaagaaattgaaaagctgagatctgaacttgaccaattgaaaatgagaactggctctttaattgaacccacaataccaagaactcatctagacacctcagctgagttgcggtactcagtgggatccctagtggacagccagtctgattacagaacaactaaagtaataagaagaccaaggagaggccgcatgggtgtgcgaagagatgagccaaaggtgaaatctcttggggatcacgagtggaatagaactcaacagattggagtactaagcagccacccttttgaaagtgacactgaaatgtctgatattgatgatgatgacagagaaacaatttttagctcaatggatcttctctctccaagtggtcattccgatgcccagacgctagccatgatgcttcaggaacaattggatgccatcaacaaagaaatcaggctaattcaggaagaaaaagaatctacagagttgcgtgctgaagaaattgaaaatagagtggctagtgtgagcctcgaaggcctgaatttggcaagggtccacccaggtacctccattactgcctctgttacagcttcatcgctggccagttcatctccccccagtggacactcaactccaaagctcacccctcgaagccctgccagggaaatggatcggatgggagtcatgacactgccaagtgatctgaggaaacatcggagaaagattgcagttgtggaagaagatggtcgagaggacaaagcaacaattaaatgtgaaacttctcctcctcctacccctagagccctcagaatgactcacactctcccttcttcctaccacaatgatgctcgaagtagtttatctgtctctcttgagccagaaagcctcgggcttggtagtgccaacagcagccaagactctcttcacaaagcccccaagaagaaaggaatcaagtcttcaataggacgtttgtttggtaaaaaagaaaaagctcgacttgggcagctccgaggctttatggagactgaagctgcagctcaggagtccctggggttaggcaaactcggaactcaagctgagaaggatcgaagactaaagaaaaagcatgaacttcttgaagaagctcggagaaagggattaccttttgcccagtgggatgggccaactgtggtcgcatggctagagctttggttgggaatgcctgcgtggtacgtggcagcctgccgagccaacgtgaagagtggtgccatcatgtctgctttatctgacactgagatccagagagaaattggaatcagcaatccactgcatcgcttaaaacttcgattagcaatccaggagatggtttccctaacaagtccttcagctcctccaacatctcgaactccttcaggcaacgtttgggtgactcatgaagaaatggaaaatcttgcagctccagcaaaaacgaaagaatctgaggaaggaagctgggcccagaccctggcttatggagatatgaatcatgagtggattggaaatgaatggcttcccagcttggggttacctcagtacagaagttactttatggaatgcttggtagatgcaagaatgttagatcacctaacaaaaaaagatctccgtgtccatttaaaaatggtggatagtttccatcgaacaagtttacaatatggaattatgtgcttaaagaggttgaattatgacagaaaagaactagaaagaagacgggaagcaagccaacatgaaataaaagacgtgttggtgtggagcaatgaccgagttattcgctggatacaagcaattggacttcgagaatatgcaaataatatacttgagagcggtgtgcatggctcacttatagccctggatgaaaactttgactacagcagcttagctttattattacagattccaacacagaacacccaggcaaggcagattcttgaaagagaatacaataacctcttggccctgggaactgaaaggcgactggatgaaagtgatgacaagaacttcagacgtggatcaacctggagaaggcagtttcctcctcgtgaagtacatggaatcagcatgatgcctgggtcctcagaaacattaccagctggatttaggttaaccacaacctctgggcagtcaagaaaaatgacaacagatgttgcttcatcaagactgcagaggttagacaactccactgttcgcacatactcatgttgaccagccactcaaaggaggcagcactgacctgctatggcgtcttttcagtctactctacctaaagtgcactaccatctaagaagacgagcagtgaaaacctttgtgaaaactgaattctaaggaaataatgacgtcatgacttattaaaagctgaaaaatgtgatttttggggggagtcagatattacatttgattagtttactacaaattgtaataaaatgcttaagtcatttgaataataaacatcatctacatcataaactctgtacaacagatgcttttatgaaatgaagccagttgtttttcatgttttattgtaatatactaggcatttatgtattaccgtgcatttctttttaaatgtgtaagtcttatgtaaatggatataaatatgattttttaaaaaataaaatatatggttcatggagtctcgagtgcaaacatttgacaattccaagtactgtttgtattttaccattccaccatttttacagtttttggattgttaatagtcaaatcaatatgtttccttgaagcatgtttcatgcttcaacgtgtttctccttcaagtctgtcaatacttaaagctgaacaacctgcctctgatcatgtaaaaaagaatgatttaacctggaaccggagccaaaaatagagctttaaaggcaatcagggatgtcctatatctttagaaatagcactgtgatggcttgatctccttttcaatacaaaacaaagccaagctgtttacaagggtcaaaagcaattatttaaaaatttatattaaaaaaccataatcttctcttgttacctgtggaccaagaaaaaaaaaaagataaaaaaacttctttactaagaaccacatgttcattcaaatatcttgaaatgccagccagtactggacagtgaatgtcaaccaccgcagagtctgaggctcatttccactagagaaaacgaaacccaagatacctttcccttttgtcaatgtaacagggcattagccagactcatgtctaatgttataagcttttagccgagatggccttgttgcgacttccctgaagtcagttttatcagaggaaataaatgaaagacagaatgattaacatatatagtgtataaaagtatagaagagtaatctcttccctgtggctttatttggtggtgttactgttgtttattctttgtttatatgggagattcaaagtaaagcctatttaataataccatttatctaactgctgattttctgctgcttgatcttattaagcgcaagacctgtcattagtaatttcttttctgtattttaatttgctatgtttgcacgtacattacatttgttttgatgtctatttttatttaacagattcagtcaaaaggtaatgataacagaaaccctttccattgtcaataaaaaaaataataattccagttctctgtttaagctttgttttctagtcacataaggctcgacaatttacttaaactatcaggaaatgtgttctttgggtgacccaaatatttagcttcaaaattgagtctgccacaagagggagatctaaacttgcttatgggagtgatcttaaaatttttttctaaaaatgtggcctgagtaggaacaatgagaagtagctttctaagctcatctaaacatgggcatcttgattcatagaaatgaaatagaatataggaactacgacattataatgccataactagatt

SEQ ID NO: 171796 - DNA, 3903 bp, Homo sapiens
  Payload ID: 13763
  Gene Symbol: PPFIA2
  Gene Name: protein tyrosine phosphatase, receptor type, f polypeptide (PTPRF), interacting protein (liprin), alpha 2
  Uniprot ID: O75334
  ENST ID: ENST00000407050
  CDS Start-End: 340-3810
gagaacagatgggcaggtccacagcactgccagattctgcacaagctccatttatcgttggttcttgcttttttccttctgtgtttttaattttttaaaaaacattgtatgttctagagaactagcttcacaaaaggtcggtggctgatgatctttcagctaagatttcaaatgtagaagaacaattcaaaatgctatcactgtgtatgtaagaaggatggggcagatttcattttaccctctagtctccctcaatgcatgcacggatttatctgtacgctaagctctctgctctgcatctgtagctccttgtggattatattgtctcagtgatcagaaatgattttctcggatatgaacaccgtttctggctcccctaaagtgcatcctcctaatgggacccggttttacacttttcaagaatttgctgcactgacaaaagaattaaatgcctgcagggaacaacttctagaaaaggaagaagaaatctctgaacttaaagctgaaagaaacaacacaagactattactggagcatttggagtgccttgtgtcacgacatgaaagatcactaagaatgacggtggtaaaacggcaagcccagtctccctcaggagtatccagtgaagttgaagttctcaaggcactgaaatctttgtttgagcaccacaaggccttggatgaaaaggtaagggagcgactgagggtttctttagaaagagtctctgcactggaagaagaactagctgctgctaatcaggagattgttgccttgcgtgaacaaaatgttcatatacaaagaaaaatggcatcaagcgagggatccacagagtcagaacatcttgaagggatggaacctggacagaaagtccatgagaagcgtttgtccaatggttctatagactcaaccgatgaaactagtcaaatagttgaactacaagaattgcttgaaaagcaaaactatgaaatggcccagatgaaagaacgtttagcagccctttcttcccgagtgggagaggtggaacaggaagcagagacagcaagaaaggatctcattaaaacagaagaaatgaacaccaagtatcaaagggacattagggaggccatggcacaaaaggaagatatggaagaaagaattacaacccttgaaaagcgttacctcagtgctcagagagaatctacctccatacatgacatgaatgataaactagaaaatgagttagcaaataaagaagctatcctgcggcagatggaagagaaaaacagacagttacaagaacgtcttgagctagctgaacaaaagttgcagcagaccatgagaaaggctgaaaccttgcctgaagtagaggctgaactggctcagagaattgcagccctaaccaaggctgaagagagacatggaaatattgaagaacgtatgagacatttagagggtcaacttgaagagaagaatcaagaacttcaaagagctaggcaaagagagaaaatgaatgaggagcataacaagagattatcggatacggttgatagacttctgactgaatccaatgaacgcctacaactacacttaaaggaaagaatggctgctctagaagaaaagaatgttttaattcaagaatcagaaactttcagaaagaatcttgaagaatctttacatgataaggaaagattagcagaagaaattgaaaagctgagatctgaacttgaccaattgaaaatgagaactggctctttaattgaacccacaataccaagaactcatctagacacctcagctgagttgcggtactcagtgggatccctagtggacagccagtctgattacagaacaactaaagtaataagaagaccaaggagaggccgcatgggtgtgcgaagagatgagccaaaggtgaaatctcttggggatcacgagtggaatagaactcaacagattggagtactaagcagccacccttttgaaagtgacactgaaatgtctgatattgatgatgatgacagagaaacaatttttagctcaatggatcttctctctccaagtggtcattccgatgcccagacgctagccatgatgcttcaggaacaattggatgccatcaacaaagaaatcaggctaattcaggaagaaaaagaatctacagagttgcgtgctgaagaaattgaaaatagagtggctagtgtgagcctcgaaggcctgaatttggcaagggtccacccaggtacctccattactgcctctgttacagcttcatcgctggccagttcatctccccccagtggacactcaactccaaagctcacccctcgaagccctgccagggaaatggatcggatgggagtcatgacactgccaagtgatctgaggaaacatcggagaaagattgcagttgtggaagaagatggtcgagaggacaaagcaacaattaaatgtgaaacttctcctcctcctacccctagagccctcagaatgactcacactctcccttcttcctaccacaatgatgctcgaagtagtttatctgtctctcttgagccagaaagcctcgggcttggtagtgccaacagcagccaagactctcttcacaaagcccccaagaagaaaggaatcaagtcttcaataggacgtttgtttggtaaaaaagaaaaagctcgacttgggcagctccgaggctttatggagactgaagctgcagctcaggagtccctggggttaggcaaactcggaactcaagctgagaaggatcgaagactaaagaaaaagcatgaacttcttgaagaagctcggagaaagggattaccttttgcccagtgggatgggccaactgtggtcgcatggctagagctttggttgggaatgcctgcgtggtacgtggcagcctgccgagccaacgtgaagagtggtgccatcatgtctgctttatctgacactgagatccagagagaaattggaatcagcaatccactgcatcgcttaaaacttcgattagcaatccaggagatggtttccctaacaagtccttcagctcctccaacatctcgaactaaagaatctgaggaaggaagctgggcccagaccctggcttatggagatatgaatcatgagtggattggaaatgaatggcttcccagcttggggttacctcagtacagaagttactttatggaatgcttggtagatgcaagaatgttagatcacctaacaaaaaaagatctccgtgtccatttaaaaatggtggatagtttccatcgaacaagtttacaatatggaattatgtgcttaaagaggttgaattatgacagaaaagaactagaaagaagacgggaagcaagccaacatgaaataaaagacgtgttggtgtggagcaatgaccgagttattcgctggatacaagcaattggacttcgagaatatgcaaataatatacttgagagcggtgtgcatggctcacttatagccctggatgaaaactttgactacagcagcttagctttattattacagattccaacacagaacacccaggcaaggcagattcttgaaagagaatacaataacctcttggccctgggaactgaaaggcgactggatgaaagtgatgacaagaacttcagacgtggatcaacctggagaaggcagtttcctcctcgtgaagtacatggaatcagcatgatgcctgggtcctcagaaacattaccagctggatttaggttaaccacaacctctgggcagtcaagaaaaatgacaacagatgttgcttcatcaagactgcagaggttagacaactccactgttcgcacatactcatgttgaccagccactcaaaggaggcagcactgacctgctatggcgtcttttcagtctactctacctaaagtgcactaccatctaagaagacgagcagtg

SEQ ID NO: 171797 - DNA, 3782 bp, Homo sapiens
  Payload ID: 13763
  Gene Symbol: PPFIA2
  Gene Name: protein tyrosine phosphatase, receptor type, f polypeptide (PTPRF), interacting protein (liprin), alpha 2
  Uniprot ID: O75334
  ENST ID: ENST00000443686
  CDS Start-End: 309-3767
agattctgcacaagctccatttatcgttggttcttgcttttttccttctgtgtttttaattttttaaaaaacattgtatgttctagagaactagcttcacaaaaggtcggtggctgatgatctttcagctaagatttcaaatgtagaagaacaattcaaaatgctatcactgtgtatgtaagaaggatggggcagatttcattttaccctctagtctccctcaatgcatgcacggatttatctgtacgctaagctctctgctctgcatctgtagctccttgtggattatattgtctcagtgatcagaaatgattttctcggatatgaacaccgtttctggctcccctaaagtgcatcctcctaatgggacccggttttacacttttcaagaatttgctgcactgacaaaagaattaaatgcctgcagggaacaacttctagaaaaggaagaagaaatctctgaacttaaagctgaaagaaacaacacaagactattactggagcatttggagtgccttgtgtcacgacatgaaagatcactaagaatgacggtggtaaaacggcaagcccagtctccctcaggagtatccagtgaagttgaagttctcaaggcactgaaatctttgtttgagcaccacaaggccttggatgaaaagattgttgccttgcgtgaacaaaatgttcatatacaaagaaaaatggcatcaagcgagggatccacagagtcagaacatcttgaagggatggaacctggacagaaagtccatgagaagcgtttgtccaatggttctatagactcaaccgatgaaactagtcaaatagttgaactacaagaattgcttgaaaagcaaaactatgaaatggcccagatgaaagaacgtttagcagccctttcttcccgagtgggagaggtggaacaggaagcagagacagcaagaaaggatctcattaaaacagaagaaatgaacaccaagtatcaaagggacattagggaggccatggcacaaaaggaagatatggaagaaagaattacaacccttgaaaagcgttacctcagtgctcagagagaatctacctccatacatgacatgaatgataaactagaaaatgagttagcaaataaagaagctatcctgcggcagatggaagagaaaaacagacagttacaagaacgtcttgagctagctgaacaaaagttgcagcagaccatgagaaaggctgaaaccttgcctgaagtagaggctgaactggctcagagaattgcagccctaaccaaggctgaagagagacatggaaatattgaagaacgtatgagacatttagagggtcaacttgaagagaagaatcaagaacttcaaagagctaggcaaagagagaaaatgaatgaggagcataacaagagattatcggatacggttgatagacttctgactgaatccaatgaacgcctacaactacacttaaaggaaagaatggctgctctagaagaaaagaatgttttaattcaagaatcagaaactttcagaaagaatcttgaagaatctttacatgataaggaaagattagcagaagaaattgaaaagctgagatctgaacttgaccaattgaaaatgagaactggctctttaattgaacccacaataccaagaactcatctagacacctcagctgagttgcggtactcagtgggatccctagtggacagccagtctgattacagaacaactaaagtaataagaagaccaaggagaggccgcatgggtgtgcgaagagatgagccaaaggtgaaatctcttggggatcacgagtggaatagaactcaacagattggagtactaagcagccacccttttgaaagtgacactgaaatgtctgatattgatgatgatgacagagaaacaatttttagctcaatggatcttctctctccaagtggtcattccgatgcccagacgctagccatgatgcttcaggaacaattggatgccatcaacaaagaaatcaggctaattcaggaagaaaaagaatctacagagttgcgtgctgaagaaattgaaaatagagtggctagtgtgagcctcgaaggcctgaatttggcaagggtccacccaggtacctccattactgcctctgttacagcttcatcgctggccagttcatctccccccagtggacactcaactccaaagctcacccctcgaagccctgccagggaaatggatcggatgggagtcatgacactgccaagtgatctgaggaaacatcggagaaagattgcagttgtggaagaagatggtcgagaggacaaagcaacaattaaatgtgaaacttctcctcctcctacccctagagccctcagaatgactcacactctcccttcttcctaccacaatgatgctcgaagtagtttatctgtctctcttgagccagaaagcctcgggcttggtagtgccaacagcagccaagactctcttcacaaagcccccaagaagaaaggaatcaagtcttcaataggacgtttgtttggtaaaaaagaaaaagctcgacttgggcagctccgaggctttatggagactgaagctgcagctcaggagtccctggggttaggcaaactcggaactcaagctgagaaggatcgaagactaaagaaaaagcatgaacttcttgaagaagctcggagaaagggattaccttttgcccagtgggatgggccaactgtggtcgcatggctagagctttggttgggaatgcctgcgtggtacgtggcagcctgccgagccaacgtgaagagtggtgccatcatgtctgctttatctgacactgagatccagagagaaattggaatcagcaatccactgcatcgcttaaaacttcgattagcaatccaggagatggtttccctaacaagtccttcagctcctccaacatctcgaactccttcaggcaacgtttgggtgactcatgaagaaatggaaaatcttgcagctccagcaaaaacgaaagaatctgaggaaggaagctgggcccagaccctggcttatggagatatgaatcatgagtggattggaaatgaatggcttcccagcttggggttacctcagtacagaagttactttatggaatgcttggtagatgcaagaatgttagatcacctaacaaaaaaagatctccgtgtccatttaaaaatggtggatagtttccatcgaacaagtttacaatatggaattatgtgcttaaagaggttgaattatgacagaaaagaactagaaagaagacgggaagcaagccaacatgaaataaaagacgtgttggtgtggagcaatgaccgagttattcgctggatacaagcaattggacttcgagaatatgcaaataatatacttgagagcggtgtgcatggctcacttatagccctggatgaaaactttgactacagcagcttagctttattattacagattccaacacagaacacccaggcaaggcagattcttgaaagagaatacaataacctcttggccctgggaactgaaaggcgactggatgaaagtgatgacaagaacttcagacgtggatcaacctggagaaggcagtttcctcctcgtgaagtacatggaatcagcatgatgcctgggtcctcagaaacattaccagctggatttaggttaaccacaacctctgggcagtcaagaaaaatgacaacagatgttgcttcatcaagactgcagaggttagacaactccactgttcgcacatactcatgttgaccagccactcaaagg

SEQ ID NO: 171798 - DNA, 2976 bp, Homo sapiens
  Payload ID: 13763
  Gene Symbol: PPFIA2
  Gene Name: protein tyrosine phosphatase, receptor type, f polypeptide (PTPRF), interacting protein (liprin), alpha 2
  Uniprot ID: O75334
  ENST ID: ENST00000541570
  CDS Start-End: 159-2510
aaataactccaatgttttgctgatgcttggatgtaacaggcctttgtagctgacacatttcaagcaatgctgttcagctgcctgtttgaagaaagtttattttttaaaaactatgtttgcagttggctgaagagagacatggaaatattgaagaacgtatgagacatttagagggtcaacttgaagagaagaatcaagaacttcaaagagctaggcaaagagagaaaatgaatgaggagcataacaagagattatcggatacggttgatagacttctgactgaatccaatgaacgcctacaactacacttaaaggaaagaatggctgctctagaagaaaagaatgttttaattcaagaatcagaaactttcagaaagaatcttgaagaatctttacatgataaggaaagattagcagaagaaattgaaaagctgagatctgaacttgaccaattgaaaatgagaactggctctttaattgaacccacaataccaagaactcatctagacacctcagctgagttgcggtactcagtgggatccctagtggacagccagtctgattacagaacaactaaagtaataagaagaccaaggagaggccgcatgggtgtgcgaagagatgagccaaaggtgaaatctcttggggatcacgagtggaatagaactcaacagattggagtactaagcagccacccttttgaaagtgacactgaaatgtctgatattgatgatgatgacagagaaacaatttttagctcaatggatcttctctctccaagtggtcattccgatgcccagacgctagccatgatgcttcaggaacaattggatgccatcaacaaagaaatcaggctaattcaggaagaaaaagaatctacagagttgcgtgctgaagaaattgaaaatagagtggctagtgtgagcctcgaaggcctgaatttggcaagggtccacccaggtacctccattactgcctctgttacagcttcatcgctggccagttcatctccccccagtggacactcaactccaaagctcacccctcgaagccctgccagggaaatggatcggatgggagtcatgacactgccaagtgatctgaggaaacatcggagaaagattgcagttgtggaagaagatggtcgagaggacaaagcaacaattaaatgtgaaacttctcctcctcctacccctagagccctcagaatgactcacactctcccttcttcctaccacaatgatgctcgaagtagtttatctgtctctcttgagccagaaagcctcgggcttggtagtgccaacagcagccaagactctcttcacaaagcccccaagaagaaaggaatcaagtcttcaataggacgtttgtttggtaaaaaagaaaaagctcgacttgggcagctccgaggctttatggagactgaagctgcagctcaggagtccctggggttaggcaaactcggaactcaagctgagaaggatcgaagactaaagaaaaagcatgaacttcttgaagaagctcggagaaagggattaccttttgcccagtgggatgggccaactgtggtcgcatggctagagctttggttgggaatgcctgcgtggtacgtggcagcctgccgagccaacgtgaagagtggtgccatcatgtctgctttatctgacactgagatccagagagaaattggaatcagcaatccactgcatcgcttaaaacttcgattagcaatccaggagatggtttccctaacaagtccttcagctcctccaacatctcgaacttgtccggtttttctacagaccctggcttatggagatatgaatcatgagtggattggaaatgaatggcttcccagcttggggttacctcagtacagaagttactttatggaatgcttggtagatgcaagaatgttagatcacctaacaaaaaaagatctccgtgtccatttaaaaatggtggatagtttccatcgaacaagtttacaatatggaattatgtgcttaaagaggttgaattatgacagaaaagaactagaaagaagacgggaagcaagccaacatgaaataaaagacgtgttggtgtggagcaatgaccgagttattcgctggatacaagcaattggacttcgagaatatgcaaataatatacttgagagcggtgtgcatggctcacttatagccctggatgaaaactttgactacagcagcttagctttattattacagattccaacacagaacacccaggcaaggcagattcttgaaagagaatacaataacctcttggccctgggaactgaaaggcgactggatgaaagtgatgacaagaacttcagacgtggatcaacctggagaaggcagtttcctcctcgtgaagtacatggaatcagcatgatgcctgggtcctcagaaacattaccagctggatttaggttaaccacaacctctgggcagtcaagaaaaatgacaacagatgatggcgtcttttcagtctactctacctaaagtgcactaccatctaagaagacgagcagtgaaaacctttgtgaaaactgaattctaaggaaataatgacgtcatgacttattaaaagctgaaaaatgtgatttttggggggagtcagatattacatttgattagtttactacaaattgtaataaaatgcttaagtcatttgaataataaacatcatctacatcataaactctgtacaacagatgcttttatgaaatgaagccagttgtttttcatgttttattgtaatatactaggcatttatgtattaccgtgcatttctttttaaatgtgtaagtcttatgtaaatggatataaatatgattttttaaaaaataaaatatatggttcatggagtctcgagtgcaaacatttgacaattccaagtactgtttgtattttaccattccaccatttttacagtttttggattgttaatagtcaaatcaatatgttt

SEQ ID NO: 171799 - DNA, 4192 bp, Homo sapiens
  Payload ID: 13763
  Gene Symbol: PPFIA2
  Gene Name: protein tyrosine phosphatase, receptor type, f polypeptide (PTPRF), interacting protein (liprin), alpha 2
  Uniprot ID: O75334
  ENST ID: ENST00000541017
  CDS Start-End: 1142-2473
aaataactccaatgttttgctgatgcttggatgtaacaggcctttgtagctgacacatttcaagcaatgctgttcagctgcctgtttgaagaaagtttattttttaaaaactatgtttgcagttggctgaagagagacatggaaatattgaagaacgtatgagacatttagagggtcaacttgaagagaagaatcaagaacttcaaagagctaggcaaagagagaaaatgaatgaggagcataacaagagattatcggatacggttgatagacttctgactgaatccaatgaacgcctacaactacacttaaaggaaagaatggctgctctagaagaaaagttggcagctaccagaccagcaagagttatgagagctggttaccaattccagagcataaattaagaatgttttaattcaagaatcagaaactttcagaaagaatcttgaagaatctttacatgataaggaaagattagcagaagaaattgaaaagctgagatctgaacttgaccaattgaaaatgagaactggctctttaattgaacccacaataccaagaactcatctagacacctcagctgagttgcggtactcagtgggatccctagtggacagccagtctgattacagaacaactaaagtaataagaagaccaaggagaggccgcatgggtgtgcgaagagatgagccaaaggtgaaatctcttggggatcacgagtggaatagaactcaacagattggagtactaagcagccacccttttgaaagtgacactgaaatgtctgatattgatgatgatgacagagaaacaatttttagctcaatggatcttctctctccaagtggtcattccgatgcccagacgctagccatgatgcttcaggaacaattggatgccatcaacaaagaaatcaggctaattcaggaagaaaaagaatctacagagttgcgtgctgaagaaattgaaaatagagtggctagtgtgagcctcgaaggcctgaatttggcaagggtccacccagccaagtgatctgaggaaacatcggagaaagattgcagttgtggaagaagatggtcgagaggacaaagcaacaattaaatgtgaaacttctcctcctcctacccctagagccctcagaatgactcacactctcccttcttcctaccacaatgatgctcgaagtagtttatctgtctctcttgagccagaaagcctcgggcttggtagtgccaacagcagccaagactctcttcacaaagcccccaagaagaaaggaatcaagtcttcaataggacgtttgtttggtaaaaaagaaaaagctcgacttgggcagctccgaggctttatggagactgaagctgcagctcaggagtccctggggttaggcaaactcggaactcaagctgagaaggatcgaagactaaagaaaaagcatgaacttcttgaagaagctcggagaaagggattaccttttgcccagtgggatgggccaactgtggtcgcatggctagagctttggttgggaatgcctgcgtggtacgtggcagcctgccgagccaacgtgaagagtggtgccatcatgtctgctttatctgacactgagatccagagagaaattggaatcagcaatccactgcatcgcttaaaacttcgattagcaatccaggagatggtttccctaacaagtccttcagctcctccaacatctcgaacttgtccggtttttctacagaccctggcttatggagatatgaatcatgagtggattggaaatgaatggcttcccagcttggggttacctcagtacagaagttactttatggaatgcttggtagatgcaagaatgttagatcacctaacaaaaaaagatctccgtgtccatttaaaaatggtggatagtttccatcgaacaagtttacaatatggaattatgtgcttaaagaggttgaattatgacagaaaagaactagaaagaagacgggaagcaagccaacatgaaataaaagacgtgttggtgtggagcaatgaccgagttattcgctggatacaagcaattggacttcgagaatatgcaaataatatacttgagagcggtgtgcatggctcacttatagccctggatgaaaactttgactacagcagcttagctttattattacagattccaacacagaacacccaggcaaggcagattcttgaaagagaatacaataacctcttggccctgggaactgaaaggcgactggatgaaagtgatgacaagaacttcagacgtggatcaacctggagaaggcagtttcctcctcgtgaagtacatggaatcagcatgatgcctgggtcctcagaaacattaccagctggatttaggttaaccacaacctctgggcagtcaagaaaaatgacaacagatgttgcttcatcaagactgcagaggttagacaactccactgttcgcacatactcatgttgaccagccactcaaaggaggcagcactgacctgctatggcgtcttttcagtctactctacctaaagtgcactaccatctaagaagacgagcagtgaaaacctttgtgaaaactgaattctaaggaaataatgacgtcatgacttattaaaagctgaaaaatgtgatttttggggggagtcagatattacatttgattagtttactacaaattgtaataaaatgcttaagtcatttgaataataaacatcatctacatcataaactctgtacaacagatgcttttatgaaatgaagccagttgtttttcatgttttattgtaatatactaggcatttatgtattaccgtgcatttctttttaaatgtgtaagtcttatgtaaatggatataaatatgattttttaaaaaataaaatatatggttcatggagtctcgagtgcaaacatttgacaattccaagtactgtttgtattttaccattccaccatttttacagtttttggattgttaatagtcaaatcaatatgtttccttgaagcatgtttcatgcttcaacgtgtttctccttcaagtctgtcaatacttaaagctgaacaacctgcctctgatcatgtaaaaaagaatgatttaacctggaaccggagccaaaaatagagctttaaaggcaatcagggatgtcctatatctttagaaatagcactgtgatggcttgatctccttttcaatacaaaacaaagccaagctgtttacaagggtcaaaagcaattatttaaaaatttatattaaaaaaccataatcttctcttgttacctgtggaccaagaaaaaaaaaaagataaaaaaacttctttactaagaaccacatgttcattcaaatatcttgaaatgccagccagtactggacagtgaatgtcaaccaccgcagagtctgaggctcatttccactagagaaaacgaaacccaagatacctttcccttttgtcaatgtaacagggcattagccagactcatgtctaatgttataagcttttagccgagatggccttgttgcgacttccctgaagtcagttttatcagaggaaataaatgaaagacagaatgattaacatatatagtgtataaaagtatagaagagtaatctcttccctgtggctttatttggtggtgttactgttgtttattctttgtttatatgggagattcaaagtaaagcctatttaataataccatttatctaactgctgattttctgctgcttgatcttattaagcgcaagacctgtcattagtaatttcttttctgtattttaatttgctatgtttgcacgtacattacatttgttttgatgtctatttttatttaacagattcagtcaaaaggtaatgataacagaaaccctttccattgtcaataaaaaaaataataattccagttctctgtttaagctttgttttctagtcacataaggctcgacaatttacttaaactatcaggaaatgtgttctttgggtgacccaaatatttagcttcaaaattgagtctgccacaagagggagatctaaacttgcttatgggagtgatcttaaaatttttttctaaaaatgtggcctgagtaggaacaatgagaagtagctttctaagctcatctaaacatgggcatcttgattcatagaaatgaaatagaatataggaactacgacattataatgccataactagatt

SEQ ID NO: 171800 - DNA, 852 bp, Homo sapiens
  Payload ID: 13763
  Gene Symbol: PPFIA2
  Gene Name: protein tyrosine phosphatase, receptor type, f polypeptide (PTPRF), interacting protein (liprin), alpha 2
  ENST ID: ENST00000548790
  CDS Start-End: 1-852
accacaaggccttggatgaaaaggtaagggagcgactgagggtttctttagaaagagtctctgcactggaagaagaactagctgctgctaatcaggagattgttgccttgcgtgaacaaaatgttcatatacaaagaaaaatggcatcaagcgagggatccacagagtcagaacatcttgaagggatggaacctggacagaaagtccatgagaagcgtttgtccaatggttctatagactcaaccgatgaaactagtcaaatagttgaactacaagaattgcttgaaaagcaaaactatgaaatggcccagatgaaagaacgtttagcagccctttcttcccgagtgggagaggtggaacaggaagcagagacagcaagaaaggatctcattaaaacagaagaaatgaacaccaagtatcaaagggacattagggaggccatggcacaaaaggaagatatggaagaaagaattacaacccttgaaaagcgttacctcagtgctcagagagaatctacctccatacatgacatgaatgataaactagaaaatgagttagcaaataaagaagctatcctgcggcaggttcagtatctctgtcttggttttcttctggtctgtgcgttctcatcattctcacaaaacggaatggaagagaaaaacagacagttacaagaacgtcttgagctagctgaacaaaagttgcagcagaccatgagaaaggctgaaaccttgcctgaagtagaggctgaactggctcagagaattgcagccctaaccaaggctgaagagagacatggaaatattgaagaacgtatgagacatttagagggtcaacttgaagagaagaatc

SEQ ID NO: 171801 - DNA, 563 bp, Homo sapiens
  Payload ID: 13763
  Gene Symbol: PPFIA2
  Gene Name: protein tyrosine phosphatase, receptor type, f polypeptide (PTPRF), interacting protein (liprin), alpha 2
  ENST ID: ENST00000550018
  CDS Start-End: 1-563
ctcaagctgagaaggatcgaagactaaagaaaaacacatctgggcatgaacttcttgaagaagctcggagaaagggattaccttttgcccagtgggatgggccaactgtggtcgcatggctagagctttggttgggaatgcctgcgtggtacgtggcagcctgccgagccaacgtgaagagtggtgccatcatgtctgctttatctgacactgagatccagagagaaattggaatcagcaatccactgcatcgcttaaaacttcgattagcaatccaggagatggtttccctaacaagtccttcagctcctccaacatctcgaacttgtccggtttttctacagaccctggcttatggagatatgaatcatgagtggattggaaatgaatggcttcccagcttggggttacctcagtacagaagttactttatggaatgcttggtagatgcaagaatgttagatcacctaacaaaaaaagatctccgtgtccatttaaaaatggtggatagtttccatcgaacaagtttacaatatggaattatgtgcttaaagaggttgaat

SEQ ID NO: 171802 - DNA, 3808 bp, Homo sapiens
  Payload ID: 13763
  Gene Symbol: PPFIA2
  Gene Name: protein tyrosine phosphatase, receptor type, f polypeptide (PTPRF), interacting protein (liprin), alpha 2
  ENST ID: ENST00000550359
  CDS Start-End: 236-3550
aatttgttttggctgcaggtacataagagatagcagtgggagatgggaagggagagccagaggccgaccaggacatcaggaatttgctgcactgacaaaagaattaaatgcctgcagggaacaacttctagaaaaggaagaagaaatctctgaacttaaagctgaaagaaacaacacaagactattactggagcatttggagtgccttgtgtcacgacatgaaagatcactaagaatgacggtggtaaaacggcaagcccagtctccctcaggagtatccagtgaagttgaagttctcaaggcactgaaatctttgtttgagcaccacaaggccttggatgaaaaggtaagggagcgactgagggtttctttagaaagagtctctgcactggaagaagaactagctgctgctaatcaggagattgttgccttgcgtgaacaaaatgttcatatacaaagaaaaatggcatcaagcgagggatccacagagtcagaacatcttgaagggatggaacctggacagaaagtccatgagaagcgtttgtccaatggttctatagactcaaccgatgaaactagtcaaatagttgaactacaagaattgcttgaaaagcaaaactatgaaatggcccagatgaaagaacgtttagcagccctttcttcccgagtgggagaggtggaacaggaagcagagacagcaagaaaggatctcattaaaacagaagaaatgaacaccaagtatcaaagggacattagggaggccatggcacaaaaggaagatatggaagaaagaattacaacccttgaaaagcgttacctcagtgctcagagagaatctacctccatacatgacatgaatgataaactagaaaatgagttagcaaataaagaagctatcctgcggcagatggaagagaaaaacagacagttacaagaacgtcttgagctagctgaacaaaagttgcagcagaccatgagaaaggctgaaaccttgcctgaagtagaggctgaactggctcagagaattgcagccctaaccaaggctgaagagagacatggaaatattgaagaacgtatgagacatttagagggtcaacttgaagagaagaatcaagaacttcaaagagctaggcaaagagagaaaatgaatgaggagcataacaagagattatcggatacggttgatagacttctgactgaatccaatgaacgcctacaactacacttaaaggaaagaatggctgctctagaagaaaagaatgttttaattcaagaatcagaaactttcagaaagaatcttgaagaatctttacatgataaggaaagattagcagaagaaattgaaaagctgagatctgaacttgaccaattgaaaatgagaactggctctttaattgaacccacaataccaagaactcatctagacacctcagctgagttgcggtactcagtgggatccctagtggacagccagtctgattacagaacaactaaagtaataagaagaccaaggagaggccgcatgggtgtgcgaagagatgagccaaaggtgaaatctcttggggatcacgagtggaatagaactcaacagattggagtactaagcagccacccttttgaaagtgacactgaaatgtctgatattgatgatgatgacagagaaacaatttttagctcaatggatcttctctctccaagtggtcattccgatgcccagacgctagccatgatgcttcaggaacaattggatgccatcaacaaagaaatcaggctaattcaggaagaaaaagaatctacagagttgcgtgctgaagaaattgaaaatagagtggctagtgtgagcctcgaaggcctgaatttggcaagggtccacccaggtacctccattactgcctctgttacagcttcatcgctggccagttcatctccccccagtggacactcaactccaaagctcacccctcgaagccctgccagggaaatggatcggatgggagtcatgacactgccaagtgatctgaggaaacatcggagaaagattgcagttgtggaagaagatggtcgagaggacaaagcaacaattaaatgtgaaacttctcctcctcctacccctagagccctcagaatgactcacactctcccttcttcctaccacaatgatgctcgaagtagtttatctgtctctcttgagccagaaagcctcgggcttggtagtgccaacagcagccaagactctcttcacaaagcccccaagaagaaaggaatcaagtcttcaataggacgtttgtttggtaaaaaagaaaaagctcgacttgggcagctccgaggctttatggagactgaagctgcagctcaggagtccctggggttaggcaaactcggaactcaagctgagaaggatcgaagactaaagaaaaagcatgaacttcttgaagaagctcggagaaagggattaccttttgcccagtgggatgggccaactgtggtcgcatggctagagctttggttgggaatgcctgcgtggtacgtggcagcctgccgagccaacgtgaagagtggtgccatcatgtctgctttatctgacactgagatccagagagaaattggaatcagcaatccactgcatcgcttaaaacttcgattagcaatccaggagatggtttccctaacaagtccttcagctcctccaacatctcgaactccttcaggcaacgtttgggtgactcatgaagaaatggaaaatcttgcagctccagcaaaaacgaaagaatctgaggaaggaagctgggcccagtgtccggtttttctacagaccctggcttatggagatatgaatcatgagtggattggaaatgaatggcttcccagcttggggttacctcagtacagaagttactttatggaatgcttggtagatgcaagaatgttagatcacctaacaaaaaaagatctccgtgtccatttaaaaatggtggatagtttccatcgaacaagtttacaatatggaattatgtgcttaaagaggttgaattatgacagaaaagaactagaaagaagacgggaagcaagccaacatgaaataaaagacgtgttggtgtggagcaatgaccgagttattcgctggatacaagcaattggacttcgagaatatgcaaataatatacttgagagcggtgtgcatggctcacttatagccctggatgaaaactttgactacagcagcttagctttattattacagattccaacacagaacacccaggcaaggcagattcttgaaagagaatacaataacctcttggccctgggaactgaaaggcgactggatgaaagtgatgacaagaacttcagacgtggatcaacctggagaaggcagtttcctcctcgtgaagtacatggaatcagcatgatgcctgggtcctcagaaacattaccagctggatttaggttaaccacaacctctgggcagtcaagaaaaatgacaacagatgttgcttcatcaagactgcagaggttagacaactccactgttcgcacatactcatgttgaccagccactcaaaggaggcagcactgacctgctatggcgtcttttcagtctactctacctaaagtgcactaccatctaagaagacgagcagtgaaaacctttgtgaaaactgaattctaaggaaataatgacgtcatgacttattaaaagctgaaaaatgtgatttttggggggagtcagatattacatttgattagtttactacaaattgtaataaaatgcttaagtcatttgaataataaacatcatctacatcat

SEQ ID NO: 171803 - DNA, 617 bp, Homo sapiens
  Payload ID: 13763
  Gene Symbol: PPFIA2
  Gene Name: protein tyrosine phosphatase, receptor type, f polypeptide (PTPRF), interacting protein (liprin), alpha 2
  ENST ID: ENST00000548670
  CDS Start-End: 245-617
caatgttttgctgatgcttggatgtaacaggcctttgtagctgacacatttcaagcaatgctgttcagctgcctgtttgaagaaagtttattttttaaaaactatgtttgcagttggtagtagcttgctttacattttatttcaatttatttagaggaaaagtgttaaccaaatcttacatttcaggtgtattcttcatatttcttaacaggctgaagagagacatggaaatattgaagaacgtatgagacatttagagggtcaacttgaagagaagaatcaagaacttcaaagagctaggcaaagagagaaaatgaatgaggagcataacaagagattatcggatacggttgatagacttctgactgaatccaatgaacgcctacaactacacttaaaggaaagaatggctgctctagaagaaaagaatgttttaattcaagaatcagaaactttcagaaagaatcttgaagaatctttacatgataaggaaagattagcagaagaaattgaaaagctgagatctgaacttgaccaattgaaaatgagaactggctctttaattgaacccacaataccaagaactcatctagacacctcagctgagttgcggtact

SEQ ID NO: 171804 - DNA, 3976 bp, Homo sapiens
  Payload ID: 13763
  Gene Symbol: PPFIA2
  Gene Name: protein tyrosine phosphatase, receptor type, f polypeptide (PTPRF), interacting protein (liprin), alpha 2
  Uniprot ID: O75334
  ENST ID: ENST00000552948
  CDS Start-End: 251-3961
cgatggacgcttctccttttggctgctgacggagccacgggaagatgccgagctcctgccacgccaccgggccggggcacgttccgggagggcgccggggcacgcgtgtgtctgagctgcctttctcctcccgttgctagggaaatggtccaggagtgctgggtgtgagcctcccttctcctcaagccggagactgcggttgtcattgatcaattgaagaagcaaggacccgaaatcacagacattagcaatgatgtgtgaagtgatgcccacgattaatgaggacaccccaatgagccaaagggggtcccaaagcagtggctcggactcagactcccattttgagcagctgatggtgaatatgctagatgaaagggatcgtcttctagacacccttcgggagacccaggaaagcctctcacttgcccagcaaagacttcaggatgtcatctatgaccgagactcactccagagacagctcaattcagccctgccacaggatatcgaatccctaacaggagggctggctggttctaagggggctgatccaccggaatttgctgcactgacaaaagaattaaatgcctgcagggaacaacttctagaaaaggaagaagaaatctctgaacttaaagctgaaagaaacaacacaagactattactggagcatttggagtgccttgtgtcacgacatgaaagatcactaagaatgacggtggtaaaacggcaagcccagtctccctcaggagtatccagtgaagttgaagttctcaaggcactgaaatctttgtttgagcaccacaaggccttggatgaaaaggtaagggagcgactgagggtttctttagaaagagtctctgcactggaagaagaactagctgctgctaatcaggagattgttgccttgcgtgaacaaaatgttcatatacaaagaaaaatggcatcaagcgagggatccacagagtcagaacatcttgaagggatggaacctggacagaaagtccatgagaagcgtttgtccaatggttctatagactcaaccgatgaaactagtcaaatagttgaactacaagaattgcttgaaaagcaaaactatgaaatggcccagatgaaagaacgtttagcagccctttcttcccgagtgggagaggtggaacaggaagcagagacagcaagaaaggatctcattaaaacagaagaaatgaacaccaagtatcaaagggacattagggaggccatggcacaaaaggaagatatggaagaaagaattacaacccttgaaaagcgttacctcagtgctcagagagaatctacctccatacatgacatgaatgataaactagaaaatgagttagcaaataaagaagctatcctgcggcagatggaagagaaaaacagacagttacaagaacgtcttgagctagctgaacaaaagttgcagcagaccatgagaaaggctgaaaccttgcctgaagtagaggctgaactggctcagagaattgcagccctaaccaaggctgaagagagacatggaaatattgaagaacgtatgagacatttagagggtcaacttgaagagaagaatcaagaacttcaaagagctaggcaaagagagaaaatgaatgaggagcataacaagagattatcggatacggttgatagacttctgactgaatccaatgaacgcctacaactacacttaaaggaaagaatggctgctctagaagaaaagaatgttttaattcaagaatcagaaactttcagaaagaatcttgaagaatctttacatgataaggaaagattagcagaagaaattgaaaagctgagatctgaacttgaccaattgaaaatgagaactggctctttaattgaacccacaataccaagaactcatctagacacctcagctgagttgcggtactcagtgggatccctagtggacagccagtctgattacagaacaactaaagtaataagaagaccaaggagaggccgcatgggtgtgcgaagagatgagccaaaggtgaaatctcttggggatcacgagtggaatagaactcaacagattggagtactaagcagccacccttttgaaagtgacactgaaatgtctgatattgatgatgatgacagagaaacaatttttagctcaatggatcttctctctccaagtggtcattccgatgcccagacgctagccatgatgcttcaggaacaattggatgccatcaacaaagaaatcaggctaattcaggaagaaaaagaatctacagagttgcgtgctgaagaaattgaaaatagagtggctagtgtgagcctcgaaggcctgaatttggcaagggtccacccaggtacctccattactgcctctgttacagcttcatcgctggccagttcatctccccccagtggacactcaactccaaagctcacccctcgaagccctgccagggaaatggatcggatgggagtcatgacactgccaagtgatctgaggaaacatcggagaaagattgcagttgtggaagaagatggtcgagaggacaaagcaacaattaaatgtgaaacttctcctcctcctacccctagagccctcagaatgactcacactctcccttcttcctaccacaatgatgctcgaagtagtttatctgtctctcttgagccagaaagcctcgggcttggtagtgccaacagcagccaagactctcttcacaaagcccccaagaagaaaggaatcaagtcttcaataggacgtttgtttggtaaaaaagaaaaagctcgacttgggcagctccgaggctttatggagactgaagctgcagctcaggagtccctggggttaggcaaactcggaactcaagctgagaaggatcgaagactaaagaaaaagcatgaacttcttgaagaagctcggagaaagggattaccttttgcccagtgggatgggccaactgtggtcgcatggctagagctttggttgggaatgcctgcgtggtacgtggcagcctgccgagccaacgtgaagagtggtgccatcatgtctgctttatctgacactgagatccagagagaaattggaatcagcaatccactgcatcgcttaaaacttcgattagcaatccaggagatggtttccctaacaagtccttcagctcctccaacatctcgaactaaagaatctgaggaaggaagctgggcccagtgtccggtttttctacagaccctggcttatggagatatgaatcatgagtggattggaaatgaatggcttcccagcttggggttacctcagtacagaagttactttatggaatgcttggtagatgcaagaatgttagatcacctaacaaaaaaagatctccgtgtccatttaaaaatggtggatagtttccatcgaacaagtttacaatatggaattatgtgcttaaagaggttgaattatgacagaaaagaactagaaagaagacgggaagcaagccaacatgaaataaaagacgtgttggtgtggagcaatgaccgagttattcgctggatacaagcaattggacttcgagaatatgcaaataatatacttgagagcggtgtgcatggctcacttatagccctggatgaaaactttgactacagcagcttagctttattattacagattccaacacagaacacccaggcaaggcagattcttgaaagagaatacaataacctcttggccctgggaactgaaaggcgactggatgaaagtgatgacaagaacttcagacgtggatcaacctggagaaggcagtttcctcctcgtgaagtacatggaatcagcatgatgcctgggtcctcagaaacattaccagctggatttaggttaaccacaacctctgggcagtcaagaaaaatgacaacagatgttgcttcatcaagactgcagaggttagacaactccactgttcgcacatactcatgttgaccagccactcaaagg

SEQ ID NO: 171805 - DNA, 574 bp, Homo sapiens
  Payload ID: 13763
  Gene Symbol: PPFIA2
  Gene Name: protein tyrosine phosphatase, receptor type, f polypeptide (PTPRF), interacting protein (liprin), alpha 2
  ENST ID: ENST00000547623
  CDS Start-End: 211-574
aagatgctgtagcgtcctcaccggctgccagcaggttggttcttccggccaattgaagcaagcaaagaggcttgcagaaaggccgggaggagaaaaatggggaaatggtccaggagtgctgggtgtgagcctcccttctcctcaagccggagactgcggttgtcattgatcaattgaagaagcaaggacccgaaatcacagacattagcaatgatgtgtgaagtgatgcccacgattaatgaggacaccccaatgagccaaagggggtcccaaagcagtggctcggactcagactcccattttgagcagctgatggtgaatatgctagatgaaagggatcgtcttctagacacccttcgggagacccaggaaagcctctcacttgcccagcaaagacttcaggatgtcatctatgaccgagactcactccagagacagctcaattcagccctgccacaggatatcgaatccctaacaggagggctggctggttctaagggggctgatccaccggaatttgctgcactgacaaaagaattaaatgcctgcagggaacaacttctagaaaaggaag

SEQ ID NO: 171806 - DNA, 917 bp, Homo sapiens
  Payload ID: 13763
  Gene Symbol: PPFIA2
  Gene Name: protein tyrosine phosphatase, receptor type, f polypeptide (PTPRF), interacting protein (liprin), alpha 2
  ENST ID: ENST00000553058
  CDS Start-End: 122-917
attgctcataaataactccaatgttttgctgatgcttggatgtaacaggcctttgtagctgacacatttcaagcaatgctgttcagctgcctgtttgaagaaagtttattttttaaaaactatgtttgcagctgaagagagacatggaaatattgaagaacgtatgagacatttagagggtcaacttgaagagaagaatcaagaacttcaaagagctaggcaaagagagaaaatgaatgaggagcataacaagagattatcggatacggttgatagacttctgactgaatccaatgaacgcctacaactacacttaaaggaaagaatggctgctctagaagaaaagaatgttttaattcaagaatcagaaactttcagaaagaatcttgaagaatctttacatgataaggaaagattagcagaagaaattgaaaagctgagatctgaacttgaccaattgaaaatgagaactggctctttaattgaacccacaataccaagaactcatctagacacctcagctgagttgcggtactcagtgggatccctagtggacagccagtctgattacagaacaactaaagtaataagaagaccaaggagaggccgcatgggtgtgcgaagagatgagccaaaggtgaaatctcttggggatcacgagtggaatagaactcaacagattggagtactaagcagccacccttttgaaagtgacactgaaatgtctgatattgatgatgatgacagagaaacaatttttagctcaatggatcttctctctccaagtggtcattccgatgcccagacgctagccatgatgcttcaggaacaattggatgccatcaacaaagaaatcaggctaattcaggaagaaaaagaatctacagagttgcgtgctgaagaaattgaaaatagag

SEQ ID NO: 171807 - DNA, 4033 bp, Homo sapiens
  Payload ID: 13763
  Gene Symbol: PPFIA2
  Gene Name: protein tyrosine phosphatase, receptor type, f polypeptide (PTPRF), interacting protein (liprin), alpha 2
  Uniprot ID: O75334
  ENST ID: ENST00000548586
  CDS Start-End: 257-4012
tttttccgatggacgcttctccttttggctgctgacggagccacgggaagatgccgagctcctgccacgccaccgggccggggcacgttccgggagggcgccggggcacgcgtgtgtctgagctgcctttctcctcccgttgctagggaaatggtccaggagtgctgggtgtgagcctcccttctcctcaagccggagactgcggttgtcattgatcaattgaagaagcaaggacccgaaatcacagacattagcaatgatgtgtgaagtgatgcccacgattaatgaggacaccccaatgagccaaagggggtcccaaagcagtggctcggactcagactcccattttgagcagctgatggtgaatatgctagatgaaagggatcgtcttctagacacccttcgggagacccaggaaagcctctcacttgcccagcaaagacttcaggatgtcatctatgaccgagactcactccagagacagctcaattcagccctgccacaggatatcgaatccctaacaggagggctggctggttctaagggggctgatccaccggaatttgctgcactgacaaaagaattaaatgcctgcagggaacaacttctagaaaaggaagaagaaatctctgaacttaaagctgaaagaaacaacacaagactattactggagcatttggagtgccttgtgtcacgacatgaaagatcactaagaatgacggtggtaaaacggcaagcccagtctccctcaggagtatccagtgaagttgaagttctcaaggcactgaaatctttgtttgagcaccacaaggccttggatgaaaaggtaagggagcgactgagggtttctttagaaagagtctctgcactggaagaagaactagctgctgctaatcaggagattgttgccttgcgtgaacaaaatgttcatatacaaagaaaaatggcatcaagcgagggatccacagagtcagaacatcttgaagggatggaacctggacagaaagtccatgagaagcgtttgtccaatggttctatagactcaaccgatgaaactagtcaaatagttgaactacaagaattgcttgaaaagcaaaactatgaaatggcccagatgaaagaacgtttagcagccctttcttcccgagtgggagaggtggaacaggaagcagagacagcaagaaaggatctcattaaaacagaagaaatgaacaccaagtatcaaagggacattagggaggccatggcacaaaaggaagatatggaagaaagaattacaacccttgaaaagcgttacctcagtgctcagagagaatctacctccatacatgacatgaatgataaactagaaaatgagttagcaaataaagaagctatcctgcggcagatggaagagaaaaacagacagttacaagaacgtcttgagctagctgaacaaaagttgcagcagaccatgagaaaggctgaaaccttgcctgaagtagaggctgaactggctcagagaattgcagccctaaccaaggctgaagagagacatggaaatattgaagaacgtatgagacatttagagggtcaacttgaagagaagaatcaagaacttcaaagagctaggcaaagagagaaaatgaatgaggagcataacaagagattatcggatacggttgatagacttctgactgaatccaatgaacgcctacaactacacttaaaggaaagaatggctgctctagaagaaaagaatgttttaattcaagaatcagaaactttcagaaagaatcttgaagaatctttacatgataaggaaagattagcagaagaaattgaaaagctgagatctgaacttgaccaattgaaaatgagaactggctctttaattgaacccacaataccaagaactcatctagacacctcagctgagttgcggtactcagtgggatccctagtggacagccagtctgattacagaacaactaaagtaataagaagaccaaggagaggccgcatgggtgtgcgaagagatgagccaaaggtgaaatctcttggggatcacgagtggaatagaactcaacagattggagtactaagcagccacccttttgaaagtgacactgaaatgtctgatattgatgatgatgacagagaaacaatttttagctcaatggatcttctctctccaagtggtcattccgatgcccagacgctagccatgatgcttcaggaacaattggatgccatcaacaaagaaatcaggctaattcaggaagaaaaagaatctacagagttgcgtgctgaagaaattgaaaatagagtggctagtgtgagcctcgaaggcctgaatttggcaagggtccacccaggtacctccattactgcctctgttacagcttcatcgctggccagttcatctccccccagtggacactcaactccaaagctcacccctcgaagccctgccagggaaatggatcggatgggagtcatgacactgccaagtgatctgaggaaacatcggagaaagattgcagttgtggaagaagatggtcgagaggacaaagcaacaattaaatgtgaaacttctcctcctcctacccctagagccctcagaatgactcacactctcccttcttcctaccacaatgatgctcgaagtagtttatctgtctctcttgagccagaaagcctcgggcttggtagtgccaacagcagccaagactctcttcacaaagcccccaagaagaaaggaatcaagtcttcaataggacgtttgtttggtaaaaaagaaaaagctcgacttgggcagctccgaggctttatggagactgaagctgcagctcaggagtccctggggttaggcaaactcggaactcaagctgagaaggatcgaagactaaagaaaaagcatgaacttcttgaagaagctcggagaaagggattaccttttgcccagtgggatgggccaactgtggtcgcatggctagagctttggttgggaatgcctgcgtggtacgtggcagcctgccgagccaacgtgaagagtggtgccatcatgtctgctttatctgacactgagatccagagagaaattggaatcagcaatccactgcatcgcttaaaacttcgattagcaatccaggagatggtttccctaacaagtccttcagctcctccaacatctcgaactccttcaggcaacgtttgggtgactcatgaagaaatggaaaatcttgcagctccagcaaaaacgaaagaatctgaggaaggaagctgggcccagaccctggcttatggagatatgaatcatgagtggattggaaatgaatggcttcccagcttggggttacctcagtacagaagttactttatggaatgcttggtagatgcaagaatgttagatcacctaacaaaaaaagatctccgtgtccatttaaaaatggtggatagtttccatcgaacaagtttacaatatggaattatgtgcttaaagaggttgaattatgacagaaaagaactagaaagaagacgggaagcaagccaacatgaaataaaagacgtgttggtgtggagcaatgaccgagttattcgctggatacaagcaattggacttcgagaatatgcaaataatatacttgagagcggtgtgcatggctcacttatagccctggatgaaaactttgactacagcagcttagctttattattacagattccaacacagaacacccaggcaaggcagattcttgaaagagaatacaataacctcttggccctgggaactgaaaggcgactggatgaaagtgatgacaagaacttcagacgtggatcaacctggagaaggcagtttcctcctcgtgaagtacatggaatcagcatgatgcctgggtcctcagaaacattaccagctggatttaggttaaccacaacctctgggcagtcaagaaaaatgacaacagatgttgcttcatcaagactgcagaggttagacaactccactgttcgcacatactcatgttgaccagccactcaaaggaggcag

SEQ ID NO: 171808 - DNA, 825 bp, Homo sapiens
  Payload ID: 13763
  Gene Symbol: PPFIA2
  Gene Name: protein tyrosine phosphatase, receptor type, f polypeptide (PTPRF), interacting protein (liprin), alpha 2
  ENST ID: ENST00000551442
  CDS Start-End: 385-825
ctcggcagcccgggagcggctctgggggagacgagtgtatccgcgggcgcgtgtgcgtgaggaggagagcaaagacgtgattacttcagaatttatttaagggccggtggaaaccactgcagcagcttccaggggaagcccttgttccagaggaagaggaggtggtggctgccaaggaggaggaggggaggagacggaggaggaggagtagcagccaccgcacgaggcaagtgaggagagaagatgctgtagcgtcctcaccggctgccagcagggaaatggtccaggagtgctgggtgtgagcctcccttctcctcaagccggagactgcggttgtcattgatcaattgaagaagcaaggacccgaaatcacagacattagcaatgatgtgtgaagtgatgcccacgattaatgaggacaccccaatgagccaaagggggtcccaaagcagtggctcggactcagactcccattttgagcagctgatggtgaatatgctagatgaaagggatcgtcttctagacacccttcgggagacccaggaaagcctctcacttgcccagcaaagacttcaggatgtcatctatgaccgagactcactccagagacagctcaattcagccctgccacaggaatttgctgcactgacaaaagaattaaatgcctgcagggaacaacttctagaaaaggaagaagaaatctctgaacttaaagctgaaagaaacaacacaagactattactggagcatttggagtgccttgtgtcacgacatgaaagatcactaagaatgacggtggtaaaacggcaagcccagtctccctca

SEQ ID NO: 171809 - DNA, 564 bp, Homo sapiens
  Payload ID: 13763
  Gene Symbol: PPFIA2
  Gene Name: protein tyrosine phosphatase, receptor type, f polypeptide (PTPRF), interacting protein (liprin), alpha 2
  ENST ID: ENST00000551147
  CDS Start-End: 1-564
tggtaaaaaagaaaaagctcgacttgggcagctccgaggctttatggagactgaagctgcagctcaggagtccctggggttaggcaaactcggaactcaagctgagaaggatcgaagactaaagaaaaacacatctgggcatgaacttcttgaagaagctcggagaaagggattaccttttgcccagtgggatgggccaactgtggtcgcatggctagagctttggttgggaatgcctgcgtggtacgtggcagcctgccgagccaacgtgaagagtggtgccatcatgtctgctttatctgacactgagatccagagagaaattggaatcagcaatccactgcatcgcttaaaacttcgattagcaatccaggagatggtttccctaacaagtccttcagctcctccaacatctcgaactaaagaatctgaggaaggaagctgggcccagtgtccggtttttctacagaccctggcttatggagatatgaatcatgagtggattggaaatgaatggcttcccagcttggggttacctcagtacagaagttactttatggaatg

SEQ ID NO: 171810 - DNA, 5405 bp, Homo sapiens
  Payload ID: 13763
  Gene Symbol: PPFIA2
  Gene Name: protein tyrosine phosphatase, receptor type, f polypeptide (PTPRF), interacting protein (liprin), alpha 2
  ENST ID: ENST00000550584
  CDS Start-End: 297-4040
accgagctttgcttcccaaagcaaaatttgtaatatgccatttttccgatggacgcttctccttttggctgctgacggagccacgggaagatgccgagctcctgccacgccaccgggccggggcacgttccgggagggcgccggggcacgcgtgtgtctgagctgcctttctcctcccgttgctagggaaatggtccaggagtgctgggtgtgagcctcccttctcctcaagccggagactgcggttgtcattgatcaattgaagaagcaaggacccgaaatcacagacattagcaatgatgtgtgaagtgatgcccacgattaatgaggacaccccaatgagccaaagggggtcccaaagcagtggctcggactcagactcccattttgagcagctgatggtgaatatgctagatgaaagggatcgtcttctagacacccttcgggagacccaggaaagcctctcacttgcccagcaaagacttcaggatgtcatctatgaccgagactcactccagagacagctcaattcagccctgccacaggatatcgaatccctaacaggagggctggctggttctaagggggctgatccaccggaatttgctgcactgacaaaagaattaaatgcctgcagggaacaacttctagaaaaggaagaagaaatctctgaacttaaagctgaaagaaacaacacaagactattactggagcatttggagtgccttgtgtcacgacatgaaagatcactaagaatgacggtggtaaaacggcaagcccagtctccctcaggagtatccagtgaagttgaagttctcaaggcactgaaatctttgtttgagcaccacaaggccttggatgaaaaggtaagggagcgactgagggtttctttagaaagagtctctgcactggaagaagaactagctgctgctaatcaggagattgttgccttgcgtgaacaaaatgttcatatacaaagaaaaatggcatcaagcgagggatccacagagtcagaacatcttgaagggatggaacctggacagaaagtccatgagaagcgtttgtccaatggttctatagactcaaccgatgaaactagtcaaatagttgaactacaagaattgcttgaaaagcaaaactatgaaatggcccagatgaaagaacgtttagcagccctttcttcccgagtgggagaggtggaacaggaagcagagacagcaagaaaggatctcattaaaacagaagaaatgaacaccaagtatcaaagggacattagggaggccatggcacaaaaggaagatatggaagaaagaattacaacccttgaaaagcgttacctcagtgctcagagagaatctacctccatacatgacatgaatgataaactagaaaatgagttagcaaataaagaagctatcctgcggcagatggaagagaaaaacagacagttacaagaacgtcttgagctagctgaacaaaagttgcagcagaccatgagaaaggctgaaaccttgcctgaagtagaggctgaactggctcagagaattgcagccctaaccaaggctgaagagagacatggaaatattgaagaacgtatgagacatttagagggtcaacttgaagagaagaatcaagaacttcaaagagctaggcaaagagagaaaatgaatgaggagcataacaagagattatcggatacggttgatagacttctgactgaatccaatgaacgcctacaactacacttaaaggaaagaatggctgctctagaagaaaagaatgttttaattcaagaatcagaaactttcagaaagaatcttgaagaatctttacatgataaggaaagattagcagaagaaattgaaaagctgagatctgaacttgaccaattgaaaatgagaactggctctttaattgaacccacaataccaagaactcatctagacacctcagctgagttgcggtactcagtgggatccctagtggacagccagtctgattacagaacaactaaagtaataagaagaccaaggagaggccgcatgggtgtgcgaagagatgagccaaaggtgaaatctcttggggatcacgagtggaatagaactcaacagattggagtactaagcagccacccttttgaaagtgacactgaaatgtctgatattgatgatgatgacagagaaacaatttttagctcaatggatcttctctctccaagtggtcattccgatgcccagacgctagccatgatgcttcaggaacaattggatgccatcaacaaagaaatcaggctaattcaggaagaaaaagaatctacagagttgcgtgctgaagaaattgaaaatagagtggctagtgtgagcctcgaaggcctgaatttggcaagggtccacccaggtacctccattactgcctctgttacagcttcatcgctggccagttcatctccccccagtggacactcaactccaaagctcacccctcgaagccctgccagggaaatggatcggatgggagtcatgacactgccaagtgatctgaggaaacatcggagaaagattgcagttgtggaagaagatggtcgagaggacaaagcaacaattaaatgtgaaacttctcctcctcctacccctagagccctcagaatgactcacactctcccttcttcctaccacaatgatgctcgaagtagtttatctgtctctcttgagccagaaagcctcgggcttggtagtgccaacagcagccaagactctcttcacaaagcccccaagaagaaaggaatcaagtcttcaataggacgtttgtttggtaaaaaagaaaaagctcgacttgggcagctccgaggctttatggagactgaagctgcagctcaggagtccctggggttaggcaaactcggaactcaagctgagaaggatcgaagactaaagaaaaagcatgaacttcttgaagaagctcggagaaagggattaccttttgcccagtgggatgggccaactgtggtcgcatggctagagctttggttgggaatgcctgcgtggtacgtggcagcctgccgagccaacgtgaagagtggtgccatcatgtctgctttatctgacactgagatccagagagaaattggaatcagcaatccactgcatcgcttaaaacttcgattagcaatccaggagatggtttccctaacaagtccttcagctcctccaacatctcgaactccttcaggcaacgtttgggtgactcatgaagaaatggaaaatcttgcagctccagcaaaaacgaaagaatctgaggaaggaagctgggcccagtgtccggtttttctacagaccctggcttatggagatatgaatcatgagtggattggaaatgaatggcttcccagcttggggttacctcagtacagaagttactttatggaatgcttggtagatgcaagaatgttagatcacctaacaaaaaaagatctccgtgtccatttaaaaatggtggatagtttccatcgaacaagtttacaatatggaattatgtgcttaaagaggttgaattatgacagaaaagaactagaaagaagacgggaagcaagccaacatgaaataaaagacgtgttggtgtggagcaatgaccgagttattcgctggatacaagcaattggacttcgagaatatgcaaataatatacttgagagcggtgtgcatggctcacttatagccctggatgaaaactttgactacagcagcttagctttattattacagattccaacacagaacacccaggcaaggcagattcttgaaagagaatacaataacctcttggccctgggaactgaaaggcgactggatgaaagtgatgacaagaacttcagacgtggatcaacctggagaaggcagtttcctcctcgtgaagtacatggaatcagcatgatgcctgggtcctcagaaacattaccagctggatttaggttaaccacaacctctgggcagtcaagaaaaatgacaacagatgatggcgtcttttcagtctactctacctaaagtgcactaccatctaagaagacgagcagtgaaaacctttgtgaaaactgaattctaaggaaataatgacgtcatgacttattaaaagctgaaaaatgtgatttttggggggagtcagatattacatttgattagtttactacaaattgtaataaaatgcttaagtcatttgaataataaacatcatctacatcataaactctgtacaacagatgcttttatgaaatgaagccagttgtttttcatgttttattgtaatatactaggcatttatgtattaccgtgcatttctttttaaatgtgtaagtcttatgtaaatggatataaatatgattttttaaaaaataaaatatatggttcatggagtctcgagtgcaaacatttgacaattccaagtactgtttgtattttaccattccaccatttttacagtttttggattgttaatagtcaaatcaatatgtttccttgaagcatgtttcatgcttcaacgtgtttctccttcaagtctgtcaatacttaaagctgaacaacctgcctctgatcatgtaaaaaagaatgatttaacctggaaccggagccaaaaatagagctttaaaggcaatcagggatgtcctatatctttagaaatagcactgtgatggcttgatctccttttcaatacaaaacaaagccaagctgtttacaagggtcaaaagcaattatttaaaaatttatattaaaaaaccataatcttctcttgttacctgtggaccaagaaaaaaaaaaagataaaaaaacttctttactaagaaccacatgttcattcaaatatcttgaaatgccagccagtactggacagtgaatgtcaaccaccgcagagtctgaggctcatttccactagagaaaacgaaacccaagatacctttcccttttgtcaatgtaacagggcattagccagactcatgtctaatgttataagcttttagccgagatggccttgttgcgacttccctgaagtcagttttatcagaggaaataaatgaaagacagaatgattaacatatatagtgtataaaagtatagaagagtaatctcttccctgtggctttatttggtggtgttactgttgtttattctttgtttatatgggagattcaaagtaaagcctatttaataataccatttatctaactgctgattttctgctgcttgatcttattaagcgcaagacctgtcattagtaatttcttttctgtattttaatttgctatgtttgcacgtacattacatttgttttgatgtctatttttatttaacagattcagtcaaaaggtaatgataacagaaaccctttccattgtcaataaaaaaaataataattcc

SEQ ID NO: 171811 - DNA, 2834 bp, Homo sapiens
  Payload ID: 13763
  Gene Symbol: PPFIA2
  Gene Name: protein tyrosine phosphatase, receptor type, f polypeptide (PTPRF), interacting protein (liprin), alpha 2
  ENST ID: ENST00000551461
  CDS Start-End: 94-339
aatgctgttcagctgcctgtttgaagaaagtttattttttaaaaactatgtttgcagttggctgaagagagacatggaaatattgaagaacgtatgagacatttagagggtcaacttgaagagaagaatcaagaacttcaaagagctaggcaaagagagaaaatgaatgaggagcataacaagagattatcggatacggttgatagacttctgactgaatccaatgaacgcctacaactacacttaaaggaaagaatggctgctctagaagaaaagttggcagctaccagaccagcaagagttatgagagctggttaccaattccagagcataaattaagaatgttttaattcaagaatcagaaactttcagaaagaatcttgaagaatctttacatgataaggaaagattagcagaagaaattgaaaagctgagatctgaacttgaccaattgaaaatgagaactggctctttaattgaacccacaataccaagaactcatctagacacctcagctgagttgcggtactcagtgggatccctagtggacagccagtctgattacagaacaactaaagtaataagaagaccaaggagaggccgcatgggtgtgcgaagagatgagccaaaggtgaaatctcttggggatcacgagtggaatagaactcaacagattggagtactaagcagccacccttttgaaagtgacactgaaatgtctgatattgatgatgatgacagagaaacaatttttagctcaatggatcttctctctccaagtggtcattccgatgcccagacgctagccatgatgcttcaggaacaattggatgccatcaacaaagaaatcaggctaattcaggaagaaaaagaatctacagagttgcgtgctgaagaaattgaaaatagagtggctagtgtgagcctcgaaggcctgaatttggcaagggtccacccagccaagtgatctgaggaaacatcggagaaagattgcagttgtggaagaagatggtcgagaggacaaagcaacaattaaatgtgaaacttctcctcctcctacccctagagccctcagaatgactcacactctcccttcttcctaccacaatgatgctcgaagtagtttatctgtctctcttgagccagaaagcctcgggcttggtagtgccaacagcagccaagactctcttcacaaagcccccaagaagaaaggaatcaagtcttcaataggacgtttgtttggtaaaaaagaaaaagctcgacttgggcagctccgaggctttatggagactgaagctgcagctcaggagtccctggggttaggcaaactcggaactcaagctgagaaggatcgaagactaaagaaaaagcatgaacttcttgaagaagctcggagaaagggattaccttttgcccagtgggatgggccaactgtggtcgcatggctagagctttggttgggaatgcctgcgtggtacgtggcagcctgccgagccaacgtgaagagtggtgccatcatgtctgctttatctgacactgagatccagagagaaattggaatcagcaatccactgcatcgcttaaaacttcgattagcaatccaggagatggtttccctaacaagtccttcagctcctccaacatctcgaacttgtccggtttttctacagaccctggcttatggagatatgaatcatgagtggattggaaatgaatggcttcccagcttggggttacctcagtacagaagttactttatggaatgcttggtagatgcaagaatgttagatcacctaacaaaaaaagatctccgtgtccatttaaaaatggtggatagtttccatcgaacaagtttacaatatggaattatgtgcttaaagaggttgaattatgacagaaaagaactagaaagaagacgggaagcaagccaacatgaaataaaagacgtgttggtgtggagcaatgaccgagttattcgctggatacaagcaattggacttcgagaatatgcaaataatatacttgagagcggtgtgcatggctcacttatagccctggatgaaaactttgactacagcagcttagctttattattacagattccaacacagaacacccaggcaaggcagattcttgaaagagaatacaataacctcttggccctgggaactgaaaggcgactggatgaaagtgatgacaagaacttcagacgtggatcaacctggagaaggcagtttcctcctcgtgaagtacatggaatcagcatgatgcctgggtcctcagaaacattaccagctggatttaggttaaccacaacctctgggcagtcaagaaaaatgacaacagatgttgcttcatcaagactgcagaggttagacaactccactgttcgcacatactcatgttgaccagccactcaaaggaggcagcactgacctgctatggcgtcttttcagtctactctacctaaagtgcactaccatctaagaagacgagcagtgaaaacctttgtgaaaactgaattctaaggaaataatgacgtcatgacttattaaaagctgaaaaatgtgatttttggggggagtcagatattacatttgattagtttactacaaattgtaataaaatgcttaagtcatttgaataataaacatcatctacatcataaactctgtacaacagatgcttttatgaaatgaagccagttgtttttcatgttttattgtaatatactaggcatttatgtattaccgtgcatttctttttaaatgtgtaagtcttatgtaaatggatataaatatgattttttaaaaaataaaatatatggttcatgg

SEQ ID NO: 171812 - DNA, 4727 bp, Homo sapiens
  Payload ID: 13763
  Gene Symbol: PPFIA2
  Gene Name: protein tyrosine phosphatase, receptor type, f polypeptide (PTPRF), interacting protein (liprin), alpha 2
  Uniprot ID: O75334
  ENST ID: ENST00000549325
  CDS Start-End: 274-3972
aaatttgtaatatgccatttttccgatggacgcttctccttttggctgctgacggagccacgggaagatgccgagctcctgccacgccaccgggccggggcacgttccgggagggcgccggggcacgcgtgtgtctgagctgcctttctcctcccgttgctagggaaatggtccaggagtgctgggtgtgagcctcccttctcctcaagccggagactgcggttgtcattgatcaattgaagaagcaaggacccgaaatcacagacattagcaatgatgtgtgaagtgatgcccacgattaatgaggacaccccaatgagccaaagggggtcccaaagcagtggctcggactcagactcccattttgagcagctgatggtgaatatgctagatgaaagggatcgtcttctagacacccttcgggagacccaggaaagcctctcacttgcccagcaaagacttcaggatgtcatctatgaccgagactcactccagagacagctcaattcagccctgccacaggaatttgctgcactgacaaaagaattaaatgcctgcagggaacaacttctagaaaaggaagaagaaatctctgaacttaaagctgaaagaaacaacacaagactattactggagcatttggagtgccttgtgtcacgacatgaaagatcactaagaatgacggtggtaaaacggcaagcccagtctccctcaggagtatccagtgaagttgaagttctcaaggcactgaaatctttgtttgagcaccacaaggccttggatgaaaaggtaagggagcgactgagggtttctttagaaagagtctctgcactggaagaagaactagctgctgctaatcaggagattgttgccttgcgtgaacaaaatgttcatatacaaagaaaaatggcatcaagcgagggatccacagagtcagaacatcttgaagggatggaacctggacagaaagtccatgagaagcgtttgtccaatggttctatagactcaaccgatgaaactagtcaaatagttgaactacaagaattgcttgaaaagcaaaactatgaaatggcccagatgaaagaacgtttagcagccctttcttcccgagtgggagaggtggaacaggaagcagagacagcaagaaaggatctcattaaaacagaagaaatgaacaccaagtatcaaagggacattagggaggccatggcacaaaaggaagatatggaagaaagaattacaacccttgaaaagcgttacctcagtgctcagagagaatctacctccatacatgacatgaatgataaactagaaaatgagttagcaaataaagaagctatcctgcggcagatggaagagaaaaacagacagttacaagaacgtcttgagctagctgaacaaaagttgcagcagaccatgagaaaggctgaaaccttgcctgaagtagaggctgaactggctcagagaattgcagccctaaccaaggctgaagagagacatggaaatattgaagaacgtatgagacatttagagggtcaacttgaagagaagaatcaagaacttcaaagagctaggcaaagagagaaaatgaatgaggagcataacaagagattatcggatacggttgatagacttctgactgaatccaatgaacgcctacaactacacttaaaggaaagaatggctgctctagaagaaaagaatgttttaattcaagaatcagaaactttcagaaagaatcttgaagaatctttacatgataaggaaagattagcagaagaaattgaaaagctgagatctgaacttgaccaattgaaaatgagaactggctctttaattgaacccacaataccaagaactcatctagacacctcagctgagttgcggtactcagtgggatccctagtggacagccagtctgattacagaacaactaaagtaataagaagaccaaggagaggccgcatgggtgtgcgaagagatgagccaaaggtgaaatctcttggggatcacgagtggaatagaactcaacagattggagtactaagcagccacccttttgaaagtgacactgaaatgtctgatattgatgatgatgacagagaaacaatttttagctcaatggatcttctctctccaagtggtcattccgatgcccagacgctagccatgatgcttcaggaacaattggatgccatcaacaaagaaatcaggctaattcaggaagaaaaagaatctacagagttgcgtgctgaagaaattgaaaatagagtggctagtgtgagcctcgaaggcctgaatttggcaagggtccacccaggtacctccattactgcctctgttacagcttcatcgctggccagttcatctccccccagtggacactcaactccaaagctcacccctcgaagccctgccagggaaatggatcggatgggagtcatgacactgccaagtgatctgaggaaacatcggagaaagattgcagttgtggaagaagatggtcgagaggacaaagcaacaattaaatgtgaaacttctcctcctcctacccctagagccctcagaatgactcacactctcccttcttcctaccacaatgatgctcgaagtagtttatctgtctctcttgagccagaaagcctcgggcttggtagtgccaacagcagccaagactctcttcacaaagcccccaagaagaaaggaatcaagtcttcaataggacgtttgtttggtaaaaaagaaaaagctcgacttgggcagctccgaggctttatggagactgaagctgcagctcaggagtccctggggttaggcaaactcggaactcaagctgagaaggatcgaagactaaagaaaaacacatctgggcatgaacttcttgaagaagctcggagaaagggattaccttttgcccagtgggatgggccaactgtggtcgcatggctagagctttggttgggaatgcctgcgtggtacgtggcagcctgccgagccaacgtgaagagtggtgccatcatgtctgctttatctgacactgagatccagagagaaattggaatcagcaatccactgcatcgcttaaaacttcgattagcaatccaggagatggtttccctaacaagtccttcagctcctccaacatctcgaactccttcaggcaacgtttgggtgactcatgaagaaatggaaaatcttgcagctccagcaaaaacgaaagaatctgaggaaggaagctgggcccagtgtccggtttttctacagaccctggcttatggagatatgaatcatgagtggattggaaatgaatggcttcccagcttggggttacctcagtacagaagttactttatggaatgcttggtagatgcaagaatgttagatcacctaacaaaaaaagatctccgtgtccatttaaaaatggtggatagtttccatcgaacaagtttacaatatggaattatgtgcttaaagaggttgaattatgacagaaaagaactagaaagaagacgggaagcaagccaacatgaaataaaagacgtgttggtgtggagcaatgaccgagttattcgctggatacaagcaattggacttcgagaatatgcaaataatatacttgagagcggtgtgcatggctcacttatagccctggatgaaaactttgactacagcagcttagctttattattacagattccaacacagaacacccaggcaaggcagattcttgaaagagaatacaataacctcttggccctgggaactgaaaggcgactggatgaaagtgatgacaagaacttcagacgtggatcaacctggagaaggcagtttcctcctcgtgaagtacatggaatcagcatgatgcctgggtcctcagaaacattaccagctggatttaggttaaccacaacctctgggcagtcaagaaaaatgacaacagatgatggcgtcttttcagtctactctacctaaagtgcactaccatctaagaagacgagcagtgaaaacctttgtgaaaactgaattctaaggaaataatgacgtcatgacttattaaaagctgaaaaatgtgatttttggggggagtcagatattacatttgattagtttactacaaattgtaataaaatgcttaagtcatttgaataataaacatcatctacatcataaactctgtacaacagatgcttttatgaaatgaagccagttgtttttcatgttttattgtaatatactaggcatttatgtattaccgtgcatttctttttaaatgtgtaagtcttatgtaaatggatataaatatgattttttaaaaaataaaatatatggttcatggagtctcgagtgcaaacatttgacaattccaagtactgtttgtattttaccattccaccatttttacagtttttggattgttaatagtcaaatcaatatgtttccttgaagcatgtttcatgcttcaacgtgtttctccttcaagtctgtcaatacttaaagctgaacaacctgcctctgatcatgtaaaaaagaatgatttaacctggaaccggagccaaaaatagagctttaaaggcaatcagggatgtcctatatctttagaaatagcactgtgatggcttgatctccttttcaatacaaaacaaagccaagctgtttacaagggtcaaaagcaattatttaaaaatttatattaaaaaaccataatcttctcttgttacctgtggacc

SEQ ID NO: 171813 - DNA, 5363 bp, Homo sapiens
  Payload ID: 13763
  Gene Symbol: PPFIA2
  Gene Name: protein tyrosine phosphatase, receptor type, f polypeptide (PTPRF), interacting protein (liprin), alpha 2
  Uniprot ID: O75334
  ENST ID: ENST00000549396
  CDS Start-End: 162-3935
gaggcaagtgaggagagaagatgctgtagcgtcctcaccggctgccagcagggaaatggtccaggagtgctgggtgtgagcctcccttctcctcaagccggagactgcggttgtcattgatcaattgaagaagcaaggacccgaaatcacagacattagcaatgatgtgtgaagtgatgcccacgattaatgaggacaccccaatgagccaaagggggtcccaaagcagtggctcggactcagactcccattttgagcagctgatggtgaatatgctagatgaaagggatcgtcttctagacacccttcgggagacccaggaaagcctctcacttgcccagcaaagacttcaggatgtcatctatgaccgagactcactccagagacagctcaattcagccctgccacaggatatcgaatccctaacaggagggctggctggttctaagggggctgatccaccggaatttgctgcactgacaaaagaattaaatgcctgcagggaacaacttctagaaaaggaagaagaaatctctgaacttaaagctgaaagaaacaacacaagactattactggagcatttggagtgccttgtgtcacgacatgaaagatcactaagaatgacggtggtaaaacggcaagcccagtctccctcaggagtatccagtgaagttgaagttctcaaggcactgaaatctttgtttgagcaccacaaggccttggatgaaaaggtaagggagcgactgagggtttctttagaaagagtctctgcactggaagaagaactagctgctgctaatcaggagattgttgccttgcgtgaacaaaatgttcatatacaaagaaaaatggcatcaagcgagggatccacagagtcagaacatcttgaagggatggaacctggacagaaagtccatgagaagcgtttgtccaatggttctatagactcaaccgatgaaactagtcaaatagttgaactacaagaattgcttgaaaagcaaaactatgaaatggcccagatgaaagaacgtttagcagccctttcttcccgagtgggagaggtggaacaggaagcagagacagcaagaaaggatctcattaaaacagaagaaatgaacaccaagtatcaaagggacattagggaggccatggcacaaaaggaagatatggaagaaagaattacaacccttgaaaagcgttacctcagtgctcagagagaatctacctccatacatgacatgaatgataaactagaaaatgagttagcaaataaagaagctatcctgcggcagatggaagagaaaaacagacagttacaagaacgtcttgagctagctgaacaaaagttgcagcagaccatgagaaaggctgaaaccttgcctgaagtagaggctgaactggctcagagaattgcagccctaaccaaggctgaagagagacatggaaatattgaagaacgtatgagacatttagagggtcaacttgaagagaagaatcaagaacttcaaagagctaggcaaagagagaaaatgaatgaggagcataacaagagattatcggatacggttgatagacttctgactgaatccaatgaacgcctacaactacacttaaaggaaagaatggctgctctagaagaaaagaatgttttaattcaagaatcagaaactttcagaaagaatcttgaagaatctttacatgataaggaaagattagcagaagaaattgaaaagctgagatctgaacttgaccaattgaaaatgagaactggctctttaattgaacccacaataccaagaactcatctagacacctcagctgagttgcggtactcagtgggatccctagtggacagccagtctgattacagaacaactaaagtaataagaagaccaaggagaggccgcatgggtgtgcgaagagatgagccaaaggtgaaatctcttggggatcacgagtggaatagaactcaacagattggagtactaagcagccacccttttgaaagtgacactgaaatgtctgatattgatgatgatgacagagaaacaatttttagctcaatggatcttctctctccaagtggtcattccgatgcccagacgctagccatgatgcttcaggaacaattggatgccatcaacaaagaaatcaggctaattcaggaagaaaaagaatctacagagttgcgtgctgaagaaattgaaaatagagtggctagtgtgagcctcgaaggcctgaatttggcaagggtccacccaggtacctccattactgcctctgttacagcttcatcgctggccagttcatctccccccagtggacactcaactccaaagctcacccctcgaagccctgccagggaaatggatcggatgggagtcatgacactgccaagtgatctgaggaaacatcggagaaagattgcagttgtggaagaagatggtcgagaggacaaagcaacaattaaatgtgaaacttctcctcctcctacccctagagccctcagaatgactcacactctcccttcttcctaccacaatgatgctcgaagtagtttatctgtctctcttgagccagaaagcctcgggcttggtagtgccaacagcagccaagactctcttcacaaagcccccaagaagaaaggaatcaagtcttcaataggacgtttgtttggtaaaaaagaaaaagctcgacttgggcagctccgaggctttatggagactgaagctgcagctcaggagtccctggggttaggcaaactcggaactcaagctgagaaggatcgaagactaaagaaaaagcatgaacttcttgaagaagctcggagaaagggattaccttttgcccagtgggatgggccaactgtggtcgcatggctagagctttggttgggaatgcctgcgtggtacgtggcagcctgccgagccaacgtgaagagtggtgccatcatgtctgctttatctgacactgagatccagagagaaattggaatcagcaatccactgcatcgcttaaaacttcgattagcaatccaggagatggtttccctaacaagtccttcagctcctccaacatctcgaactccttcaggcaacgtttgggtgactcatgaagaaatggaaaatcttgcagctccagcaaaaacgaaagaatctgaggaaggaagctgggcccagtgtccggtttttctacagaccctggcttatggagatatgaatcatgagtggattggaaatgaatggcttcccagcttggggttacctcagtacagaagttactttatggaatgcttggtagatgcaagaatgttagatcacctaacaaaaaaagatctccgtgtccatttaaaaatggtggatagtttccatcgaacaagtttacaatatggaattatgtgcttaaagaggttgaattatgacagaaaagaactagaaagaagacgggaagcaagccaacatgaaataaaagacgtgttggtgtggagcaatgaccgagttattcgctggatacaagcaattggacttcgagaatatgcaaataatatacttgagagcggtgtgcatggctcacttatagccctggatgaaaactttgactacagcagcttagctttattattacagattccaacacagaacacccaggcaaggcagattcttgaaagagaatacaataacctcttggccctgggaactgaaaggcgactggatgaaagtgatgacaagaacttcagacgtggatcaacctggagaaggcagtttcctcctcgtgaagtacatggaatcagcatgatgcctgggtcctcagaaacattaccagctggatttaggttaaccacaacctctgggcagtcaagaaaaatgacaacagatgttgcttcatcaagactgcagaggttagacaactccactgttcgcacatactcatgttgaccagccactcaaaggaggcagcactgacctgctatggcgtcttttcagtctactctacctaaagtgcactaccatctaagaagacgagcagtgaaaacctttgtgaaaactgaattctaaggaaataatgacgtcatgacttattaaaagctgaaaaatgtgatttttggggggagtcagatattacatttgattagtttactacaaattgtaataaaatgcttaagtcatttgaataataaacatcatctacatcataaactctgtacaacagatgcttttatgaaatgaagccagttgtttttcatgttttattgtaatatactaggcatttatgtattaccgtgcatttctttttaaatgtgtaagtcttatgtaaatggatataaatatgattttttaaaaaataaaatatatggttcatggagtctcgagtgcaaacatttgacaattccaagtactgtttgtattttaccattccaccatttttacagtttttggattgttaatagtcaaatcaatatgtttccttgaagcatgtttcatgcttcaacgtgtttctccttcaagtctgtcaatacttaaagctgaacaacctgcctctgatcatgtaaaaaagaatgatttaacctggaaccggagccaaaaatagagctttaaaggcaatcagggatgtcctatatctttagaaatagcactgtgatggcttgatctccttttcaatacaaaacaaagccaagctgtttacaagggtcaaaagcaattatttaaaaatttatattaaaaaaccataatcttctcttgttacctgtggaccaagaaaaaaaaaaagataaaaaaacttctttactaagaaccacatgttcattcaaatatcttgaaatgccagccagtactggacagtgaatgtcaaccaccgcagagtctgaggctcatttccactagagaaaacgaaacccaagatacctttcccttttgtcaatgtaacagggcattagccagactcatgtctaatgttataagcttttagccgagatggccttgttgcgacttccctgaagtcagttttatcagaggaaataaatgaaagacagaatgattaacatatatagtgtataaaagtatagaagagtaatctcttccctgtggctttatttggtggtgttactgttgtttattctttgtttatatgggagattcaaagtaaagcctatttaataataccatttatctaactgctgattttctgctgcttgatcttattaagcgcaagacctgtcattagtaatttcttttctgtattttaatttgctatgtttgcacgtacattacatttgttttgatgtctatttttatttaacagattcagtcaaaaggtaatgataacagaaaccctttccattgtcaataaaaaaaataataattcca

SEQ ID NO: 171814 - DNA, 4733 bp, Homo sapiens
  Payload ID: 13764
  Gene Symbol: PPFIA3
  Gene Name: protein tyrosine phosphatase, receptor type, f polypeptide (PTPRF), interacting protein (liprin), alpha 3
  Uniprot ID: O75145
  ENST ID: ENST00000334186
  CDS Start-End: 350-3934
atttttttggggggaaggtgggatttggggggcgctggtgggcacccctggatctggcggctgcggcctcgcggggggaggctgatcggtgacaggggcagggggctattttgggggtagaaggcagtgagagcgtgagggggaggggggtccccagcgcccaagccggagccagagacgcggagcccgcgcgagcgtcggagacagggctccagggctccgaagcgacagagccgggccccggccgctgccaggggccccgcccggcccccccactccaccccacgtccctcctgcagcccagctccgcccgcagccgccgcggaccaggcaggcccgcaccgccgccatgatgtgcgaggtgatgcccaccatcagcgaggatggccggcggggctcggcgctgggcccggacgaggcgggcggggagctggagcgcctcatggtcacgatgctcacggagcgcgagcgcctgctggagacgctgcgcgaggcacaggacgggttggctacagcgcagctgcggctgcgcgagctcggccacgagaaggactcgctgcagcgccagctcagcatcgcgctgccccaggagtttgcagctctgacgaaggagctgaacttatgtcgggagcagctgctggagagggaggaagagattgcagagctgaaggcggaacggaacaacacgcggctgctcctggaacacctggagtgcctggtgtccaggcacgagaggtcactgcgcatgaccgtggtgaagcgccaggcccagtccccgggtggggtctcctcggaggtagaagtgctcaaagctctaaagtctctcttcgagcaccacaaggccctggatgagaaggtccgggagcggctgcggatggcgctggagcgcgtggcagtgctcgaggaggagctggaactgagcaatcaggagactctgaaccttcgagaacagctgtctaggcggcggtcagggctggaagagccgggcaaggatggggatgggcagactcttgccaatggcctgggtcctggcggggattccaaccggcgcacagcagagctggaggaggccctggagcggcagcgcgccgaggtgtgccagctgcgggagcgcctggcggtgctgtgccgtcagatgagccagctggaggaggagttgggcaccgcgcaccgtgagctgggcaaggcagaggaagccaactccaagctgcagcgcgacctcaaggaggcgctggcgcagcgggaagatatggaggagcggattacaacactggagaagcgctacctgagcgcccagcgggaggccacgtctctgcacgacgccaacgacaaactggagaacgagttagctagcaaggagtcgttgtatcggcagagtgaagagaagagccgtcagctggccgagtggttggacgacgccaagcagaagctgcagcagacgctgcagaaagcggagaccttgcccgagatagaggcgcagctggcgcagcgcgtggcggcgctcaacaaggccgaggaacgtcatgggaattttgaggagcggcttcggcagctggaggcccagctggaagagaagaatcaagagctgcagcgggcccggcagcgggagaagatgaacgatgaccacaataagcggctgtccgagacggtggacaagctgctgagcgagtccaacgagcgcttacagcttcacctcaaggagcgcatgggggcgctggaggagaagaactccctgagcgaggagatagccaacatgaagaagcttcaggatgagttgctgctaaacaaggagcagctcttggccgaaatggagcggatgcagatggagatcgaccagctgcgggggaggccaccatcctcctactccaggtctctccctggcagtgccctggagctccgttactctcaggcacccactttaccttctggtgcccacctggatccctatgtggctggcagtggtcgggcaggcaagaggggccgctggtcaggggtcaaggaggagccctccaaggattgggagcggtctgcccctgcgggctccataccacccccattccctggggaactggacggctccgatgaggaggaggcagaggggatgtttggggccgagctgctgtcccccagtgggcaggctgacgtgcagacgctggccatcatgcttcaggagcagctggaggccatcaacaaggagatcaagctgatccaagaggagaaggagacaacagaacagagggcagaggagctggagagtcgggtgtccagctctggcttggactcgttgggccgctaccgcagcagctgctccctgcccccctccctcaccacctctacccttgccagcccctcccctcccagctctggccactcaacaccccgcctggcaccccctagccctgcccgtgagggcaccgacaaggctaatcatgtccctaaggaggaagctggagctccacgaggggaggggccggccatcccaggagacaccccaccacccactccccgctctgcccgtcttgagagaatgacccaggccttggcactgcaggcggggtccctggaagatgggggacccccacggggaagtgagggcaccccagattctctgcacaaagcccccaagaagaagagcatcaagtcatccataggccgtctctttggcaagaaagagaagggacgaatgggacccccaggccgggacagctcttctctggctggaacaccctcagatgagacactggccactgaccctctggggctagccaagctgacaggcccaggagacaaggaccgaaggaacaagaggaagcatgaactcctggaggaggcctgccgccagggcctaccttttgctgcctgggacgggcccaccgtggtgtcctggctggagctgtgggtgggcatgcctgcctggtatgtggccgcctgccgggccaatgtcaagagcggtgccatcatggccaacctgtcagacacggagatccagcgcgagatcggcatcagcaacccgctgcaccgactcaagctacgcctcgccatccaggagatggtctcgctcacctcgccctcagcccccgcctcctcccgcacttccacaggaaacgtgtggatgacacacgaggagatggagtcccttacggccacgaccaagcccgagaccaaggagatcagctgggagcagatcctggcatatggcgacatgaaccacgagtgggtggggaacgactggctgcccagcctggggctgccccaataccgcagctacttcatggagtcgctggtggacgctcgaatgttagatcaccttaacaagaaggagctccggggccaactcaagatggtggacagctttcacagggtgagtctacattatgggattatgtgcctgaaacggctcaactatgaccggaaggacctggagcggaggcgggaagaaagtcagacccagatccgagacgtgatggtgtggtccaatgagcgggtcatgggttgggtgtccgggctgggcctgaaggaatttgccacgaacctcacggagagcggggtacacggggcactgctcgccctggacgagaccttcgactactccgacctggccttgctcctgcagatccccacgcagaatgcacaggcccggcagcttctggagaaggaattcagcaaccttatctccttaggcacagacaggcggctggacgaggacagcgccaagtctttcagccgctccccatcctggcggaagatgttccgggagaaggacctccgaggcgtaactcccgactcagctgagatgttgccccccaactttcgttcggctgcagcgggagccctgggctctccggggctccctctccgcaagctgcagccagaaggccagacttctgggagttcccgggcagacggcgtttcggtccggacctattcctgctagtgcaggcctccaggtgacctcactcggacggaagaatcttcccgaggctgggctgttccctctcctgcccggactgtggcctcgccggggagagcgggcgggggagctcgcgccgaggactggaccatctgtacagaccagcgggagtgcgcgcgcccgcctcgcacagggccggggcctggaccaaaccacatgaactggactgagagggggaagaagcggggaggaagaaatcccgccccaaacgtccgctttccttttctctactttgtaatttattgatcagtttctgttgggagacgggtgtcctttacccgcgggaagggggcggggcttccctcccgggccgcatgcggggagaggctgctccctcccctttttcctgcccagtcgcggggcccaagtcttccttcttcgtccgaaaggaggggaggggggactcgctgctacaagcctcgccccctgtgccactcagctccgccccgccgcgtccggtcgccggtcccccgggtcatctgcgggcgggttcccctctccctcccccgtgtctcgtgtccccggggcctcaccgccccccgtgctgtggccgtgtccgtgccccgggggtagggggcgcagaatggcgcttccccttctcctctggctccggggtttgcatgggagaatcctctttccacgatgccgctgggcgacgtggcgtgggggcagggggacggtgggggagccctcgcccccgactctcggtcggcctccccgccccaggcgtcactcagtgatcacgggtaaagagaactgtttc

SEQ ID NO: 171815 - DNA, 1638 bp, Homo sapiens
  Payload ID: 13764
  Gene Symbol: PPFIA3
  Gene Name: protein tyrosine phosphatase, receptor type, f polypeptide (PTPRF), interacting protein (liprin), alpha 3
  ENST ID: ENST00000602848
  CDS Start-End: 1-834
gcccccgcctcctcccgcacttccacaggaaacgtgtggatgacacacgaggagatggagtcccttacggccacgaccaagcccatcctggcatatggcgacatgaaccacgagtgggtggggaacgactggctgcccagcctggggctgccccaataccgcagctacttcatggagtcgctggtggacgctcgaatgttagatcaccttaacaagaaggagctccggggccaactcaagatggtggacagctttcacagggtgagtctacattatgggattatgtgcctgaaacggctcaactatgaccggaaggacctggagcggaggcgggaagaaagtcagacccagatccgagacgtgatggtgtggtccaatgagcgggtcatgggttgggtgtccgggctgggcctgaaggaatttgccacgaacctcacggagagcggggtacacggggcactgctcgccctggacgagaccttcgactactccgacctggccttgctcctgcagatccccacgcagaatgcacaggcccggcagcttctggagaaggaattcagcaaccttatctccttaggcacagacaggcggctggacgaggacagcgccaagtctttcagccgctccccatcctggcggaagatgttccgggagaaggacctccgaggcgtaactcccgactcagctgagatgttgccccccaactttcgttcggctgcagcgggagccctgggctctccggggctccctctccgcaagctgcagccagaaggccagacttctgggagttcccgggcagacggcgtttcggtccggacctattcctgctagtgcaggcctccaggtgacctcactcggacggaagaatcttcccgaggctgggctgttccctctcctgcccggactgtggcctcgccggggagagcgggcgggggagctcgcgccgaggactggaccatctgtacagaccagcgggagtgcgcgcgcccgcctcgcacagggccggggcctggaccaaaccacatgaactggactgagagggggaagaagcggggaggaagaaatcccgccccaaacgtccgctttccttttctctactttgtaatttattgatcagtttctgttgggagacgggtgtcctttacccgcgggaagggggcggggcttccctcccgggccgcatgcggggagaggctgctccctcccctttttcctgcccagtcgcggggcccaagtcttccttcttcgtccgaaaggaggggaggggggactcgctgctacaagcctcgccccctgtgccactcagctccgccccgccgcgtccggtcgccggtcccccgggtcatctgcgggcgggttcccctctccctcccccgtgtctcgtgtccccggggcctcaccgccccccgtgctgtggccgtgtccgtgccccgggggtagggggcgcagaatggcgcttccccttctcctctggctccggggtttgcatgggagaatcctctttccacgatgccgctgggcgacgtggcgtgggggcagggggacggtgggggagccctcgcccccgactctcggtcggcctccccgccccaggcgtcactcagtgatcacgggtaaagagaactgtttcaaaaa

SEQ ID NO: 171816 - DNA, 1615 bp, Homo sapiens
  Payload ID: 13764
  Gene Symbol: PPFIA3
  Gene Name: protein tyrosine phosphatase, receptor type, f polypeptide (PTPRF), interacting protein (liprin), alpha 3
  ENST ID: ENST00000602897
  CDS Start-End: 1-732
atgaaccacgagtgggtggggaacgactggctgcccagcctggggctgccccaataccgcagctacttcatggagtcgctggtggacgctcgaatgttagatcaccttaacaagaaggagctccggggccaactcaagatggtggacagctttcacagggtgagtctacattatgggattatgtgcctgaaacggctcaactatgaccggaaggacctggagcggaggcgggaagaaagtcagacccagatccgagacgtgatggtgtggtccaatgagcgggtcatgggttgggtgtccgggctgggcctgaaggaatttgccacgaacctcacggagagcggggtacacggggcactgctcgccctggacgagaccttcgactactccgacctggccttgctcctgcagatccccacgcagaatgcacaggcccggcagcttctggagaaggaattcagcaaccttatctccttaggcacagacaggcggctggacgaggacagcgccaagtctttcagccgctccccatcctggcggaagatgttccgggagaaggacctccgaggcgtaactcccgactcagctgagatgttgccccccaactttcgttcggctgcagcgggagccctgggctctccggggctccctctccgcaagctgcagccagaaggccagacttctgggagttcccgggcagacggcgtttcggtccggacctattcctgctagtgcaggcctccaggtgaggaccgtgctgggcgaccttgggggtgcggggcggcacggtggatcttcactgctccacgcgctgcccggcgtcatgcaggtgacctcactcggacggaagaatcttcccgaggctgggctgttccctctcctgcccggactgtggcctcgccggggagagcgggcgggggagctcgcgccgaggactggaccatctgtacagaccagcgggagtgcgcgcgcccgcctcgcacagggccggggcctggaccaaaccacatgaactggactgagagggggaagaagcggggaggaagaaatcccgccccaaacgtccgctttccttttctctactttgtaatttattgatcagtttctgttgggagacgggtgtcctttacccgcgggaagggggcggggcttccctcccgggccgcatgcggggagaggctgctccctcccctttttcctgcccagtcgcggggcccaagtcttccttcttcgtccgaaaggaggggaggggggactcgctgctacaagcctcgccccctgtgccactcagctccgccccgccgcgtccggtcgccggtcccccgggtcatctgcgggcgggttcccctctccctcccccgtgtctcgtgtccccggggcctcaccgccccccgtgctgtggccgtgtccgtgccccgggggtagggggcgcagaatggcgcttccccttctcctctggctccggggtttgcatgggagaatcctctttccacgatgccgctgggcgacgtggcgtgggggcagggggacggtgggggagccctcgcccccgactctcggtcggcctccccgccccaggcgtcactcagtgatcacgggtaaagagaactgtttc

SEQ ID NO: 171817 - DNA, 3493 bp, Homo sapiens
  Payload ID: 13764
  Gene Symbol: PPFIA3
  Gene Name: protein tyrosine phosphatase, receptor type, f polypeptide (PTPRF), interacting protein (liprin), alpha 3
  ENST ID: ENST00000602655
  CDS Start-End: 75-2033
ctccaccccacgtccctcctgcagcccagctccgcccgcagccgccgcggaccaggcaggcccgcaccgccgccatgatgtgcgaggtgatgcccaccatcagcgaggatggccggcggggctcggcgctgggcccggacgaggcgggcggggagctggagcgcctcatggtcacgatgctcacggagcgcgagcgcctgctggagacgctgcgcgaggcacaggacgggttggctacagcgcagctgcggctgcgcgagctcggccacgagaaggactcgctgcagcgccagctcagcatcgcgctgccccaggagtttgcagctctgacgaaggagctgaacttatgtcgggagcagctgctggagagggaggaagagattgcagagctgaaggcggaacggaacaacacgcggctgctcctggaacacctggagtgcctggtgtccaggcacgagaggtcactgcgcatgaccgtggtgaagcgccaggcccagtccccgggtggggtctcctcggaggtagaagtgctcaaagctctaaagtctctcttcgagcaccacaaggccctggatgagaaggtccgggagcggctgcggatggcgctggagcgcgtggcagtgctcgaggaggagctggaactgagcaatcaggagactctgaaccttcgagaacagctgtctaggcggcggtcagggctggaagagccgggcaaggatggggatgggcagactcttgccaatggcctgggtcctggcggggattccaaccggcgcacagcagagctggaggaggccctggagcggcagcgcgccgaggtgtgccagctgcgggagcgcctggcggtgctgtgccgtcagatgagccagctggaggaggagttgggcaccgcgcaccgtgagctgggcaaggcagaggaagccaactccaagctgcagcgcgacctcaaggaggcgctggcgcagcgggaagatatggaggagcggattacaacactggagaagcgctacctgagcgcccagcgggaggccacgtctctgcacgacgccaacgacaaactggagaacgagttagctagcaaggagtcgttgtatcggcagagtgaagagaagagccgtcagctggccgagtggttggacgacgccaagcagaagctgcagcagacgctgcagaaagcggagaccttgcccgagatagaggcgcagctggcgcagcgcgtggcggcgctcaacaaggccgaggaacgtcatgggaattttgaggagcggcttcggcagctggaggcccagctggaagagaagaatcaagagctgcagcgggcccggcagcgggagaagatgaacgatgaccacaataagcggctgtccgagacggtggacaagctgctgagcgagtccaacgagcgcttacagcttcacctcaaggagcgcatgggggcgctggaggagaagaactccctgagcgaggagatagccaacatgaagaagcttcaggatgagttgctgctaaacaaggagcagctcttggccgaaatggagcggatgcagatggagatcgaccagctgcgggggaggccaccatcctcctactccaggtctctccctggcagtgccctggagctccgttactctcaggcacccactttaccttctggtgcccacctggatccctatgtggctggcagtggtcgggcaggcaagaggggccgctggtcaggggtcaaggaggagccctccaaggattgggagcggtctgcccctgcgggctccataccacccccattccctggggaactggacggctccgatgaggaggaggcagaggggatgtttggggccgagctgctgtcccccagtgggcaggctgacgtgcagacgctggccatcatgcttcaggagcagctggaggccatcaacaaggagatcaaaatcatgtccctaaggaggaagctggagctccacgaggggaggggccggccatcccaggagacaccccaccacccactccccgctctgcccgtcttgagagaatgacccaggccttggcactgcaggcggggtccctggaagatgggggacccccacggggaagtgagggcaccccagattctctgcacaaagcccccaagaagaagagcatcaagtcatccataggccgtctctttggcaagaaagagaagggacgaatgggacccccaggccgggacagctcttctctggctggaacaccctcagatgagacactggccactgaccctctggggctagccaagctgacaggcccaggagacaaggaccgaaggaacaagaggaagcatgaactcctggaggaggcctgccgccagggcctaccttttgctgcctgggacgggcccaccgtggtgtcctggctggagctgtgggtgggcatgcctgcctggtatgtggccgcctgccgggccaatgtcaagagcggtgccatcatggccaacctgtcagacacggagatccagcgcgagatcggcatcagcaacccgctgcaccgactcaagctacgcctcgccatccaggagatggtctcgctcacctcgccctcagcccccgcctcctcccgcacttccacaggaaacgtgtggatgacacacgaggagatggagtcccttacggccacgaccaagcccgagaccaaggagatcagctgggagcagatcctggcatatggcgacatgaaccacgagtgggtggggaacgactggctgcccagcctggggctgccccaataccgcagctacttcatggagtcgctggtggacgctcgaatgttagatcaccttaacaagaaggagctccggggccaactcaagatggtggacagctttcacagggtgagtctacattatgggattatgtgcctgaaacggctcaactatgaccggaaggacctggagcggaggcgggaagaaagtcagacccagatccgagacgtgatggtgtggtccaatgagcgggtcatgggttgggtgtccgggctgggcctgaaggaatttgccacgaacctcacggagagcggggtacacggggcactgctcgccctggacgagaccttcgactactccgacctggccttgctcctgcagatccccacgcagaatgcacaggcccggcagcttctggagaaggaattcagcaaccttatctccttaggcacagacaggcggctggacgaggacagcgccaagtctttcagccgctccccatcctggcggaagatgttccgggagaaggacctccgaggcgtaactcccgactcagctgagatgttgccccccaactttcgttcggctgcagcgggagccctgggctctccggggctccctctccgcaagctgcagccagaaggccagacttctgggagttcccgggcagacggcgtttcggtccggacctattcctgctagtgcaggcctccaggtgacctcactcggacggaagaatcttcccgaggctgggctgtt

SEQ ID NO: 171818 - DNA, 547 bp, Homo sapiens
  Payload ID: 13764
  Gene Symbol: PPFIA3
  Gene Name: protein tyrosine phosphatase, receptor type, f polypeptide (PTPRF), interacting protein (liprin), alpha 3
  ENST ID: ENST00000602509
  CDS Start-End: 108-547
atgcgttgcccgcagggagagaaggaaaagaaggaactgagtgaaagtccctcctgctttccgccgggccagctggacccgtcggacctgatgcccgcaccgccgccatgatgtgcgaggtgatgcccaccatcagcgaggatggccggcggggctcggcgctgggcccggacgaggcgggcggggagctggagcgcctcatggtcacgatgctcacggagcgcgagcgcctgctggagacgctgcgcgaggcacaggacgggttggctacagcgcagctgcggctgcgcgagctcggccacgagaaggactcgctgcagcgccagctcagcatcgcgctgccccaggagtttgcagctctgacgaaggagctgaacttatgtcgggagcagctgctggagagggaggaagagattgcagagctgaaggcggaacggaacaacacgcggctgctcctggaacacctggagtgcctggtgtccaggcacgagaggtcactgcgcatgaccgtggtgaagcgccaggcccagtccccgggtggggtctc

SEQ ID NO: 171819 - DNA, 4341 bp, Homo sapiens
  Payload ID: 13764
  Gene Symbol: PPFIA3
  Gene Name: protein tyrosine phosphatase, receptor type, f polypeptide (PTPRF), interacting protein (liprin), alpha 3
  Uniprot ID: O75145
  ENST ID: ENST00000602351
  CDS Start-End: 1-3558
atgatgtgcgaggtgatgcccaccatcagcgaggatggccggcggggctcggcgctgggcccggacgaggcgggcggggagctggagcgcctcatggtcacgatgctcacggagcgcgagcgcctgctggagacgctgcgcgaggcacaggacgggttggctacagcgcagctgcggctgcgcgagctcggccacgagaaggactcgctgcagcgccagctcagcatcgcgctgccccaggagtttgcagctctgacgaaggagctgaacttatgtcgggagcagctgctggagagggaggaagagattgcagagctgaaggcggaacggaacaacacgcggctgctcctggaacacctggagtgcctggtgtccaggcacgagaggtcactgcgcatgaccgtggtgaagcgccaggcccagtccccgggtggggtctcctcggaggtagaagtgctcaaagctctaaagtctctcttcgagcaccacaaggccctggatgagaaggtccgggagcggctgcggatggcgctggagcgcgtggcagtgctcgaggaggagctggaactgagcaatcaggagactctgaaccttcgagaacagctgtctaggcggcggtcagggctggaagagccgggcaaggatggggatgggcagactcttgccaatggcctgggtcctggcggggattccaaccggcgcacagcagagctggaggaggccctggagcggcagcgcgccgaggtgtgccagctgcgggagcgcctggcggtgctgtgccgtcagatgagccagctggaggaggagttgggcaccgcgcaccgtgagctgggcaaggcagaggaagccaactccaagctgcagcgcgacctcaaggaggcgctggcgcagcgggaagatatggaggagcggattacaacactggagaagcgctacctgagcgcccagcgggaggccacgtctctgcacgacgccaacgacaaactggagaacgagttagctagcaaggagtcgttgtatcggcagagtgaagagaagagccgtcagctggccgagtggttggacgacgccaagcagaagctgcagcagacgctgcagaaagcggagaccttgcccgagatagaggcgcagctggcgcagcgcgtggcggcgctcaacaaggccgaggaacgtcatgggaattttgaggagcggcttcggcagctggaggcccagctggaagagaagaatcaagagctgcagcgggcccggcagcgggagaagatgaacgatgaccacaataagcggctgtccgagacggtggacaagctgctgagcgagtccaacgagcgcttacagcttcacctcaaggagcgcatgggggcgctggaggagaagaactccctgagcgaggagatagccaacatgaagaagcttcaggatgagttgctgctaaacaaggagcagctcttggccgaaatggagcggatgcagatggagatcgaccagctgcgggggaggccaccatcctcctactccaggtctctccctggcagtgccctggagctccgttactctcaggcacccactttaccttctggtgcccacctggatccctatgtggctggcagtggtcgggcaggcaagaggggccgctggtcaggggtcaaggaggagccctccaaggattgggagcggtctgcccctgcgggctccataccacccccattccctggggaactggacggctccgatgaggaggaggcagaggggatgtttggggccgagctgctgtcccccagtgggcaggctgacgtgcagacgctggccatcatgcttcaggagcagctggaggccatcaacaaggagatcaagctgatccaagaggagaaggagacaacagaacagagggcagaggagctggagagtcgggtgtccagctctggcttggactcgttgggccgctaccgcagcagctgctccctgcccccctccctcaccacctctacccttgccagcccctcccctcccagctctggccactcaacaccccgcctggcaccccctagccctgcccgtgagggcaccgacaaggctaatcatgtccctaaggaggaagctggagctccacgaggggaggggccggccatcccaggagacaccccaccacccactccccgctctgcccgtcttgagagaatgacccaggccttggcactgcaggcggggtccctggaagatgggggacccccacggggaagtgagggcaccccagattctctgcacaaagcccccaagaagaagagcatcaagtcatccataggccgtctctttggcaagaaagagaagggacgaatgggacccccaggccgggacagctcttctctggctggaacaccctcagatgagacactggccactgaccctctggggctagccaagctgacaggcccaggagacaaggaccgaaggaacaagaggaagcatgaactcctggaggaggcctgccgccagggcctaccttttgctgcctgggacgggcccaccgtggtgtcctggctggagctgtgggtgggcatgcctgcctggtatgtggccgcctgccgggccaatgtcaagagcggtgccatcatggccaacctgtcagacacggagatccagcgcgagatcggcatcagcaacccgctgcaccgactcaagctacgcctcgccatccaggagatggtctcgctcacctcgccctcagcccccgcctcctcccgcacttccacaggaaacgtgtggatgacacacgaggagatggagtcccttacggccacgaccaagcccatcctggcatatggcgacatgaaccacgagtgggtggggaacgactggctgcccagcctggggctgccccaataccgcagctacttcatggagtcgctggtggacgctcgaatgttagatcaccttaacaagaaggagctccggggccaactcaagatggtggacagctttcacagggtgagtctacattatgggattatgtgcctgaaacggctcaactatgaccggaaggacctggagcggaggcgggaagaaagtcagacccagatccgagacgtgatggtgtggtccaatgagcgggtcatgggttgggtgtccgggctgggcctgaaggaatttgccacgaacctcacggagagcggggtacacggggcactgctcgccctggacgagaccttcgactactccgacctggccttgctcctgcagatccccacgcagaatgcacaggcccggcagcttctggagaaggaattcagcaaccttatctccttaggcacagacaggcggctggacgaggacagcgccaagtctttcagccgctccccatcctggcggaagatgttccgggagaaggacctccgaggcgtaactcccgactcagctgagatgttgccccccaactttcgttcggctgcagcgggagccctgggctctccggggctccctctccgcaagctgcagccagaaggccagacttctgggagttcccgggcagacggcgtttcggtccggacctattcctgctagtgcaggcctccagaatcttcccgaggctgggctgttccctctcctgcccggactgtggcctcgccggggagagcgggcgggggagctcgcgccgaggactggaccatctgtacagaccagcgggagtgcgcgcgcccgcctcgcacagggccggggcctggaccaaaccacatgaactggactgagagggggaagaagcggggaggaagaaatcccgccccaaacgtccgctttccttttctctactttgtaatttattgatcagtttctgttgggagacgggtgtcctttacccgcgggaagggggcggggcttccctcccgggccgcatgcggggagaggctgctccctcccctttttcctgcccagtcgcggggcccaagtcttccttcttcgtccgaaaggaggggaggggggactcgctgctacaagcctcgccccctgtgccactcagctccgccccgccgcgtccggtcgccggtcccccgggtcatctgcgggcgggttcccctctccctcccccgtgtctcgtgtccccggggcctcaccgccccccgtgctgtggccgtgtccgtgccccgggggtagggggcgcagaatggcgcttccccttctcctctggctccggggtttgcatgggagaatcctctttccacgatgccgctgggcgacgtggcgtgggggcagggggacggtgggggagccctcgcccccgactctcggtcggcctccccgccccaggcgtcactcagtgatcacgggtaaagagaactgtttcaaaaa

SEQ ID NO: 171820 - DNA, 5045 bp, Homo sapiens
  Payload ID: 13765
  Gene Symbol: PPFIA4
  Gene Name: protein tyrosine phosphatase, receptor type, f polypeptide (PTPRF), interacting protein (liprin), alpha 4
  Uniprot ID: O75335
  ENST ID: ENST00000272198
  CDS Start-End: 594-2699
attttctctggcttgtgtttctgacagtgttagggcctcctaaagcttcctaggcataggggtatgcctggcttgaattttaaccagggactcagtccagattatggggagacccgaggaaaagtgctgggtagaagaccaaaaaacaaagaccctcagagtgaaaagggcctctagacatcatcccttccaacatctcccagtgcctggagccctcctgcgccacgtgtgtcagatggccggagagcctctgctcgaatacctctttgatggggagctcaactttttaaaagccaccagttgcatcgtaagccaactcttgccattagaagatccttcttatgccagacggaaaaccgctctctggaactttctcccctggctcattctgacccctggagcaccagggcatacgtctgctctcttgcttacacggcagcccttcagacatttgtgacagctctgtgtcctgctaagatgtctcttctctgagctgaagatcccttgactctttgggcccactgggtgtgagctgggggtctcagtcctcagggcctgtcttttctctcccccatcaccgctcaaggtcgcacatgggcagtgcagcagacgtgcggttctccctgggcacaaccacacacgcacccccaggcgtgcatcgccgctactcggcattgagggaagagtctgccaaggactgggagacttctccactgcctgggatgctggccccggcagctggccctgcctttgacagtgaccctgagatctccgacgtggatgaggatgagccagggggtctggtgggctctgcggatgttgtctcccccagcggccactcagatgcccagaccctggccatgatgctgcaggagcagctggatgccatcaatgaggaaatcaggatgattcaggaagagaaggagtccacggagctccgcgcggaggagattgagacgcgtgtaaccagtggcagcatggaagccctaaacctgaagcagctgcgcaagcgtggttccatccccacctctctgacggccctgtccctggccagcgcgtccccaccactcagcggccgctccacacctaagctcacctcccgcagtgctgcccaggacctggaccgaatgggggtcatgaccctgcccagtgacttaagaaagcataggaggaagctgctgtcgccagtgtctcgggaagagaaccgagaggataaagccaccataaaatgtgagacttctcctccttcctcacccaggacgctgcggctagagaagcttggccacccagccctgagccaggaagaaggcaagagtgccttggaggatcagggcagcaaccccagcagcagcaacagcagccaggactccctgcacaagggcgccaagcgcaagggcatcaagtcgtccattggccgcctgtttgggaagaaggagaagggcaggctgatccagctgagtcgggatggagccacaggccatgttctgctaacagactccgaattcagtatgcaggagcctatggtgcctgccaagctggggacccaggcagagaaggaccggcggctaaagaagaaacaccagctgcttgaagatgcccgcaggaaaggaatgccctttgcccagtgggatggtcctactgtggtctcctggttggagctctgggtggggatgcctgcctggtatgtggcagcctgccgggccaacgtcaagagtggtgccatcatgtccgctctgtcggacacagagatccagcgggagatcggcatcagcaatgccctgcaccggctcaagctccgcctggccattcaggagatggtgtcattgaccagcccctctgccccacccacctccaggacttcttctgggaatgtctgggtcacccatgaagagatggaaactctggaaacatctactaaaacagacagtgaggagggcagctgggctcagaccctggcctatggggacatgaaccatgagtggattgggaatgaatggctacccagcctggggctcccgcagtaccgcagctacttcatggagtgcctggtggacgcccgcatgctggaccacctcaccaagaaggacctgcgggtccacctgaagatggtggacagcttccatcgaaccagtcttcagtatggcatcatgtgtctgaagaggctgaattatgaccggaaggagctggagaagaggcgagaggagagccagcatgagatcaaggatgtgttagtctggaccaacgaccaggtggttcattgggtccagtctattgggctccgggactacgcaggaaacctgcatgagagtggtgtgcatggagccttgctggccctggacgagaacttcgaccacaacacactggccctgatcctccagatccccacacagaacacccaggcacgccaagtgatggaaagagagttcaataacctgttggccttgggcacagaccggaagctggatgacggggatgacaaggtgtttcgccgcgcgccctcctggaggaagcgcttccggccgcgggagcaccacggtcgcggcggcatgctcagcgcttccgcggagaccctcccggcgggcttccgtgtgtccaccctggggaccctgcagcccccaccggccccgccaaagaagatcatgcctgaagctcactcccactatctctacggacacatgctctccgccttccgggactagccatggcccccagggctggcttcctccttctgggtttcacaggctcctctggccctgacccctcttgctcgttccccttccttccgcagctcctagtctcgtccgtgactttccggttgccctggatctcagaatatattcgtccaccccctcggcaccccattaccccgagtcccaccgtgtgtccgttgtaagtccggtggatgtggctggggtttcctggtattgtggaggcacccaggttgtccatgcttgggattctgggggaaggagagaagggcagctcagggtggatgtgaagccacccttcctcttctggacccagcctggtctgcactgcaacctccaccaggaccaggatcctgggccacaggctgggatggtccttccaagaaagggtcatttcagacgcagccctgcttgggctattcaatcttagggtgtctatccacgtctggctgtgccaaatggtctggcagctggttttggcatccccagcatcaccactctcccaacccatcaccgtgactgcagttcctgcccccattctcttggggtcagggaggggctgggaagggctactgaaggccccattctcccacaggatggtgaggctgggaggaggaagactgaggtagagattccaggccctggcataagctgaatcccaaatttgagtttgggaagaaccagagagaaatggatccctgagctctgagccaagggtgaggatggggaaactctaagctcccacctaataagaagcataggcagaccagccagagggagagccaatggcctctggtagccttaagcccaaagggcagtgggaatgtcccctgccccaaccatcgggtggagctcctgctgggctatggggaagggaggttgtgcggatcttgactctagggcagaacagatctaaccatgcattgctagctctgctcccagcatcccttccccttctctcctcctctgcctcacttctttagtaatcccaaccctataaaaatgaacctaatgggtggattgaatatacattgagcccaaagtcaagtttggggaaaaggcagactaaggcctcctttctctgacctcccaggaagaaaatagcttctcctacagtgattcatgtcccaggtccaggaaatccaatgttggtgaaggcagccactctcttgcttgtccccaaatcacctaaccctcatccagggctattttggtgggcagggactgcctcctcccggaattcctaagatccgcccagctgccaccattttcattgctttccccagcagcatgatgggaacccaagctgagggatacaggtcctgatttggtaggaatattattcccaagaaatacccgctcctcacctactccctcatcctaccaaggtgcctgaaaatgttcaagacttatgttcagggtgggatgatggaaccgagggcttcatcaaagtgagaggaaaggaaaagcatctggcatgtgtttcttggataggggccagtgcagtgccatcctacaggtggctggagcagctgctttgcaacctgatcaccttgagttctgagcagggactaggcttgcaggtgagataatgggccagggcacccagtccagaaggagcaatggcacctgggcagtgccagggcttaaagcccgctgctccttttcggtagaggagaggcccatcactggtgtggtggggtgggctctcccttaggcttgggcaaggcagccacctgcccttgctctcccttagtgttccctggcctccctgccatcaggttgctgggagtggagatggagggattattgagcagaaaatgagttggatggagataaacagctcccatccctgggtaatggatggtaagatgatggagattcctaagattggtggagttgggcaatgcatagccatctgactccttcagggtgctcttgatgggctggctgtaagggagactcagtcccagcctctcccctctacaactcctgccactgttggccatgtcgtaaggcagcagctgtgccaggatagctgggtccattcagagcaccttgagaagtgttgcagggaggtgttaagaagagaactctgtgcaaacagtgatggaaggctgttgtcttggtgtatcccttgcctcatagtcaatatattttttttttggcgagtcaccagtgacccgagccctccacaccagcctcctgtatctcatcaggtcccttctcagtactgtatttgctcagtgcatcaggaatgggtgtatgggtgtgtgtgggtgggtgtgagtgtgggtgtgtacgtaccaataaacaacctggttttaagacaatgta

SEQ ID NO: 171821 - DNA, 6395 bp, Homo sapiens
  Payload ID: 13765
  Gene Symbol: PPFIA4
  Gene Name: protein tyrosine phosphatase, receptor type, f polypeptide (PTPRF), interacting protein (liprin), alpha 4
  Uniprot ID: O75335
  ENST ID: ENST00000295706
  CDS Start-End: 1972-4050
atgtctgagagccccaaggacgagggctccgaagagtgtctgtttctgcagcgcctatgggagtggggggcagtggggggaactcagggaagctgcctacaacttgaggccttccccaggctggaggaggaggacagggaaggccgaggggagctgtcctccggctgccatcaccctgatgaggcggccctgccccgggctgtggtctccgcaggggctggcaaccttgcctttgtccagctctctccgtggccaggcctgccatctgcctgcccacactcctccccggcaaagccccttgcaaatgcttgctttggggactggcagctttcgcctctgaatcaggacctagcatcagtactctggggagggggtccaggtgccaaccctgtgagtccctccctgtcccctgacgctgagaaggccctgccaacccccaccatgtgtgaggtgatgcccacaatcaatgagggggaccgcctgggtccccctcatggcgccgatgctgacgccaacttcgagcagctgatggtgaacatgctggacgagcgggagaagttgctggagtctcttcgggagagtcaggagaccttggcggccacacagagccggctccaggatgccatacacgagcgggaccagctccagcgccaccttaactccgccctcccccaggaatttgccaccttaacccgggagctgagcatgtgtcgggagcagcttctagagcgggaggaagagatatcagaactgaaagcagaacggaataacacacggctgcttctggaacatctggagtgcctggtgtcccgccatgaacggtcactgcggatgactgtggtgaagcgccaggcccagtcaccttcgggggtctccagtgaggtggaggtgctgaaggccctcaagtcactgtttgagcaccacaaggccctggatgagaaggtgcgagagcggctccgggcagcgctggagcgagtcaccaccttggaggagcagctggcaggtgcccaccagcaggtgtctgccctgcagcagggggcaggggtgcgggatggagcggcagaagaggaggggactgtggagctggggccgaaacgcctgtggaaggaggatacgggccgggtagaggagctgcaggagctcctggagaagcagaactttgagttgagccaggcccgggagcgactggtcaccctaacaacaaccgtgactgaactcgaggaggacctgggcacggcccgccgggacctcatcaagtcggaggagctgagcagcaagcatcagcgggacctccgggaggctctggcccagaaggaggacatggaagagcggattactacactggagaagcgctacctggctgctcagcgtgaggcaacatccatccatgacctcaatgacaagctggagaatgagctggccaacaaggagtccctgcaccgccagtgtgaggagaaggcccgacacctgcaggagctgctggaggtggcagagcagaagctgcagcagacgatgcgcaaggcagagacgctgccagaggtggaggctgagctggcccagagaattgcagccctcaccaaggctgaagaacggcatggcaacattgaggagcacctgcggcagctggagggacagctggaggagaagaaccaggagctggcacggacggctgtgcaggtgcgccagcgggaaaagatgaatgaggaccacaacaagcggctgtcggacacagtggaccggctgctcagcgagtccaacgagcgtctgcagctccacctgaaggagcgcatggctgccctggaggagaagaacacgttgatccaggagttggagagctcccagcggcagattgaggagcagcaccaccacaagggccgcctgtctgaagagattgagaagctgcgccaagaggtggaccagctgaagggccgaggggggccgtttgtggatggcgtccactccaggtcgcacatgggcagtgcagcagacgtgcggttctccctgggcacaaccacacacgcacccccaggcgtgcatcgccgctactcggcattgagggaagagtctgccaaggactgggagacttctccactgcctgggatgctggccccggcagctggccctgcctttgacagtgaccctgagatctccgacgtggatgaggatgagccagggggtctggtgggctctgcggatgttgtctcccccagcggccactcagatgcccagaccctggccatgatgctgcaggagcagctggatgccatcaatgaggaaatcaggatgattcaggaagagaaggagtccacggagctccgcgcggaggagattgagacgcgtgtaaccagtggcagcatggaagccctaaacctgaagcagctgcgcaagcgtggttccatccccacctctctgacggccctgtccctggccagcgcgtccccaccactcagcggccgctccacacctaagctcacctcccgcagtgctgcccaggacctggaccgaatgggggtcatgaccctgcccagtgacttaagaaagcataggaggaagctgctgtcgccagtgtctcgggaagagaaccgagaggataaagccaccataaaatgtgagacttctcctccttcctcacccaggacgctgcggctagagaagcttggccacccagccctgagccaggaagaaggcaagagtgccttggaggatcagggcagcaaccccagcagcagcaacagcagccaggactccctgcacaagggcgccaagcgcaagggcatcaagtcgtccattggccgcctgtttgggaagaaggagaagggcaggctgatccagctgagtcgggatggagccacaggccatgttctgctaacagactccgaattcagtatgcaggagcctatggtgcctgccaagctggggacccaggcagagaaggaccggcggctaaagaagaaacaccagctgcttgaagatgcccgcaggaaaggaatgccctttgcccagtgggatggtcctactgtggtctcctggttggagctctgggtggggatgcctgcctggtatgtggcagcctgccgggccaacgtcaagagtggtgccatcatgtccgctctgtcggacacagagatccagcgggagatcggcatcagcaatgccctgcaccggctcaagctccgcctggccattcaggagatggtgtcattgaccagcccctctgccccacccacctccaggacttcttctgggaatgtctgggtcacccatgaagagatggaaactctggaaacatctactaaaacaaccctggcctatggggacatgaaccatgagtggattgggaatgaatggctacccagcctggggctcccgcagtaccgcagctacttcatggagtgcctggtggacgcccgcatgctggaccacctcaccaagaaggacctgcgggtccacctgaagatggtggacagcttccatcgaaccagtcttcagtatggcatcatgtgtctgaagaggctgaattatgaccggaaggagctggagaagaggcgagaggagagccagcatgagatcaaggatgtgttagtctggaccaacgaccaggtggttcattgggtccagtctattgggctccgggactacgcaggaaacctgcatgagagtggtgtgcatggagccttgctggccctggacgagaacttcgaccacaacacactggccctgatcctccagatccccacacagaacacccaggcacgccaagtgatggaaagagagttcaataacctgttggccttgggcacagaccggaagctggatgacggggatgacaaggtgtttcgccgcgcgccctcctggaggaagcgcttccggccgcgggagcaccacggtcgcggcggcatgctcagcgcttccgcggagaccctcccggcgggcttccgtgtgtccaccctggggaccctgcagcccccaccggccccgccaaagaagatcatgcctgaagctcactcccactatctctacggacacatgctctccgccttccgggactagccatggcccccagggctggcttcctccttctgggtttcacaggctcctctggccctgacccctcttgctcgttccccttccttccgcagctcctagtctcgtccgtgactttccggttgccctggatctcagaatatattcgtccaccccctcggcaccccattaccccgagtcccaccgtgtgtccgttgtaagtccggtggatgtggctggggtttcctggtattgtggaggcacccaggttgtccatgcttgggattctgggggaaggagagaagggcagctcagggtggatgtgaagccacccttcctcttctggacccagcctggtctgcactgcaacctccaccaggaccaggatcctgggccacaggctgggatggtccttccaagaaagggtcatttcagacgcagccctgcttgggctattcaatcttagggtgtctatccacgtctggctgtgccaaatggtctggcagctggttttggcatccccagcatcaccactctcccaacccatcaccgtgactgcagttcctgcccccattctcttggggtcagggaggggctgggaagggctactgaaggccccattctcccacaggatggtgaggctgggaggaggaagactgaggtagagattccaggccctggcataagctgaatcccaaatttgagtttgggaagaaccagagagaaatggatccctgagctctgagccaagggtgaggatggggaaactctaagctcccacctaataagaagcataggcagaccagccagagggagagccaatggcctctggtagccttaagcccaaagggcagtgggaatgtcccctgccccaaccatcgggtggagctcctgctgggctatggggaagggaggttgtgcggatcttgactctagggcagaacagatctaaccatgcattgctagctctgctcccagcatcccttccccttctctcctcctctgcctcacttctttagtaatcccaaccctataaaaatgaacctaatgggtggattgaatatacattgagcccaaagtcaagtttggggaaaaggcagactaaggcctcctttctctgacctcccaggaagaaaatagcttctcctacagtgattcatgtcccaggtccaggaaatccaatgttggtgaaggcagccactctcttgcttgtccccaaatcacctaaccctcatccagggctattttggtgggcagggactgcctcctcccggaattcctaagatccgcccagctgccaccattttcattgctttccccagcagcatgatgggaacccaagctgagggatacaggtcctgatttggtaggaatattattcccaagaaatacccgctcctcacctactccctcatcctaccaaggtgcctgaaaatgttcaagacttatgttcagggtgggatgatggaaccgagggcttcatcaaagtgagaggaaaggaaaagcatctggcatgtgtttcttggataggggccagtgcagtgccatcctacaggtggctggagcagctgctttgcaacctgatcaccttgagttctgagcagggactaggcttgcaggtgagataatgggccagggcacccagtccagaaggagcaatggcacctgggcagtgccagggcttaaagcccgctgctccttttcggtagaggagaggcccatcactggtgtggtggggtgggctctcccttaggcttgggcaaggcagccacctgcccttgctctcccttagtgttccctggcctccctgccatcaggttgctgggagtggagatggagggattattgagcagaaaatgagttggatggagataaacagctcccatccctgggtaatggatggtaagatgatggagattcctaagattggtggagttgggcaatgcatagccatctgactccttcagggtgctcttgatgggctggctgtaagggagactcagtcccagcctctcccctctacaactcctgccactgttggccatgtcgtaaggcagcagctgtgccaggatagctgggtccattcagagcaccttgagaagtgttgcagggaggtgttaagaagagaactctgtgcaaacagtgatggaaggctgttgtcttggtgtatcccttgcctcatagtcaatatattttttttttggcgagtcaccagtgacccgagccctccacaccagcctcctgtatctcatcaggtcccttctcagtactgtatttgctcagtgcatcaggaatgggtgtatgggtgtgtgtgggtgggtgtgagtgtgggtgtgtacgtaccaataaacaacctggttttaagacaatgt

SEQ ID NO: 171822 - DNA, 6434 bp, Homo sapiens
  Payload ID: 13765
  Gene Symbol: PPFIA4
  Gene Name: protein tyrosine phosphatase, receptor type, f polypeptide (PTPRF), interacting protein (liprin), alpha 4
  ENST ID: ENST00000367240
  CDS Start-End: 528-4088
cgcgcttgggcggcggaggctgcagctacctcggcgccggctcggctctaggacgtgtcgggctgcacgggtcgggggcggctccctgctgcttccgagcctagccgcctggccttcggcatttgcagacacactgccctccagaaacgatgggtgtcgctagatccagctgggactctgccagcctccggcactcagtctaagagaagggccatcttccagccctgctgtccctgcctgtcatggccacattcggctgctgtctgcatgtctggggacacagggcacccagccccagccctgagaagttaagccaggccttctggctcagttccacaggggcactccagaccccaggcccctttcagagcaaaagcaactgatgctatgggagaagcccctgcccacctgtccactcgcctggcactgcccactctgagacccatgcactgggttcccctggaggtgccaaccctgtgagtccctccctgtcccctgacgctgagaaggccctgccaacccccaccatgtgtgaggtgatgcccacaatcaatgagggggaccgcctgggtccccctcatggcgccgatgctgacgccaacttcgagcagctgatggtgaacatgctggacgagcgggagaagttgctggagtctcttcgggagagtcaggagaccttggcggccacacagagccggctccaggatgccatacacgagcgggaccagctccagcgccaccttaactccgccctcccccaggaatttgccaccttaacccgggagctgagcatgtgtcgggagcagcttctagagcgggaggaagagatatcagaactgaaagcagaacggaataacacacggctgcttctggaacatctggagtgcctggtgtcccgccatgaacggtcactgcggatgactgtggtgaagcgccaggcccagtcaccttcgggggtctccagtgaggtggaggtgctgaaggccctcaagtcactgtttgagcaccacaaggccctggatgagaaggtgcgagagcggctccgggcagcgctggagcgagtcaccaccttggaggagcagctggcaggtgcccaccagcaggtgtctgccctgcagcagggggcaggggtgcgggatggagcggcagaagaggaggggactgtggagctggggccgaaacgcctgtggaaggaggatacgggccgggtagaggagctgcaggagctcctggagaagcagaactttgagttgagccaggcccgggagcgactggtcaccctaacaacaaccgtgactgaactcgaggaggacctgggcacggcccgccgggacctcatcaagtcggaggagctgagcagcaagcatcagcgggacctccgggaggctctggcccagaaggaggacatggaagagcggattactacactggagaagcgctacctggctgctcagcgtgaggcaacatccatccatgacctcaatgacaagctggagaatgagctggccaacaaggagtccctgcaccgccagtgtgaggagaaggcccgacacctgcaggagctgctggaggtggcagagcagaagctgcagcagacgatgcgcaaggcagagacgctgccagaggtggaggctgagctggcccagagaattgcagccctcaccaaggctgaagaacggcatggcaacattgaggagcacctgcggcagctggagggacagctggaggagaagaaccaggagctggcacgggtgcgccagcgggaaaagatgaatgaggaccacaacaagcggctgtcggacacagtggaccggctgctcagcgagtccaacgagcgtctgcagctccacctgaaggagcgcatggctgccctggaggagaagggccgcctgtctgaagagattgagaagctgcgccaagaggtggaccagctgaagggccgaggggggccgtttgtggatggcgtccactccaggtcgcacatgggcagtgcagcagacgtgcggttctccctgggcacaaccacacacgcacccccaggcgtgcatcgccgctactcggcattgagggaagagtctgccaaggactgggagacttctccactgcctgggatgctggccccggcagctggccctgcctttgacagtgaccctgagatctccgacgtggatgaggatgagccagggggtctggtgggctctgcggatgttgtctcccccagcggccactcagatgcccagaccctggccatgatgctgcaggagcagctggatgccatcaatgaggaaatcaggatgattcaggaagagaaggagtccacggagctccgcgcggaggagattgagacgcgtgtaaccagtggcagcatggaagccctaaacctgaagcagctgcgcaagcgtggttccatccccacctctctgacggccctgtccctggccagcgcgtccccaccactcagcggccgctccacacctaagctcacctcccgcagtgctgcccaggacctggaccgaatgggggtcatgaccctgcccagtgacttaagaaagcataggaggaagctgctgtcgccagtgtctcgggaagagaaccgagaggataaagccaccataaaatgtgagacttctcctccttcctcacccaggacgctgcggctagagaagcttggccacccagccctgagccaggaagaaggcaagagtgccttggaggatcagggcagcaaccccagcagcagcaacagcagccaggactccctgcacaagggcgccaagcgcaagggcatcaagtcgtccattggccgcctgtttgggaagaaggagaagggcaggctgatccagctgagtcgggatggagccacaggccatgttctgctaacagactccgaattcagtatgcaggagcctatggtgcctgccaagctggggacccaggcagagaaggaccggcggctaaagaagaaacaccagctgcttgaagatgcccgcaggaaaggaatgccctttgcccagtgggatggtcctactgtggtctcctggttggagctctgggtggggatgcctgcctggtatgtggcagcctgccgggccaacgtcaagagtggtgccatcatgtccgctctgtcggacacagagatccagcgggagatcggcatcagcaatgccctgcaccggctcaagctccgcctggccattcaggagatggtgtcattgaccagcccctctgccccacccacctccaggacttcttctgggaatgtctgggtcacccatgaagagatggaaactctggaaacatctactaaaacagacagtgaggagggcagctgggctcagaccctggcctatggggacatgaaccatgagtggattgggaatgaatggctacccagcctggggctcccgcagtaccgcagctacttcatggagtgcctggtggacgcccgcatgctggaccacctcaccaagaaggacctgcgggtccacctgaagatggtggacagcttccatcgaaccagtcttcagtatggcatcatgtgtctgaagaggctgaattatgaccggaaggagctggagaagaggcgagaggagagccagcatgagatcaaggatgtgttagtctggaccaacgaccaggtggttcattgggtccagtctattgggctccgggactacgcaggaaacctgcatgagagtggtgtgcatggagccttgctggccctggacgagaacttcgaccacaacacactggccctgatcctccagatccccacacagaacacccaggcacgccaagtgatggaaagagagttcaataacctgttggccttgggcacagaccggaagctggatgacggggatgacaaggtgtttcgccgcgcgccctcctggaggaagcgcttccggccgcgggagcaccacggtcgcggcggcatgctcagcgcttccgcggagaccctcccggcgggcttccgtgtgtccaccctggggaccctgcagcccccaccggccccgccaaagaagatcatgcctgaagctcactcccactatctctacggacacatgctctccgccttccgggactagccatggcccccagggctggcttcctccttctgggtttcacaggctcctctggccctgacccctcttgctcgttccccttccttccgcagctcctagtctcgtccgtgactttccggttgccctggatctcagaatatattcgtccaccccctcggcaccccattaccccgagtcccaccgtgtgtccgttgtaagtccggtggatgtggctggggtttcctggtattgtggaggcacccaggttgtccatgcttgggattctgggggaaggagagaagggcagctcagggtggatgtgaagccacccttcctcttctggacccagcctggtctgcactgcaacctccaccaggaccaggatcctgggccacaggctgggatggtccttccaagaaagggtcatttcagacgcagccctgcttgggctattcaatcttagggtgtctatccacgtctggctgtgccaaatggtctggcagctggttttggcatccccagcatcaccactctcccaacccatcaccgtgactgcagttcctgcccccattctcttggggtcagggaggggctgggaagggctactgaaggccccattctcccacaggatggtgaggctgggaggaggaagactgaggtagagattccaggccctggcataagctgaatcccaaatttgagtttgggaagaaccagagagaaatggatccctgagctctgagccaagggtgaggatggggaaactctaagctcccacctaataagaagcataggcagaccagccagagggagagccaatggcctctggtagccttaagcccaaagggcagtgggaatgtcccctgccccaaccatcgggtggagctcctgctgggctatggggaagggaggttgtgcggatcttgactctagggcagaacagatctaaccatgcattgctagctctgctcccagcatcccttccccttctctcctcctctgcctcacttctttagtaatcccaaccctataaaaatgaacctaatgggtggattgaatatacattgagcccaaagtcaagtttggggaaaaggcagactaaggcctcctttctctgacctcccaggaagaaaatagcttctcctacagtgattcatgtcccaggtccaggaaatccaatgttggtgaaggcagccactctcttgcttgtccccaaatcacctaaccctcatccagggctattttggtgggcagggactgcctcctcccggaattcctaagatccgcccagctgccaccattttcattgctttccccagcagcatgatgggaacccaagctgagggatacaggtcctgatttggtaggaatattattcccaagaaatacccgctcctcacctactccctcatcctaccaaggtgcctgaaaatgttcaagacttatgttcagggtgggatgatggaaccgagggcttcatcaaagtgagaggaaaggaaaagcatctggcatgtgtttcttggataggggccagtgcagtgccatcctacaggtggctggagcagctgctttgcaacctgatcaccttgagttctgagcagggactaggcttgcaggtgagataatgggccagggcacccagtccagaaggagcaatggcacctgggcagtgccagggcttaaagcccgctgctccttttcggtagaggagaggcccatcactggtgtggtggggtgggctctcccttaggcttgggcaaggcagccacctgcccttgctctcccttagtgttccctggcctccctgccatcaggttgctgggagtggagatggagggattattgagcagaaaatgagttggatggagataaacagctcccatccctgggtaatggatggtaagatgatggagattcctaagattggtggagttgggcaatgcatagccatctgactccttcagggtgctcttgatgggctggctgtaagggagactcagtcccagcctctcccctctacaactcctgccactgttggccatgtcgtaaggcagcagctgtgccaggatagctgggtccattcagagcaccttgagaagtgttgcagggaggtgttaagaagagaactctgtgcaaacagtgatggaaggctgttgtcttggtgtatcccttgcctcatagtcaatatattttttttttggcgagtcaccagtgacccgagccctccacaccagcctcctgtatctcatcaggtcccttctcagtactgtatttgctcagtgcatcaggaatgggtgtatgggtgtgtgtgggtgggtgtgagtgtgggtgtgtacgtaccaataaacaacctggttttaagacaatgta

SEQ ID NO: 171823 - DNA, 6349 bp, Homo sapiens
  Payload ID: 13765
  Gene Symbol: PPFIA4
  Gene Name: protein tyrosine phosphatase, receptor type, f polypeptide (PTPRF), interacting protein (liprin), alpha 4
  Uniprot ID: O75335
  ENST ID: ENST00000447715
  CDS Start-End: 442-3999
atgtctgagagccccaaggacgagggctccgaagagtgtctgtttctgcagcgcctatgggagtggggggcagtggggggaactcagggaagctgcctacaacttgaggccttccccaggctggaggaggaggacagggaaggccgaggggagctgtcctccggctgccatcaccctgatgaggcggccctgccccgggctgtggtctccgcaggggctggcaaccttgcctttgtccagctctctccgtggccaggcctgccatctgcctgcccacactcctccccggcaaagccccttgcaaatgcttgctttggggactggcagctttcgcctctgaatcaggacctagcatcagtactctggggagggggtccaggtgccaaccctgtgagtccctccctgtcccctgacgctgagaaggccctgccaacccccaccatgtgtgaggtgatgcccacaatcaatgagggggaccgcctgggtccccctcatggcgccgatgctgacgccaacttcgagcagctgatggtgaacatgctggacgagcgggagaagttgctggagtctcttcgggagagtcaggagaccttggcggccacacagagccggctccaggatgccatacacgagcgggaccagctccagcgccaccttaactccgccctcccccaggaatttgccaccttaacccgggagctgagcatgtgtcgggagcagcttctagagcgggaggaagagatatcagaactgaaagcagaacggaataacacacggctgcttctggaacatctggagtgcctggtgtcccgccatgaacggtcactgcggatgactgtggtgaagcgccaggcccagtcaccttcgggggtctccagtgaggtggaggtgctgaaggccctcaagtcactgtttgagcaccacaaggccctggatgagaaggtgcgagagcggctccgggcagcgctggagcgagtcaccaccttggaggagcagctggcaggtgcccaccagcaggtgtctgccctgcagcagggggcaggggtgcgggatggagcggcagaagaggaggggactgtggagctggggccgaaacgcctgtggaaggaggatacgggccgggtagaggagctgcaggagctcctggagaagcagaactttgagttgagccaggcccgggagcgactggtcaccctaacaacaaccgtgactgaactcgaggaggacctgggcacggcccgccgggacctcatcaagtcggaggagctgagcagcaagcatcagcgggacctccgggaggctctggcccagaaggaggacatggaagagcggattactacactggagaagcgctacctggctgctcagcgtgaggcaacatccatccatgacctcaatgacaagctggagaatgagctggccaacaaggagtccctgcaccgccagtgtgaggagaaggcccgacacctgcaggagctgctggaggtggcagagcagaagctgcagcagacgatgcgcaaggcagagacgctgccagaggtggaggctgagctggcccagagaattgcagccctcaccaaggctgaagaacggcatggcaacattgaggagcacctgcggcagctggagggacagctggaggagaagaaccaggagctggcacggacggctgtgcaggtgcgccagcgggaaaagatgaatgaggaccacaacaagcggctgtcggacacagtggaccggctgctcagcgagtccaacgagcgtctgcagctccacctgaaggagcgcatggctgccctggaggagaagaacacgttgatccaggagttggagagctcccagcggcagattgaggagcagcaccaccacaagggccgcctgtctgaagagattgagaagctgcgccaagaggtggaccagctgaagggccgaggggggccgtttgtggatggcgtccactccaggtcgcacatgggcagtgcagcagacgtgcggttctccctgggcacaaccacacacgcacccccaggcgtgcatcgccgctactcggcattgagggaagagtctgccaagctggccctgcctttgacagtgaccctgagatctccgacgtggatgaggatgagccagggggtctgctgcaacttagagtaccacagttcagggaccctctgtgggtcatcaggcccgctgccagtgccggagatgattcaggaagagaaggagtccacggagctccgcgcggaggagattgagacgcgtgtaaccagtggcagcatggaagccctaaacctgaagcagctgcgcaagcgtggttccatccccacctctctgacggccctgtccctggccagcgcgtccccaccactcagcggccgctccacacctaagctcacctcccgcagtgctgcccaggacctggaccgaatgggggtcatgaccctgcccagtgacttaagaaagcataggaggaagctgctgtcgccagtgtctcgggaagagaaccgagaggataaagccaccataaaatgtgagacttctcctccttcctcacccaggacgctgcggctagagaagcttggccacccagccctgagccaggaagaaggcaagagtgccttggaggatcagggcagcaaccccagcagcagcaacagcagccaggactccctgcacaagggcgccaagcgcaagggcatcaagtcgtccattggccgcctgtttgggaagaaggagaagggcaggctgatccagctgagtcgggatggagccacaggccatgttctgctaacagactccgaattcagtatgcaggagcctatggtgcctgccaagctggggacccaggcagagaaggaccggcggctaaagaagaaacaccagctgcttgaagatgcccgcaggaaaggaatgccctttgcccagtgggatggtcctactgtggtctcctggttggagctctgggtggggatgcctgcctggtatgtggcagcctgccgggccaacgtcaagagtggtgccatcatgtccgctctgtcggacacagagatccagcgggagatcggcatcagcaatgccctgcaccggctcaagctccgcctggccattcaggagatggtgtcattgaccagcccctctgccccacccacctccaggacttcttctgggaatgtctgggtcacccatgaagagatggaaactctggaaacatctactaaaacagacagtgaggagggcagctgggctcagaccctggcctatggggacatgaaccatgagtggattgggaatgaatggctacccagcctggggctcccgcagtaccgcagctacttcatggagtgcctggtggacgcccgcatgctggaccacctcaccaagaaggacctgcgggtccacctgaagatggtggacagcttccatcgaaccagtcttcagtatggcatcatgtgtctgaagaggctgaattatgaccggaaggagctggagaagaggcgagaggagagccagcatgagatcaaggatgtgttagtctggaccaacgaccaggtggttcattgggtccagtctattgggctccgggactacgcaggaaacctgcatgagagtggtgtgcatggagccttgctggccctggacgagaacttcgaccacaacacactggccctgatcctccagatccccacacagaacacccaggcacgccaagtgatggaaagagagttcaataacctgttggccttgggcacagaccggaagctggatgacggggatgacaaggtgtttcgccgcgcgccctcctggaggaagcgcttccggccgcgggagcaccacggtcgcggcggcatgctcagcgcttccgcggagaccctcccggcgggcttccgtgtgtccaccctggggaccctgcagcccccaccggccccgccaaagaagatcatgcctgaagctcactcccactatctctacggacacatgctctccgccttccgggactagccatggcccccagggctggcttcctccttctgggtttcacaggctcctctggccctgacccctcttgctcgttccccttccttccgcagctcctagtctcgtccgtgactttccggttgccctggatctcagaatatattcgtccaccccctcggcaccccattaccccgagtcccaccgtgtgtccgttgtaagtccggtggatgtggctggggtttcctggtattgtggaggcacccaggttgtccatgcttgggattctgggggaaggagagaagggcagctcagggtggatgtgaagccacccttcctcttctggacccagcctggtctgcactgcaacctccaccaggaccaggatcctgggccacaggctgggatggtccttccaagaaagggtcatttcagacgcagccctgcttgggctattcaatcttagggtgtctatccacgtctggctgtgccaaatggtctggcagctggttttggcatccccagcatcaccactctcccaacccatcaccgtgactgcagttcctgcccccattctcttggggtcagggaggggctgggaagggctactgaaggccccattctcccacaggatggtgaggctgggaggaggaagactgaggtagagattccaggccctggcataagctgaatcccaaatttgagtttgggaagaaccagagagaaatggatccctgagctctgagccaagggtgaggatggggaaactctaagctcccacctaataagaagcataggcagaccagccagagggagagccaatggcctctggtagccttaagcccaaagggcagtgggaatgtcccctgccccaaccatcgggtggagctcctgctgggctatggggaagggaggttgtgcggatcttgactctagggcagaacagatctaaccatgcattgctagctctgctcccagcatcccttccccttctctcctcctctgcctcacttctttagtaatcccaaccctataaaaatgaacctaatgggtggattgaatatacattgagcccaaagtcaagtttggggaaaaggcagactaaggcctcctttctctgacctcccaggaagaaaatagcttctcctacagtgattcatgtcccaggtccaggaaatccaatgttggtgaaggcagccactctcttgcttgtccccaaatcacctaaccctcatccagggctattttggtgggcagggactgcctcctcccggaattcctaagatccgcccagctgccaccattttcattgctttccccagcagcatgatgggaacccaagctgagggatacaggtcctgatttggtaggaatattattcccaagaaatacccgctcctcacctactccctcatcctaccaaggtgcctgaaaatgttcaagacttatgttcagggtgggatgatggaaccgagggcttcatcaaagtgagaggaaaggaaaagcatctggcatgtgtttcttggataggggccagtgcagtgccatcctacaggtggctggagcagctgctttgcaacctgatcaccttgagttctgagcagggactaggcttgcaggtgagataatgggccagggcacccagtccagaaggagcaatggcacctgggcagtgccagggcttaaagcccgctgctccttttcggtagaggagaggcccatcactggtgtggtggggtgggctctcccttaggcttgggcaaggcagccacctgcccttgctctcccttagtgttccctggcctccctgccatcaggttgctgggagtggagatggagggattattgagcagaaaatgagttggatggagataaacagctcccatccctgggtaatggatggtaagatgatggagattcctaagattggtggagttgggcaatgcatagccatctgactccttcagggtgctcttgatgggctggctgtaagggagactcagtcccagcctctcccctctacaactcctgccactgttggccatgtcgtaaggcagcagctgtgccaggatagctgggtccattcagagcaccttgagaagtgttgcagggaggtgttaagaagagaactctgtgcaaacagtgatggaaggctgttgtcttggtgtatcccttgcctcatagtcaatatattttttttttggcgagtcaccagtgacccgagccctccacaccagcctcctgtatctcatcaggtcccttctcagtactgtatttgctcagtgcatcaggaatgggtgtatgggtgtgtgtgggtgggtgtgagtgtgggtgtgtacgtaccaataaacaacctggttttaagacaatgtacaaa

SEQ ID NO: 171824 - DNA, 2967 bp, Homo sapiens
  Payload ID: 13765
  Gene Symbol: PPFIA4
  Gene Name: protein tyrosine phosphatase, receptor type, f polypeptide (PTPRF), interacting protein (liprin), alpha 4
  ENST ID: ENST00000600426
  CDS Start-End: 1-2860
cgtgactgaactcgaggaggacctgggcacggcccgccgggacctcatcaagtcggaggagctgagcagcaagcatcagcgggacctccgggaggctctggcccagaaggaggacatggaagagcggattactacactggagaagcgctacctggctgctcagcgtgaggcaacatccatccatgacctcaatgacaagctggagaatgagctggccaacaaggagtccctgcaccgccagtgtgaggagaaggcccgacacctgcaggagctgctggaggtggcagagcagaagctgcagcagacgatgcgcaaggcagagacgctgccagaggtggaggctgagctggcccagagaattgcagccctcaccaaggctgaagaacggcatggcaacattgaggagcacctgcggcagctggagggacagctggaggagaagaaccaggagctggcacgggtgcgccagcgggaaaagatgaatgaggaccacaacaagcggctgtcggacacagtggaccggctgctcagcgagtccaacgagcgtctgcagctccacctgaaggagcgcatggctgccctggaggagaagaacacgttgatccaggagttggagagctcccagcggcagattgaggagcagcaccaccacaagggccgcctgtctgaagagattgagaagctgcgccaagaggtggaccagctgaagggccgaggggggccgtttgtggatggcgtccactccaggtcgcacatgggcagtgcagcagacgtgcggttctccctgggcacaaccacacacgcacccccaggcgtgcatcgccgctactcggcattgagggaagagtctgccaaggactgggagacttctccactgcctgggatgctggccccggcagctggccctgcctttgacagtgaccctgagatctccgacgtggatgaggatgagccagggggtctggtgggctctgcggatgttgtctcccccagcggccactcagatgcccagaccctggccatgatgctgcaggagcagctggatgccatcaatgaggaaatcaggatgattcaggaagagaaggagtccacggagctccgcgcggaggagattgagacgcgtgtaaccagtggcagcatggaagccctaaacctgaagcagctgcgcaagcgtggttccatccccacctctctgacggccctgtccctggccagcgcgtccccaccactcagcggccgctccacacctaagctcacctcccgcagtgctgcccaggacctggaccgaatgggggtcatgaccctgcccagtgacttaagaaagcataggaggaagctgctgtcgccagtgtctcgggaagagaaccgagaggataaagccaccataaaatgtgagacttctcctccttcctcacccaggacgctgcggctagagaagcttggccacccagccctgagccaggaagaaggcaagagtgccttggaggatcagggcagcaaccccagcagcagcaacagcagccaggactccctgcacaagggcgccaagcgcaagggcatcaagtcgtccattggccgcctgtttgggaagaaggagaagggcaggctgatccagctgagtcgggatggagccacaggccatgttctgctaacagactccgaattcagtatgcaggagcctatggtgcctgccaagctggggacccaggcagagaaggaccggcggctaaagaagaaacaccagctgcttgaagatgcccgcaggaaaggaatgccctttgcccagtgggatggtcctactgtggtctcctggttggagctctgggtggggatgcctgcctggtatgtggcagcctgccgggccaacgtcaagagtggtgccatcatgtccgctctgtcggacacagagatccagcgggagatcggcatcagcaatgccctgcaccggctcaagctccgcctggccattcaggagatggtgtcattgaccagcccctctgccccacccacctccaggacttcttctgggaatgtctgggtcacccatgaagagatggaaactctggaaacatctactaaaacagacagtgaggagggcagctgggctcagaccctggcctatggggacatgaaccatgagtggattgggaatgaatggctacccagcctggggctcccgcagtaccgcagctacttcatggagtgcctggtggacgcccgcatgctggaccacctcaccaagaaggacctgcgggtccacctgaagatggtggacagcttccatcgaaccagtcttcagtatggcatcatgtgtctgaagaggctgaattatgaccggaaggagctggagaagaggcgagaggagagccagcatgagatcaaggatgtgttagtctggaccaacgaccaggtggttcattgggtccagtctattgggctccgggactacgcaggaaacctgcatgagagtggtgtgcatggagccttgctggccctggacgagaacttcgaccacaacacactggccctgatcctccagatccccacacagaacacccaggcacgccaagtgatggaaagagagttcaataacctgttggccttgggcacagaccggaagctggatgacggggatgacaaggtgtttcgccgcgcgccctcctggaggaagcgcttccggccgcgggagcaccacggtcgcggcggcatgctcagcgcttccgcggagaccctcccggcgggcttccgtgtgtccaccctggggaccctgcagcccccaccggccccgccaaagaagatcatgcctgaagctcactcccactatctctacggacacatgctctccgccttccgggactagccatggcccccagggctggcttcctccttctgggtttcacaggctcctctggccctgacccctcttgctcgttccccttccttccgcagctcctagtctcgtccgtg

SEQ ID NO: 171825 - DNA, 3178 bp, Homo sapiens
  Payload ID: 13765
  Gene Symbol: PPFIA4
  Gene Name: protein tyrosine phosphatase, receptor type, f polypeptide (PTPRF), interacting protein (liprin), alpha 4
  Uniprot ID: O75335
  ENST ID: ENST00000599966
  CDS Start-End: 537-2615
aggggtatgcctggcttgaattttaaccagggactcagtccagattatggggagacccgaggaaaagtgctgggtagaagaccaaaaaacaaagaccctcagagtgaaaagggcctctagacatcatcccttccaacatctcccagtgcctggagccctcctgcgccacgtgtgtcagatggccggagagcctctgctcgaatacctctttgatggggagctcaactttttaaaagccaccagttgcatcgtaagccaactcttgccattagaagatccttcttatgccagacggaaaaccgctctctggaactttctcccctggctcattctgacccctggagcaccagggcatacgtctgctctcttgcttacacggcagcccttcagacatttgtgacagctctgtgtcctgctaagatgtctcttctctgagctgaagatcccttgactctttgggcccactgggtgtgagctgggggtctcagtcctcagggcctgtcttttctctcccccatcaccgctcaaggtcgcacatgggcagtgcagcagacgtgcggttctccctgggcacaaccacacacgcacccccaggcgtgcatcgccgctactcggcattgagggaagagtctgccaaggactgggagacttctccactgcctgggatgctggccccggcagctggccctgcctttgacagtgaccctgagatctccgacgtggatgaggatgagccagggggtctggtgggctctgcggatgttgtctcccccagcggccactcagatgcccagaccctggccatgatgctgcaggagcagctggatgccatcaatgaggaaatcaggatgattcaggaagagaaggagtccacggagctccgcgcggaggagattgagacgcgtgtaaccagtggcagcatggaagccctaaacctgaagcagctgcgcaagcgtggttccatccccacctctctgacggccctgtccctggccagcgcgtccccaccactcagcggccgctccacacctaagctcacctcccgcagtgctgcccaggacctggaccgaatgggggtcatgaccctgcccagtgacttaagaaagcataggaggaagctgctgtcgccagtgtctcgggaagagaaccgagaggataaagccaccataaaatgtgagacttctcctccttcctcacccaggacgctgcggctagagaagcttggccacccagccctgagccaggaagaaggcaagagtgccttggaggatcagggcagcaaccccagcagcagcaacagcagccaggactccctgcacaagggcgccaagcgcaagggcatcaagtcgtccattggccgcctgtttgggaagaaggagaagggcaggctgatccagctgagtcgggatggagccacaggccatgttctgctaacagactccgaattcagtatgcaggagcctatggtgcctgccaagctggggacccaggcagagaaggaccggcggctaaagaagaaacaccagctgcttgaagatgcccgcaggaaaggaatgccctttgcccagtgggatggtcctactgtggtctcctggttggagctctgggtggggatgcctgcctggtatgtggcagcctgccgggccaacgtcaagagtggtgccatcatgtccgctctgtcggacacagagatccagcgggagatcggcatcagcaatgccctgcaccggctcaagctccgcctggccattcaggagatggtgtcattgaccagcccctctgccccacccacctccaggacttcttctgggaatgtctgggtcacccatgaagagatggaaactctggaaacatctactaaaacaaccctggcctatggggacatgaaccatgagtggattgggaatgaatggctacccagcctggggctcccgcagtaccgcagctacttcatggagtgcctggtggacgcccgcatgctggaccacctcaccaagaaggacctgcgggtccacctgaagatggtggacagcttccatcgaaccagtcttcagtatggcatcatgtgtctgaagaggctgaattatgaccggaaggagctggagaagaggcgagaggagagccagcatgagatcaaggatgtgttagtctggaccaacgaccaggtggttcattgggtccagtctattgggctccgggactacgcaggaaacctgcatgagagtggtgtgcatggagccttgctggccctggacgagaacttcgaccacaacacactggccctgatcctccagatccccacacagaacacccaggcacgccaagtgatggaaagagagttcaataacctgttggccttgggcacagaccggaagctggatgacggggatgacaaggtgtttcgccgcgcgccctcctggaggaagcgcttccggccgcgggagcaccacggtcgcggcggcatgctcagcgcttccgcggagaccctcccggcgggcttccgtgtgtccaccctggggaccctgcagcccccaccggccccgccaaagaagatcatgcctgaagctcactcccactatctctacggacacatgctctccgccttccgggactagccatggcccccagggctggcttcctccttctgggtttcacaggctcctctggccctgacccctcttgctcgttccccttccttccgcagctcctagtctcgtccgtgactttccggttgccctggatctcagaatatattcgtccaccccctcggcaccccattaccccgagtcccaccgtgtgtccgttgtaagtccggtggatgtggctggggtttcctggtattgtggaggcacccaggttgtccatgcttgggattctgggggaaggagagaagggcagctcagggtggatgtgaagccacccttcctcttctggacccagcctggtctgcactgcaacctccaccaggaccaggatcctgggccacaggctgggatggtccttccaagaaagggtcatttcagacgcagccctgcttgggctattcaatcttagggtgtctatccacgtctggctgtgccaaatggtctggcagctggttttggcatccccagcatcaccactctcccaacccatcaccgtgactgcagttcctgcccccattctcttggggtcaggg

SEQ ID NO: 171826 - DNA, 573 bp, Homo sapiens
  Payload ID: 13765
  Gene Symbol: PPFIA4
  Gene Name: protein tyrosine phosphatase, receptor type, f polypeptide (PTPRF), interacting protein (liprin), alpha 4
  ENST ID: ENST00000599514
  CDS Start-End: 1-573
tgctaaggactgggagacttctccactgcctgggatgctggccccggcagctggccctgcctttgacagtgaccctgagatctccgacgtggatgaggatgagccagggggtctggtgggctctgcggatgttgtctcccccagcggccactcagatgcccagaccctggccatgatgctgcaggagcagctggatgccatcaatgaggaaatcaggatgattcaggaagagaaggagtccacggagctccgcgcggaggagattgagacgcgtgtaaccagtggcagcatggaagccctaaacctgaagcagctgcgcaagcgtggttccatccccacctctctgacggccctgtccctggccagcgcgtccccaccactcagcggccgctccacacctaagctcacctcccgcagtgctgcccaggacctggaccgaatgggggtcatgaccctgcccagtgacttaagaaagcataggaggaagctgctggacgctgcggctagagaagcttggccacccagccctgagccaggaagaaggcaagagtgccttggaggatcagggcagca

SEQ ID NO: 171827 - DNA, 4650 bp, Homo sapiens
  Payload ID: 13766
  Gene Symbol: PTPRG
  Gene Name: protein tyrosine phosphatase, receptor type, G
  Uniprot ID: P23470
  ENST ID: ENST00000295874
  CDS Start-End: 378-4628
ctcaagttggggatcctcggctgctcgccgccgccgcccgcggtccctgcctgccccaggcccggggcatcgccgccggccgccgactccgcgccctgcccgatcggctctctcctttttaaacggaaagcagcctttctccgccgagaggatcgtccccagcgtggctctgcgttcccggtcactttttgagattttccggggggcgctcggcggcttcccggattccaaggggactcgggccgccgagcgcggggggcccgtggagcgggcgagccggggaagcgccccggcttagcggaggctcgcacggaggcaagaacttattcaacaagtttacctccctgctttcctcttttcgatgtgcgttttcggacatgcggaggttactggaaccgtgttggtggattttgttcctgaaaatcaccagttccgtgctccattatgtcgtgtgcttccccgcgttgacagaaggctacgttggggccctgcacgagaatagacacggcagcgcagtgcagatccgcaggcgcaaggcttcaggcgacccgtactgggcctactctggtgcctatggtcctgagcactgggtcacgtctagtgtcagctgtgggggccgtcaccagtctcctattgacattttagaccagtatgcgcgtgttggggaagaataccaggaactgcaactcgatggcttcgacaatgagtcttctaacaaaacctggatgaaaaacacagggaaaacagtcgccatccttctgaaagacgactattttgtcagtggagctggtctacctggcagattcaaagctgagaaggtggaatttcactggggccacagcaatggctcagcgggctctgaacacagcatcaatggcaggaggtttcctgttgagatgcagattttcttttacaatccagatgactttgacagctttcaaaccgcaatttctgagaacagaataatcggagccatggccatattttttcaagtcagtccgagggacaattctgcactggatcctattatccacgggttgaagggtgtcgtacatcatgagaaggagacctttctggatcctttcgtcctccgggacctcctgcctgcatccctgggcagctattatcggtacacaggttccttgaccacaccaccgtgtagcgaaatagtggagtggatagtcttccggagacccgtccccatctcttaccatcagcttgaggctttttattccatcttcaccacggagcagcaagaccatgtcaagtcggtggagtatctgagaaataactttcgaccacagcagcgtctgcatgacagggtggtgtccaagtccgccgtccgtgactcctggaaccacgacatgacagacttcttagaaaacccactggggacagaagcctctaaagtttgcagctctccacccatccacatgaaggtgcagcctctgaaccagacggcactgcaggtgtcctggagccagccggagactatctaccacccacccatcatgaactacatgatctcctacagctggaccaagaatgaggacgagaaggagaagacgtttacaaaggacagcgacaaagacttgaaagccaccattagccatgtctcacccgatagcctttacctgttccgagtccaggccgtgtgtcggaacgacatgcgcagcgactttagccagacgatgctgtttcaagctaataccactcgaatattccaagggaccagaatagtgaaaacaggagtgcccacagcgtctcctgcctcttcagccgacatggcccccatcagctcggggtcttctacctggacgtcctctggcatcccattctcatttgtttccatggcaactgggatgggcccctcctccagtggcagccaggccacagtggcctcggtggtcaccagcacgctgctcgccggcctggggttcggcggtggtggcatctcctctttccccagcactgtgtggcccacgcgcctcccgacggccgcctcagccagcaagcaggcggctaggccagtcctagccaccacagaggccttggcttctccagggcccgatggtgattcgtcaccaaccaaggacggcgagggcaccgaggaaggagagaaggatgagaaaagcgagagtgaggatggggagcgggagcacgaggaggatggagagaaggactccgaaaagaaggagaagagtggggtgacccacgctgccgaggagcggaatcagacggagcccagccccacaccctcgtctcctaacaggactgccgagggagggcatcagactatacctgggcatgagcaggatcacactgccgtccccacagaccagacgggcggaaggagggatgccggcccaggcctggaccccgacatggtcacctccacccaagtgccccccaccgccacagaggagcagtatgcagggagtgatcccaagaggcccgaaatgccatctaaaaagcctatgtcccgcggggaccgattttctgaagacagcagatttatcactgttaatccagcggaaaaaaacacctctggaatgataagccgccctgctccagggaggatggagtggatcatccctctgattgtggtatcagccttgaccttcgtgtgcctcatccttctcattgctgtgctcgtttactggagaaaatgttttcagactgctcatttctatgtggaagacagcagttcacctcgagtggtccctaatgaaagtatccctattattcctattccggatgacatggaagccattcctgtcaaacagtttgtcaaacacatcggtgagctctattctaataaccagcatgggttctctgaggattttgaggaagtccagcgctgtactgctgatatgaacatcactgcagagcattccaatcatccagaaaacaagcacaaaaacagatacatcaacattttagcatatgatcacagtagggtgaagttaagacctttaccaggaaaagactctaagcacagcgactacattaatgcaaactatgttgatggttacaacaaagcaaaagcctacattgccacccaaggacctttgaagtctacatttgaagatttctggaggatgatttgggaacaaaacactggaatcattgtgatgattacgaaccttgtggaaaaaggaagacgaaaatgtgatcagtattggccaacagagaacagtgaggaatatggaaacattattgtcacgctgaagagcacaaaaatacatgcctgctacactgttcgtcgtttttcaatcagaaatacaaaagtgaaaaagggtcagaagggaaatcccaagggtcgtcagaatgaaagggtagtgatccagtatcactatacacagtggcctgacatgggagttcccgagtatgcccttccagtactgactttcgtgaggagatcctcagcagctcggatgccagaaacgggccctgtgttggtgcactgcagtgctggtgtgggcagaacaggcacctatattgtaatagacagcatgctgcaacagataaaagacaaaagcacagttaacgtcctgggattcctgaagcatatcaggacacagcgtaactacctcgtccagactgaggagcagtacattttcatccatgatgccttgttggaagccattcttggaaaggagactgaagtatcttcaaatcagctgcacagctatgttaacagcatccttataccaggagtaggaggaaagacacgactggaaaagcaattcaagctggtcacacagtgtaatgcaaaatatgtggaatgtttcagtgctcagaaagagtgtaacaaagaaaagaacagaaactcttcagttgtgccatctgagcgtgctcgagtgggtcttgcaccattgcctggaatgaaaggaacagattacattaatgcttcttatatcatgggctattataggagcaatgaatttattataactcagcatcctctgccacatactacgaaagatttctggcgaatgatttgggatcataacgcacagatcattgtcatgctgccagacaaccagagcttggcagaagatgagtttgtgtactggccaagtcgagaagaatccatgaactgtgaggcctttaccgtcacccttatcagcaaagacagactgtgcctctctaatgaagaacaaattatcatccatgactttatccttgaagctacacaggatgactatgtcttagaagttcggcactttcagtgtcccaaatggcctaacccagatgcccccataagtagtacctttgaacttatcaacgtcatcaaggaagaggccttaacaagggatggtcccaccattgttcatgatgagtatggagcagtttcagcaggaatgttatgtgcccttaccaccctgtcccagcaactggagaatgaaaatgctgtggatgttttccaggttgcaaaaatgatcaatcttatgaggcctggagtattcacagacattgaacaataccagttcatctataaagcaatgcttagcttggtcagcactaaagaaaatggaaatggtcccatgacagtagacaaaaatggtgctgttcttattgcagatgaatcagaccctgctgagagcatggagtccctagtgtgactggaatcctgaaagggcactt

SEQ ID NO: 171828 - DNA, 9021 bp, Homo sapiens
  Payload ID: 13766
  Gene Symbol: PTPRG
  Gene Name: protein tyrosine phosphatase, receptor type, G
  Uniprot ID: P23470
  ENST ID: ENST00000474889
  CDS Start-End: 378-4715
ctcaagttggggatcctcggctgctcgccgccgccgcccgcggtccctgcctgccccaggcccggggcatcgccgccggccgccgactccgcgccctgcccgatcggctctctcctttttaaacggaaagcagcctttctccgccgagaggatcgtccccagcgtggctctgcgttcccggtcactttttgagattttccggggggcgctcggcggcttcccggattccaaggggactcgggccgccgagcgcggggggcccgtggagcgggcgagccggggaagcgccccggcttagcggaggctcgcacggaggcaagaacttattcaacaagtttacctccctgctttcctcttttcgatgtgcgttttcggacatgcggaggttactggaaccgtgttggtggattttgttcctgaaaatcaccagttccgtgctccattatgtcgtgtgcttccccgcgttgacagaaggctacgttggggccctgcacgagaatagacacggcagcgcagtgcagatccgcaggcgcaaggcttcaggcgacccgtactgggcctactctggtgcctatggtcctgagcactgggtcacgtctagtgtcagctgtgggggccgtcaccagtctcctattgacattttagaccagtatgcgcgtgttggggaagaataccaggaactgcaactcgatggcttcgacaatgagtcttctaacaaaacctggatgaaaaacacagggaaaacagtcgccatccttctgaaagacgactattttgtcagtggagctggtctacctggcagattcaaagctgagaaggtggaatttcactggggccacagcaatggctcagcgggctctgaacacagcatcaatggcaggaggtttcctgttgagatgcagattttcttttacaatccagatgactttgacagctttcaaaccgcaatttctgagaacagaataatcggagccatggccatattttttcaagtcagtccgagggacaattctgcactggatcctattatccacgggttgaagggtgtcgtacatcatgagaaggagacctttctggatcctttcgtcctccgggacctcctgcctgcatccctgggcagctattatcggtacacaggttccttgaccacaccaccgtgtagcgaaatagtggagtggatagtcttccggagacccgtccccatctcttaccatcagcttgaggctttttattccatcttcaccacggagcagcaagaccatgtcaagtcggtggagtatctgagaaataactttcgaccacagcagcgtctgcatgacagggtggtgtccaagtccgccgtccgtgactcctggaaccacgacatgacagacttcttagaaaacccactggggacagaagcctctaaagtttgcagctctccacccatccacatgaaggtgcagcctctgaaccagacggcactgcaggtgtcctggagccagccggagactatctaccacccacccatcatgaactacatgatctcctacagctggaccaagaatgaggacgagaaggagaagacgtttacaaaggacagcgacaaagacttgaaagccaccattagccatgtctcacccgatagcctttacctgttccgagtccaggccgtgtgtcggaacgacatgcgcagcgactttagccagacgatgctgtttcaagctaataccactcgaatattccaagggaccagaatagtgaaaacaggagtgcccacagcgtctcctgcctcttcagccgacatggcccccatcagctcggggtcttctacctggacgtcctctggcatcccattctcatttgtttccatggcaactgggatgggcccctcctccagtggcagccaggccacagtggcctcggtggtcaccagcacgctgctcgccggcctggggttcggcggtggtggcatctcctctttccccagcactgtgtggcccacgcgcctcccgacggccgcctcagccagcaagcaggcggctaggccagtcctagccaccacagaggccttggcttctccagggcccgatggtgattcgtcaccaaccaaggacggcgagggcaccgaggaaggagagaaggatgagaaaagcgagagtgaggatggggagcgggagcacgaggaggatggagagaaggactccgaaaagaaggagaagagtggggtgacccacgctgccgaggagcggaatcagacggagcccagccccacaccctcgtctcctaacaggactgccgagggagggcatcagactatacctgggcatgagcaggatcacactgccgtccccacagaccagacgggcggaaggagggatgccggcccaggcctggaccccgacatggtcacctccacccaagtgccccccaccgccacagaggagcagtatgcagggagtgatcccaagaggcccgaaatgccatctaaaaagcctatgtcccgcggggaccgattttctgaagacagcagatttatcactgttaatccagcggaaaaaaacacctctggaatgataagccgccctgctccagggaggatggagtggatcatccctctgattgtggtatcagccttgaccttcgtgtgcctcatccttctcattgctgtgctcgtttactggagagggtgtaacaaaataaagtccaagggctttcccagacgtttccgtgaagtgccttcttctggggagagaggagagaaggggagcagaaaatgttttcagactgctcatttctatgtggaagacagcagttcacctcgagtggtccctaatgaaagtatccctattattcctattccggatgacatggaagccattcctgtcaaacagtttgtcaaacacatcggtgagctctattctaataaccagcatgggttctctgaggattttgaggaagtccagcgctgtactgctgatatgaacatcactgcagagcattccaatcatccagaaaacaagcacaaaaacagatacatcaacattttagcatatgatcacagtagggtgaagttaagacctttaccaggaaaagactctaagcacagcgactacattaatgcaaactatgttgatggttacaacaaagcaaaagcctacattgccacccaaggacctttgaagtctacatttgaagatttctggaggatgatttgggaacaaaacactggaatcattgtgatgattacgaaccttgtggaaaaaggaagacgaaaatgtgatcagtattggccaacagagaacagtgaggaatatggaaacattattgtcacgctgaagagcacaaaaatacatgcctgctacactgttcgtcgtttttcaatcagaaatacaaaagtgaaaaagggtcagaagggaaatcccaagggtcgtcagaatgaaagggtagtgatccagtatcactatacacagtggcctgacatgggagttcccgagtatgcccttccagtactgactttcgtgaggagatcctcagcagctcggatgccagaaacgggccctgtgttggtgcactgcagtgctggtgtgggcagaacaggcacctatattgtaatagacagcatgctgcaacagataaaagacaaaagcacagttaacgtcctgggattcctgaagcatatcaggacacagcgtaactacctcgtccagactgaggagcagtacattttcatccatgatgccttgttggaagccattcttggaaaggagactgaagtatcttcaaatcagctgcacagctatgttaacagcatccttataccaggagtaggaggaaagacacgactggaaaagcaattcaagctggtcacacagtgtaatgcaaaatatgtggaatgtttcagtgctcagaaagagtgtaacaaagaaaagaacagaaactcttcagttgtgccatctgagcgtgctcgagtgggtcttgcaccattgcctggaatgaaaggaacagattacattaatgcttcttatatcatgggctattataggagcaatgaatttattataactcagcatcctctgccacatactacgaaagatttctggcgaatgatttgggatcataacgcacagatcattgtcatgctgccagacaaccagagcttggcagaagatgagtttgtgtactggccaagtcgagaagaatccatgaactgtgaggcctttaccgtcacccttatcagcaaagacagactgtgcctctctaatgaagaacaaattatcatccatgactttatccttgaagctacacaggatgactatgtcttagaagttcggcactttcagtgtcccaaatggcctaacccagatgcccccataagtagtacctttgaacttatcaacgtcatcaaggaagaggccttaacaagggatggtcccaccattgttcatgatgagtatggagcagtttcagcaggaatgttatgtgcccttaccaccctgtcccagcaactggagaatgaaaatgctgtggatgttttccaggttgcaaaaatgatcaatcttatgaggcctggagtattcacagacattgaacaataccagttcatctataaagcaatgcttagcttggtcagcactaaagaaaatggaaatggtcccatgacagtagacaaaaatggtgctgttcttattgcagatgaatcagaccctgctgagagcatggagtccctagtgtgactggaatcctgaaagggcacttaatttgtaaacttctgaagactgagaacttttttgaggccttttttgccagactctaggttatacaataacccagttacttttttacactgataaaagttttgatatttattttttgccattttatgtcttaatggtatcctactgagcatttgcacctctgttcatttcacacagtgaaacgcaattttacctagtttgcactatatgatcagtgttactgcctataatcttatacaacagcaaaccctgatgtgacattccatgacgacatacatgctacttttttttagttcaatacagtgaaggtctttgttatgacagtgaatattgcttttattattattattgctgaagtggttgcattctactagcaggcaatgctgtacttttcttcagtcctcctctcctttttattttaggcactgttcaatactgtatgccttctgtattttaatggagtggatagcattgttttcttttacagactagcaggctactgggacctaaaaaggtctgttaatgtcatggccttgaaacagttccatttatgctggttaagagatcccttaagaagttagaaggcttaagaactgcttcatgtgaacatcccttattagttacaaagttatattcacagttttttaaaaatgtgtcaaaataaaggataactctgtattacagctttcacagtagctatgtggacaatgtgttatttccattttgactctctaaaatagctacatcctaaaatcagggctatctttaacaatagcaagatagcaatattatatacaactcagttatgagaccctttagttattctccattaatgcttcttagtttgtaataccatacctcacagtaggtagaagaatgaaaacttctgcaggtgtgtaattttgaaactagtcctctaaaaattccctattactcctatagcaatctaataaaaactacctacatagttactgttttctttccttctttgccaaatgttttataataaatctcttaattacatacatttttctacttaagattaaattggaaatactgtcttagcaaaagtcttgggactatctaaactcccacacatagataaatctgatttggagagagaaatttaaaatatttaattaaaggtgatacccacattttcaagtttttaaaagagggagatggctttgtatgcttttgtgtagtttagaacagatacacattagtaaaagataccaataatcattagagctcaaggaagttattaggtgcagcctctggagccatactcacgctgcagtgcataatgggaaaattaggagcattaataagaaatttcagtagtgtttgtaaggaaaataagctacttactgagatctgtttcttctattgcatgtttgcttttgagggacagcttctgtcaaaagtgaaatcatcaccagaactgggcctgttaggaagaatagggttttatttactttttatgtcaattaacttcaacaaaaaggccacgctggctgctgtcatgccatctgggtatgcattaaacattaatgatgatcagcactgaggttctatttatcttgatttggctttcataaagtttgtcagaatggtgctggaggaccagaagtgctaaggagaaagaagctatgggccaagttaaagaatttgaatgcaaaggccaggtcaatggagttttcataaactacataatttaccagggtttatctcatcttctcaatacatagatttaacaacatggaatactctgcttttcaagagctgcgtaagctagtcctgagataagatgttcaagagagcatgctaagttgcatgtgctagatgagagacacctttacagcccctccgctccaaccagaggtgacacaggaagctctgtaaagttcaagtaaagcttgaacacaggaacactacaactgccagatgctgaggagaatcaggaaagcaatgagctagactctttttttagtcaattaagtgggttgttttagatgtatagagtattgatatgagttaacactttttagtagatggcaaagtgggcttgatgttcaaaagtaatgttcgagttagggttcatggtccctttctcagtaattttttcttaataaaagtaaacactggttcaaagacaaatagcaagtattccctcctgtgctatttatagagggctcaattcgtagaaaggcataccctccaatgcaattctgtggctgtcccttacagtggtttcagaatcacgaaaaaacagctagtaaataggatagaaacaataaaagaaagagtttagaagttccctgtgagcaatctgtgtgtcttcagcgagcttgaaccaaagtcttcatatcctgacccactgaattataagcaattgctacttgcccatcttgccaaagtagtccaaacacacttcaatgaggacagttatatttagcaggtcctcacccctgcaagagacagcatatcctcactattattattcatgtgttattggcaaaaacatagcttgcatctttccagaggcagagtttcaaagacagggttttctttgagacataagcacattgcttaagtacataacaaggttattaacacttgcactcaggggaaaggaaatagctattgcaaattaatgtgtgcaacttaataaaataagctgtttgtgtatatgaatttagctctaggtaagcaaaatgcacacatcatataaaaataaattgcaatgatcagaccaagtggctgtgctggacatcaaagaaaagacatgctgttgccatcaggagaactctttcttatatgcgatagccaagatatcttctttaatatgaaaaaagttaatttctgaatttcaaaaagagtaagattagctaattggtcttcctaatttttatgcctttagagtttttagtctattcaagtagaagagtccagcgaggccaaagaagggttacggtgttcaagttctggttgttggagtttttagcccagagtgacatactgaaatcagtaaataattattttataatgacacagcacaactgccttgttatgaatttttcttaaatgcatatatactgtatttaaaattaaaatatagataccaatttaccaaagatacatattactaattctaagcaaaactaaaaaaaaaacccaactcatcataatttaagaatcaaaatgtagtttgtcttaagaatttagtggttatactggaaatgcattttcaactcctatgttctaaagtttatgttcaaatggtgccagtgaatttttatatgaagggaaaatgcctgctttttttttttttttaacagatgtaatttcacttaaccctttgcgctttcccttagttgtcatttaacatacaatactggctttacttatctctagaaagaagaaggcatgctacaaataggaaggaattgtaataatgatatttggcctctactttgtcttagctgttaaactgtttttagtatttttgttaaatatttgcaaagggaagcattttctacagaggataattaatttcaagaaaaatatcttgagttttaagaaataaacatctccagaaaaggagaaagtcgattttataaaatgtcgcaactctccaacatttggggtagtgactccttttttgttaggacatttgaaactagcaagcagccattgtttctaaagaattctggcttcacattgactcatgtttctttcactccattttgaaatagctaaaaatcattaaaactgtaaatattttgttgcttgggtaagcatcttctgggaactttgtatctatggtatataatcatagaattttatattttcatataaagctaatttttttctagtttcaactccgtcatagttttttttcctttttgtggtggatatgtgaattcaactttctgtgtattgaagtagcaaaaaccatctttacattccaaaagaatccaacatgtgttatttctttgaggcagtgattgtgaaagttgggttttctttttaattccattgaccatttgtgcaataggaattagacataattagtcactgaaaacattcgtcacattgacccatttggaaaaagtgtgctttttttttttttttaaatttgttcagggggaggggttttgtaacctgaaatttttccctttttcttctgtttaaactatatcaaatcattctattatagtgttatttaatatgtaaattgtattgctatacataaaataaagtatggtttttgatgtattca

SEQ ID NO: 171829 - DNA, 5656 bp, Homo sapiens
  Payload ID: 13766
  Gene Symbol: PTPRG
  Gene Name: protein tyrosine phosphatase, receptor type, G
  ENST ID: ENST00000618938
  CDS Start-End: 1-4065
acaggtgcctatggtcctgagcactgggtcacgtctagtgtcagctgtgggggccgtcaccagtctcctattgacattttagaccagtatgcgcgtgttggggaagaataccaggaactgcaactcgatggcttcgacaatgagtcttctaacaaaacctggatgaaaaacacagggaaaacagtcgccatccttctgaaagacgactattttgtcagtggagctggtctacctggcagattcaaagctgagaaggtggaatttcactggggccacagcaatggctcagcgggctctgaacacagcatcaatggcaggaggtttcctgttgagatgcagattttcttttacaatccagatgactttgacagctttcaaaccgcaatttctgagaacagaataatcggagccatggccatattttttcaagtcagtccgagggacaattctgcactggatcctattatccacgggttgaagggtgtcgtacatcatgagaaggagacctttctggatcctttcgtcctccgggacctcctgcctgcatccctgggcagctattatcggtacacaggttccttgaccacaccaccgtgtagcgaaatagtggagtggatagtcttccggagacccgtccccatctcttaccatcagcttgaggctttttattccatcttcaccacggagcagcaagaccatgtcaagtcggtggagtatctgagaaataactttcgaccacagcagcgtctgcatgacagggtggtgtccaagtccgccgtccgtgactcctggaaccacgacatgacagacttcttagaaaacccactggggacagaagcctctaaagtttgcagctctccacccatccacatgaaggtgcagcctctgaaccagacggcactgcaggtgtcctggagccagccggagactatctaccacccacccatcatgaactacatgatctcctacagctggaccaagaatgaggacgagaaggagaagacgtttacaaaggacagcgacaaagacttgaaagccaccattagccatgtctcacccgatagcctttacctgttccgagtccaggccgtgtgtcggaacgacatgcgcagcgactttagccagacgatgctgtttcaagctaataccactcgaatattccaagggaccagaatagtgaaaacaggagtgcccacagcgtctcctgcctcttcagccgacatggcccccatcagctcggggtcttctacctggacgtcctctggcatcccattctcatttgtttccatggcaactgggatgggcccctcctccagtggcagccaggccacagtggcctcggtggtcaccagcacgctgctcgccggcctggggttcggcggtggtggcatctcctctttccccagcactgtgtggcccacgcgcctcccgacggccgcctcagccagcaagcaggcggctaggccagtcctagccaccacagaggccttggcttctccagggcccgatggtgattcgtcaccaaccaaggacggcgagggcaccgaggaaggagagaaggatgagaaaagcgagagtgaggatggggagcgggagcacgaggaggatggagagaaggactccgaaaagaaggagaagagtggggtgacccacgctgccgaggagcggaatcagacggagcccagccccacaccctcgtctcctaacaggactgccgagggagggcatcagactatacctgggcatgagcaggatcacactgccgtccccacagaccagacgggcggaaggagggatgccggcccaggcctggaccccgacatggtcacctccacccaagtgccccccaccgccacagaggagcagtatgcagggagtgatcccaagaggcccgaaatgccatctaaaaagcctatgtcccgcggggaccgattttctgaagacagcagatttatcactgttaatccagcggaaaaaaacacctctggaatgataagccgccctgctccagggaggatggagtggatcatccctctgattgtggtatcagccttgaccttcgtgtgcctcatccttctcattgctgtgctcgtttactggagaaaatgttttcagactgctcatttctatgtggaagacagcagttcacctcgagtggtccctaatgaaagtatccctattattcctattccggatgacatggaagccattcctgtcaaacagtttgtcaaacacatcggtgagctctattctaataaccagcatgggttctctgaggattttgaggaagtccagcgctgtactgctgatatgaacatcactgcagagcattccaatcatccagaaaacaagcacaaaaacagatacatcaacattttagcatatgatcacagtagggtgaagttaagacctttaccaggaaaagactctaagcacagcgactacattaatgcaaactatgttgatggttacaacaaagcaaaagcctacattgccacccaaggacctttgaagtctacatttgaagatttctggaggatgatttgggaacaaaacactggaatcattgtgatgattacgaaccttgtggaaaaaggaagacgaaaatgtgatcagtattggccaacagagaacagtgaggaatatggaaacattattgtcacgctgaagagcacaaaaatacatgcctgctacactgttcgtcgtttttcaatcagaaatacaaaagtgaaaaagggtcagaagggaaatcccaagggtcgtcagaatgaaagggtagtgatccagtatcactatacacagtggcctgacatgggagttcccgagtatgcccttccagtactgactttcgtgaggagatcctcagcagctcggatgccagaaacgggccctgtgttggtgcactgcagtgctggtgtgggcagaacaggcacctatattgtaatagacagcatgctgcaacagataaaagacaaaagcacagttaacgtcctgggattcctgaagcatatcaggacacagcgtaactacctcgtccagactgaggagcagtacattttcatccatgatgccttgttggaagccattcttggaaaggagactgaagtatcttcaaatcagctgcacagctatgttaacagcatccttataccaggagtaggaggaaagacacgactggaaaagcaattcaagctggtcacacagtgtaatgcaaaatatgtggaatgtttcagtgctcagaaagagtgtaacaaagaaaagaacagaaactcttcagttgtgccatctgagcgtgctcgagtgggtcttgcaccattgcctggaatgaaaggaacagattacattaatgcttcttatatcatgggctattataggagcaatgaatttattataactcagcatcctctgccacatactacgaaagatttctggcgaatgatttgggatcataacgcacagatcattgtcatgctgccagacaaccagagcttggcagaagatgagtttgtgtactggccaagtcgagaagaatccatgaactgtgaggcctttaccgtcacccttatcagcaaagacagactgtgcctctctaatgaagaacaaattatcatccatgactttatccttgaagctacacaggatgactatgtcttagaagttcggcactttcagtgtcccaaatggcctaacccagatgcccccataagtagtacctttgaacttatcaacgtcatcaaggaagaggccttaacaagggatggtcccaccattgttcatgatgagtatggagcagtttcagcaggaatgttatgtgcccttaccaccctgtcccagcaactggagaatgaaaatgctgtggatgttttccaggttgcaaaaatgatcaatcttatgaggcctggagtattcacagacattgaacaataccagttcatctataaagcaatgcttagcttggtcagcactaaagaaaatggaaatggtcccatgacagtagacaaaaatggtgctgttcttattgcagatgaatcagaccctgctgagagcatggagtccctagtgtgactggaatcctgaaagggcacttaatttgtaaacttctgaagactgagaacttttttgaggccttttttgccagactctaggttatacaataacccagttacttttttacactgataaaagttttgatatttattttttgccattttatgtcttaatggtatcctactgagcatttgcacctctgttcatttcacacagtgaaacgcaattttacctagtttgcactatatgatcagtgttactgcctataatcttatacaacagcaaaccctgatgtgacattccatgacgacatacatgctacttttttttagttcaatacagtgaaggtctttgttatgacagtgaatattgcttttattattattattgctgaagtggttgcattctactagcaggcaatgctgtacttttcttcagtcctcctctcctttttattttaggcactgttcaatactgtatgccttctgtattttaatggagtggatagcattgttttcttttacagactagcaggctactgggacctaaaaaggtctgttaatgtcatggccttgaaacagttccatttatgctggttaagagatcccttaagaagttagaaggcttaagaactgcttcatgtgaacatcccttattagttacaaagttatattcacagttttttaaaaatgtgtcaaaataaaggataactctgtattacagctttcacagtagctatgtggacaatgtgttatttccattttgactctctaaaatagctacatcctaaaatcagggctatctttaacaatagcaagatagcaatattatatacaactcagttatgagaccctttagttattctccattaatgcttcttagtttgtaataccatacctcacagtaggtagaagaatgaaaacttctgcaggtgtgtaattttgaaactagtcctctaaaaattccctattactcctatagcaatctaataaaaactacctacatagttactgttttctttccttctttgccaaatgttttataataaatctcttaattacatacatttttctacttaagattaaattggaaatactgtcttagcaaaagtcttgggactatctaaactcccacacatagataaatctgatttggagagagaaatttaaaatatttaattaaaggtgatacccacattttcaagtttttaaaagagggagatggctttgtatgcttttgtgtagtttagaacagatacacattagtaaaagataccaataatcattagagctcaaggaagttattaggtgcagcctctggagccatactcacgctgcagtgcataatgggaaaattaggagcattaataagaaatttcagtagtgtttgtaaggaaaataagctacttactgagatctgtttcttctattgcatgtttgcttttgagggacagcttctgtcaaaagtgaaatcatcaccagaactgggcctgttaggaagaatagggttttatttactttttatgtcaattaacttcaacaaaaaggccacgctggctgctgtcatgccatctgggtatgcattaaacattaatgatgatcagcactga

SEQ ID NO: 171830 - DNA, 5743 bp, Homo sapiens
  Payload ID: 13766
  Gene Symbol: PTPRG
  Gene Name: protein tyrosine phosphatase, receptor type, G
  ENST ID: ENST00000615556
  CDS Start-End: 1-4152
acaggtgcctatggtcctgagcactgggtcacgtctagtgtcagctgtgggggccgtcaccagtctcctattgacattttagaccagtatgcgcgtgttggggaagaataccaggaactgcaactcgatggcttcgacaatgagtcttctaacaaaacctggatgaaaaacacagggaaaacagtcgccatccttctgaaagacgactattttgtcagtggagctggtctacctggcagattcaaagctgagaaggtggaatttcactggggccacagcaatggctcagcgggctctgaacacagcatcaatggcaggaggtttcctgttgagatgcagattttcttttacaatccagatgactttgacagctttcaaaccgcaatttctgagaacagaataatcggagccatggccatattttttcaagtcagtccgagggacaattctgcactggatcctattatccacgggttgaagggtgtcgtacatcatgagaaggagacctttctggatcctttcgtcctccgggacctcctgcctgcatccctgggcagctattatcggtacacaggttccttgaccacaccaccgtgtagcgaaatagtggagtggatagtcttccggagacccgtccccatctcttaccatcagcttgaggctttttattccatcttcaccacggagcagcaagaccatgtcaagtcggtggagtatctgagaaataactttcgaccacagcagcgtctgcatgacagggtggtgtccaagtccgccgtccgtgactcctggaaccacgacatgacagacttcttagaaaacccactggggacagaagcctctaaagtttgcagctctccacccatccacatgaaggtgcagcctctgaaccagacggcactgcaggtgtcctggagccagccggagactatctaccacccacccatcatgaactacatgatctcctacagctggaccaagaatgaggacgagaaggagaagacgtttacaaaggacagcgacaaagacttgaaagccaccattagccatgtctcacccgatagcctttacctgttccgagtccaggccgtgtgtcggaacgacatgcgcagcgactttagccagacgatgctgtttcaagctaataccactcgaatattccaagggaccagaatagtgaaaacaggagtgcccacagcgtctcctgcctcttcagccgacatggcccccatcagctcggggtcttctacctggacgtcctctggcatcccattctcatttgtttccatggcaactgggatgggcccctcctccagtggcagccaggccacagtggcctcggtggtcaccagcacgctgctcgccggcctggggttcggcggtggtggcatctcctctttccccagcactgtgtggcccacgcgcctcccgacggccgcctcagccagcaagcaggcggctaggccagtcctagccaccacagaggccttggcttctccagggcccgatggtgattcgtcaccaaccaaggacggcgagggcaccgaggaaggagagaaggatgagaaaagcgagagtgaggatggggagcgggagcacgaggaggatggagagaaggactccgaaaagaaggagaagagtggggtgacccacgctgccgaggagcggaatcagacggagcccagccccacaccctcgtctcctaacaggactgccgagggagggcatcagactatacctgggcatgagcaggatcacactgccgtccccacagaccagacgggcggaaggagggatgccggcccaggcctggaccccgacatggtcacctccacccaagtgccccccaccgccacagaggagcagtatgcagggagtgatcccaagaggcccgaaatgccatctaaaaagcctatgtcccgcggggaccgattttctgaagacagcagatttatcactgttaatccagcggaaaaaaacacctctggaatgataagccgccctgctccagggaggatggagtggatcatccctctgattgtggtatcagccttgaccttcgtgtgcctcatccttctcattgctgtgctcgtttactggagagggtgtaacaaaataaagtccaagggctttcccagacgtttccgtgaagtgccttcttctggggagagaggagagaaggggagcagaaaatgttttcagactgctcatttctatgtggaagacagcagttcacctcgagtggtccctaatgaaagtatccctattattcctattccggatgacatggaagccattcctgtcaaacagtttgtcaaacacatcggtgagctctattctaataaccagcatgggttctctgaggattttgaggaagtccagcgctgtactgctgatatgaacatcactgcagagcattccaatcatccagaaaacaagcacaaaaacagatacatcaacattttagcatatgatcacagtagggtgaagttaagacctttaccaggaaaagactctaagcacagcgactacattaatgcaaactatgttgatggttacaacaaagcaaaagcctacattgccacccaaggacctttgaagtctacatttgaagatttctggaggatgatttgggaacaaaacactggaatcattgtgatgattacgaaccttgtggaaaaaggaagacgaaaatgtgatcagtattggccaacagagaacagtgaggaatatggaaacattattgtcacgctgaagagcacaaaaatacatgcctgctacactgttcgtcgtttttcaatcagaaatacaaaagtgaaaaagggtcagaagggaaatcccaagggtcgtcagaatgaaagggtagtgatccagtatcactatacacagtggcctgacatgggagttcccgagtatgcccttccagtactgactttcgtgaggagatcctcagcagctcggatgccagaaacgggccctgtgttggtgcactgcagtgctggtgtgggcagaacaggcacctatattgtaatagacagcatgctgcaacagataaaagacaaaagcacagttaacgtcctgggattcctgaagcatatcaggacacagcgtaactacctcgtccagactgaggagcagtacattttcatccatgatgccttgttggaagccattcttggaaaggagactgaagtatcttcaaatcagctgcacagctatgttaacagcatccttataccaggagtaggaggaaagacacgactggaaaagcaattcaagctggtcacacagtgtaatgcaaaatatgtggaatgtttcagtgctcagaaagagtgtaacaaagaaaagaacagaaactcttcagttgtgccatctgagcgtgctcgagtgggtcttgcaccattgcctggaatgaaaggaacagattacattaatgcttcttatatcatgggctattataggagcaatgaatttattataactcagcatcctctgccacatactacgaaagatttctggcgaatgatttgggatcataacgcacagatcattgtcatgctgccagacaaccagagcttggcagaagatgagtttgtgtactggccaagtcgagaagaatccatgaactgtgaggcctttaccgtcacccttatcagcaaagacagactgtgcctctctaatgaagaacaaattatcatccatgactttatccttgaagctacacaggatgactatgtcttagaagttcggcactttcagtgtcccaaatggcctaacccagatgcccccataagtagtacctttgaacttatcaacgtcatcaaggaagaggccttaacaagggatggtcccaccattgttcatgatgagtatggagcagtttcagcaggaatgttatgtgcccttaccaccctgtcccagcaactggagaatgaaaatgctgtggatgttttccaggttgcaaaaatgatcaatcttatgaggcctggagtattcacagacattgaacaataccagttcatctataaagcaatgcttagcttggtcagcactaaagaaaatggaaatggtcccatgacagtagacaaaaatggtgctgttcttattgcagatgaatcagaccctgctgagagcatggagtccctagtgtgactggaatcctgaaagggcacttaatttgtaaacttctgaagactgagaacttttttgaggccttttttgccagactctaggttatacaataacccagttacttttttacactgataaaagttttgatatttattttttgccattttatgtcttaatggtatcctactgagcatttgcacctctgttcatttcacacagtgaaacgcaattttacctagtttgcactatatgatcagtgttactgcctataatcttatacaacagcaaaccctgatgtgacattccatgacgacatacatgctacttttttttagttcaatacagtgaaggtctttgttatgacagtgaatattgcttttattattattattgctgaagtggttgcattctactagcaggcaatgctgtacttttcttcagtcctcctctcctttttattttaggcactgttcaatactgtatgccttctgtattttaatggagtggatagcattgttttcttttacagactagcaggctactgggacctaaaaaggtctgttaatgtcatggccttgaaacagttccatttatgctggttaagagatcccttaagaagttagaaggcttaagaactgcttcatgtgaacatcccttattagttacaaagttatattcacagttttttaaaaatgtgtcaaaataaaggataactctgtattacagctttcacagtagctatgtggacaatgtgttatttccattttgactctctaaaatagctacatcctaaaatcagggctatctttaacaatagcaagatagcaatattatatacaactcagttatgagaccctttagttattctccattaatgcttcttagtttgtaataccatacctcacagtaggtagaagaatgaaaacttctgcaggtgtgtaattttgaaactagtcctctaaaaattccctattactcctatagcaatctaataaaaactacctacatagttactgttttctttccttctttgccaaatgttttataataaatctcttaattacatacatttttctacttaagattaaattggaaatactgtcttagcaaaagtcttgggactatctaaactcccacacatagataaatctgatttggagagagaaatttaaaatatttaattaaaggtgatacccacattttcaagtttttaaaagagggagatggctttgtatgcttttgtgtagtttagaacagatacacattagtaaaagataccaataatcattagagctcaaggaagttattaggtgcagcctctggagccatactcacgctgcagtgcataatgggaaaattaggagcattaataagaaatttcagtagtgtttgtaaggaaaataagctacttactgagatctgtttcttctattgcatgtttgcttttgagggacagcttctgtcaaaagtgaaatcatcaccagaactgggcctgttaggaagaatagggttttatttactttttatgtcaattaacttcaacaaaaaggccacgctggctgctgtcatgccatctgggtatgcattaaacattaatgatgatcagcactga

SEQ ID NO: 171831 - DNA, 3343 bp, Homo sapiens
  Payload ID: 13767
  Gene Symbol: PTPRH
  Gene Name: protein tyrosine phosphatase, receptor type, H
  Uniprot ID: Q9HD43
  ENST ID: ENST00000263434
  CDS Start-End: 24-2837
ggtccccggcagtgtctggaggcatggctggggctggcgggggcctcggggtctgggggaacctggtgctgctgggcctgtgcagctggacaggggccagggcgcctgcccccaacccagggaggaacctgacagtggagactcagaccaccagctccatctccctgagctgggaggtccccgatggcctagactcacagaactccaactactgggttcagtgtactggagacggcggcacaacagagactcgaaacacaacagccaccaacgtcaccgtggatggccttggacccgggtcattgtatacgtgttctgtgtgggtggagaaagacggagtaaatagctctgtggggactgtcactactgccacagctcccaacccagtgagaaacctgacagtggaggctcagaccaacagctccatcgccctgacctgggaggtccccgatggcccagacccacagaactccacctacggggttgagtacactggagatggtggcagagcagggactcgaagcacagcacacaccaacatcaccgtggatagacttgaacccgggtgtttgtatgtgttttccgtgtgggtggggaagaatggaatcaacagctcccgggagactcgaaatgccaccacagcccccaacccagtgagaaacctccatatggagactcagaccaacagctccatcgccctatgctgggaagtccccgatggcccataccctcaggactacacctactgggtagagtacactggagacggtggtggcacagagacccgaaacacaacaaataccagtgtgacagctgagagacttgagcccggaaccttgtacacattctctgtatgggcagaaaaaaatggagcacgtggctccaggcagaatgtcagcatctccacagtccccaacgcagtgacaagcctcagcaagcaggactggaccaacagcaccattgctttgcgctggacagctccccagggcccaggccagtcttcctacagctactgggtctcatgggtcagggaaggcatgactgaccccaggacccaaagcacctcaggtactgacatcaccctaaaggaactggaagctggcagcctgtaccacctcaccgtctgggccgagaggaatgaggtcagaggctataacagcaccctcactgcagccactgctcccaatgaggtcacagatctccagaatgaaactcagactaagaactcagtcatgctgtggtggaaggcccctggagacccccactctcagttgtacgtatactgggtccagtgggccagcaagggacatccccggagggggcaagatccccaagcgaattgggtcaaccagaccagcaggaccaatgagacgtggtacaaagtggaggccctggaacccgggacgttgtacaatttcaccgtgtgggcagagaggaatgacgtagccagttccacgcagagcctctgtgcgtccacatacccagacacagtcaccatcacttcctgtgtcagcacctcagcgggctatggagtcaacttgatctggtcctgcccccagggaggctacgaggcctttgagttggaggtgggaggacagcggggctcccaggacagatcttcatgtggggaggctgtgtctgtgttgggtctcgggccggctcggtcctacccagccaccatcacgaccatctgggacggaatgaaggtcgtgtctcactctgtggtctgccacaccgagagtgcaggggtcattgccggagcctttgtgggcatcctcctgtttctcatcctcgtgggcctgctgattttcttcctgaagaggaggaataagaagaagcagcagaaaccagaactcagggatctggtctttagctccccaggggacatcccagctgaagacttcgctgaccacgtcaggaagaatgagagggacagcaactgtggttttgcagacgagtaccagcaactctccctggtgggccacagccagtctcagatggtggcttcggcttcagagaacaacgccaagaaccgctacagaaatgtgctgccctatgactggtcccgggtgcccctgaagcccatccatgaggagccaggctctgactacatcaatgccagcttcatgcccggtctctggagcccccaggagttcattgcaacccagggtcccctgccacagacagtgggtgacttctggcgcctggtgtgggaacagcagagccacaccctggtcatgctgaccaactgcatggaggccggccgggtgaagtgtgagcattactggcctctggactcgcagccctgcacccatgggcacctgcgggtaaccctggtaggtgaggaagtgatggagaactggacggtgcgggaactgctgctcctccaggtggaggagcagaagacactgtctgtgcgccaattccactaccaggcctggccggatcacggcgttccctcctccccagacaccttgctggctttctggaggatgcttcggcagtggctggatcagaccatggagggaggcccacccattgtgcactgcagtgctggcgtgggtcgcacaggaaccctcattgccctggacgtcctgctccggcagctgcagtccgagggtctccttgggcccttcagctttgtaaggaagatgagagagagtcggccgttgatggtgcagactgaggctcagtacgtattcctgcatcagtgcatcctgcggttcctccaacagtcagcccaggccccagccgagaaggaagtcccgtatgaggatgtcgaaaacctcatctacgagaacgtggccgccatccaggcccacaagttggaggtctaagtgacgagggggctgggtcggcagcccaggcatcctcaagctctggacacccacttgagcccagattcctggaagagcagagggctgggctcccagactcctgggtgctgtgggaggagggggctggtatcccaaactctggtttccccaggagagagtggtctggtgggcttcagatgagtcctatgggagctggggatctggattcctggttccctgaaggaggagagggatgatagcttggattccctaggtctttccaggatgcagaaagaaacaggctggggcctggattctgaggcaggaaggaatttgggtctggagttctggctacttgaggaccaaaggcaggaaggatcctgccttgattttacttcagaaaccaaatcagtcttctataatctggggtcggagggagtccctgtgcccaaggtctctctgcaccccaccatccacatgtatttttccttctatcccataatttattaaatcactgttctccccag

SEQ ID NO: 171832 - DNA, 3877 bp, Homo sapiens
  Payload ID: 13767
  Gene Symbol: PTPRH
  Gene Name: protein tyrosine phosphatase, receptor type, H
  Uniprot ID: Q9HD43
  ENST ID: ENST00000376350
  CDS Start-End: 24-3371
ggtccccggcagtgtctggaggcatggctggggctggcgggggcctcggggtctgggggaacctggtgctgctgggcctgtgcagctggacaggggccagggcgcctgcccccaacccagggaggaacctgacagtggagactcagaccaccagctccatctccctgagctgggaggtccccgatggcctagactcacagaactccaactactgggttcagtgtactggagacggcggcacaacagagactcgaaacacaacagccaccaacgtcaccgtggatggccttggacccgggtcattgtatacgtgttctgtgtgggtggagaaagacggagtaaatagctctgtggggactgtcactactgccacagctcccaacccagtgaggaacctgagagtggaggctcagaccaacagctccatcgccctgacctgggaggtccccgacggcccagacccacagaactccacctacggggttgagtacactggagatggtggcagagcagggactcgaagcacagcacacactaacatcaccgtggatggacttgaacccgggtgtttgtatgcgttttccatgtgggtgggaaagaatggaatcaacagctcccgggagactcgaaatgccaccacagctcacaacccagtgaggaacctgagagtggaggctcagaccaccagctccatctccctgagctgggaggtccccgatggcacagacccacagaactcgacctactgcgttcagtgcactggagatggtggcagaacagagactcgaaacacaacagacaccagagtcaccgtggatggccttggacccgggtcattgtatacgtgttctgtgtgggtggagaaagacggagtaaatagctctgtggagattgtcactagtgccacagctcccaacccagtgagaaacctgacagtggaggctcagaccaacagctccatcgccctgacctgggaggtccccgatggcccagacccacagaactccacctacggggttgagtacactggagatggtggcagagcagggactcgaagcacagcacacaccaacatcaccgtggatagacttgaacccgggtgtttgtatgtgttttccgtgtgggtggggaagaatggaatcaacagctcccgggagactcgaaatgccaccacagcccccaacccagtgagaaacctccatatggagactcagaccaacagctccatcgccctatgctgggaagtccccgatggcccataccctcaggactacacctactgggtagagtacactggagacggtggtggcacagagacccgaaacacaacaaataccagtgtgacagctgagagacttgagcccggaaccttgtacacattctctgtatgggcagaaaaaaatggagcacgtggctccaggcagaatgtcagcatctccacagtccccaacgcagtgacaagcctcagcaagcaggactggaccaacagcaccattgctttgcgctggacagctccccagggcccaggccagtcttcctacagctactgggtctcatgggtcagggaaggcatgactgaccccaggacccaaagcacctcaggtactgacatcaccctaaaggaactggaagctggcagcctgtaccacctcaccgtctgggccgagaggaatgaggtcagaggctataacagcaccctcactgcagccactgctcccaatgaggtcacagatctccagaatgaaactcagactaagaactcagtcatgctgtggtggaaggcccctggagacccccactctcagttgtacgtatactgggtccagtgggccagcaagggacatccccggagggggcaagatccccaagcgaattgggtcaaccagaccagcaggaccaatgagacgtggtacaaagtggaggccctggaacccgggacgttgtacaatttcaccgtgtgggcagagaggaatgacgtagccagttccacgcagagcctctgtgcgtccacatacccagacacagtcaccatcacttcctgtgtcagcacctcagcgggctatggagtcaacttgatctggtcctgcccccagggaggctacgaggcctttgagttggaggtgggaggacagcggggctcccaggacagatcttcatgtggggaggctgtgtctgtgttgggtctcgggccggctcggtcctacccagccaccatcacgaccatctgggacggaatgaaggtcgtgtctcactctgtggtctgccacaccgagagtgcaggggtcattgccggagcctttgtgggcatcctcctgtttctcatcctcgtgggcctgctgattttcttcctgaagaggaggaataagaagaagcagcagaaaccagaactcagggatctggtctttagctccccaggggacatcccagctgaagacttcgctgaccacgtcaggaagaatgagagggacagcaactgtggttttgcagacgagtaccagcaactctccctggtgggccacagccagtctcagatggtggcttcggcttcagagaacaacgccaagaaccgctacagaaatgtgctgccctatgactggtcccgggtgcccctgaagcccatccatgaggagccaggctctgactacatcaatgccagcttcatgcccggtctctggagcccccaggagttcattgcaacccagggtcccctgccacagacagtgggtgacttctggcgcctggtgtgggaacagcagagccacaccctggtcatgctgaccaactgcatggaggccggccgggtgaagtgtgagcattactggcctctggactcgcagccctgcacccatgggcacctgcgggtaaccctggtaggtgaggaagtgatggagaactggacggtgcgggaactgctgctcctccaggtggaggagcagaagacactgtctgtgcgccaattccactaccaggcctggccggatcacggcgttccctcctccccagacaccttgctggctttctggaggatgcttcggcagtggctggatcagaccatggagggaggcccacccattgtgcactgcagtgctggcgtgggtcgcacaggaaccctcattgccctggacgtcctgctccggcagctgcagtccgagggtctccttgggcccttcagctttgtaaggaagatgagagagagtcggccgttgatggtgcagactgaggctcagtacgtattcctgcatcagtgcatcctgcggttcctccaacagtcagcccaggccccagccgagaaggaagtcccgtatgaggatgtcgaaaacctcatctacgagaacgtggccgccatccaggcccacaagttggaggtctaagtgacgagggggctgggtcggcagcccaggcatcctcaagctctggacacccacttgagcccagattcctggaagagcagagggctgggctcccagactcctgggtgctgtgggaggagggggctggtatcccaaactctggtttccccaggagagagtggtctggtgggcttcagatgagtcctatgggagctggggatctggattcctggttccctgaaggaggagagggatgatagcttggattccctaggtctttccaggatgcagaaagaaacaggctggggcctggattctgaggcaggaaggaatttgggtctggagttctggctacttgaggaccaaaggcaggaaggatcctgccttgattttacttcagaaaccaaatcagtcttctataatctggggtcggagggagtccctgtgcccaaggtctctctgcaccccaccatccacatgtatttttccttctatcccataatttattaaatcactgttctccccag

SEQ ID NO: 171833 - DNA, 5122 bp, Homo sapiens
  Payload ID: 13768
  Gene Symbol: PTPRJ
  Gene Name: protein tyrosine phosphatase, receptor type, J
  Uniprot ID: Q12913
  ENST ID: ENST00000418331
  CDS Start-End: 353-4366
ccccagccgcatgacgcgcggaggaggcagcgggagcagccgcgggagccgggaccgggtagccgcgcgctgggggtgggcgccgctcgctccgccccgcgaagcccctgcgcgctcagggacgcggcccccccgcggcagccgcgctaggctccggcgtgtggccgcggccgccgccgccgctgccatgtctccggggaagcccggggcgggcggagcggggacgaggcggaccggctggcggaggaggaggcgaaggagacggcaggaggcggcgacgacggtgcccgggctcgggcgcacggcggggcccgattcgcgcgtccggggcacgttccagggcgcgcggggcatgaagccggcggcgcgggaggcgcggctgcctccgcgctcgcccgggctgcgctgggcgctgccgctgctgctgctgctgctgcgcctgggccagatcctgtgcgcaggtggcacccctagtccaattcctgacccttcagtagcaactgttgccacaggggaaaatggcataacgcagatcagcagtacagcagaatcctttcataaacagaatggaactggaacacctcaggtggaaacaaacaccagtgaggatggtgaaagctctggagccaacgatagtttaagaacacctgaacaaggatctaatgggactgatggggcatctcaaaaaactcccagtagcactgggcccagtcctgtgtttgacattaaagctgtttccatcagtccaaccaatgtgatcttaacttggaaaagtaatgacacagctgcttctgagtacaagtatgtagtaaagcataagatggaaaatgagaagacaattactgttgtgcatcaaccatggtgtaacatcacaggcttacgtccagcgacttcatatgtattctccatcactccaggaataggcaatgagacttggggagatcccagagtcataaaagtcatcacagagccgatcccagtttctgatctccgtgttgccctcacgggtgtgaggaaggctgctctctcctggagcaatggcaatggcactgcctcctgccgggttcttcttgaaagcattggaagccatgaggagttgactcaagactcaagacttcaggtcaatatctcgggcctgaagccaggggttcaatacaacatcaacccgtatcttctacaatcaaataagacaaagggagaccccttgggcacagaaggtggcttggatgccagcaatacagagagaagccgggcagggagccccaccgcccctgtgcatgatgagtccctcgtgggacctgtggacccatcctccggccagcagtcccgagacacggaagtcctgcttgtcgggttagagcctggcacccgatacaatgccaccgtttattcccaagcagcgaatggcacagaaggacagccccaggccatagagttcaggacaaatgctattcaggtttttgacgtcaccgctgtgaacatcagtgccacaagcctgaccctgatctggaaagtcagcgataacgagtcgtcatctaactatacctacaagatacatgtggcgggggagacagattcttccaatctcaacgtcagtgagcctcgcgctgtcatccccggactccgctccagcaccttctacaacatcacagtgtgtcctgtcctaggtgacatcgagggcacgccgggcttcctccaagtgcacaccccccctgttccagtttctgacttccgagtgacagtggtcagcacgacggagatcggcttagcatggagcagccatgatgcagaatcatttcagatgcatatcacacaggagggagctggcaattctcgggtagaaataaccaccaaccaaagtattatcattggtggcttgttccctggaaccaagtattgctttgaaatagttccaaaaggaccaaatgggactgaaggggcatctcggacagtttgcaatagaactgttcccagtgcagtgtttgacatccacgtggtctacgtcaccaccacggagatgtggctggactggaagagccctgacggtgcttccgagtatgtctaccatttagtcatagagtccaagcatggctctaaccacacaagcacgtatgacaaagcgattactctccagggcctgattccgggcaccttatataacatcaccatctctccagaagtggaccacgtctggggggaccccaactccactgcacagtacacacggcccagcaatgtgtccaacattgatgtaagtaccaacaccacagcagcaactttaagttggcagaactttgatgacgcctctcccacgtactcctactgccttcttattgagaaggctggaaattccagcaacgcaacacaagtagtcacggacattggaattactgacgctacagtcactgaattaatacctggctcatcatacacagtggagatctttgcacaagtaggggatgggatcaagtcactggaacctggccggaagtcattctgtacagatcctgcgtccatggcctccttcgactgcgaagtggtccccaaagagccagccctggttctcaaatggacctgccctcctggcgccaatgcaggctttgagctggaggtcagcagtggagcctggaacaatgcgacccacctggagagctgctcctctgagaatggcactgagtatagaacggaagtcacgtatttgaatttttctacctcgtacaacatcagcatcaccactgtgtcctgtggaaagatggcagcccccacccggaacacctgcactactggcatcacagatccccctcctccagatggatcccctaatattacatctgtcagtcacaattcagtaaaggtcaagttcagtggatttgaagccagccacggacccatcaaagcctatgctgtcattctcaccaccggggaagctggtcacccttctgcagatgtcctgaaatacacgtatgaggatttcaaaaagggagcctcagatacttatgtgacatacctcataagaacagaagaaaagggacgttctcagagcttgtctgaagttttgaaatatgaaattgacgttgggaatgagtcaaccacacttggttattacaatgggaagctggaacctctgggctcctaccgggcttgtgtggctggcttcaccaacattaccttccaccctcaaaacaaggggctcattgatggggctgagagctatgtgtccttcagtcgctactcagatgctgtttccttgccccaggatccaggtgtcatctgtggagcggtttttggctgtatctttggtgccctggttattgtgactgtgggaggcttcatcttctggagaaagaagaggaaagatgcaaagaataatgaagtgtccttttctcaaattaaacctaaaaaatctaagttaatcagagtggagaattttgaggcctacttcaagaagcagcaagctgactccaactgtgggttcgcagaggaatacgaagatctgaagcttgttggaattagtcaacctaaatatgcagcagaactggctgagaatagaggaaagaatcgctataataatgttctgccctatgatatttcccgtgtcaaactttcggtccagacccattcaacggatgactacatcaatgccaactacatgcctggctaccactccaagaaagattttattgccacacaaggacctttaccgaacactttgaaagatttttggcgtatggtttgggagaaaaatgtatatgccatcattatgttgactaaatgtgttgaacagggaagaaccaaatgtgaggagtattggccctccaagcaggctcaggactatggagacataactgtggcaatgacatcagaaattgttcttccggaatggaccatcagagatttcacagtgaaaaatatccagacaagtgagagtcaccctctgagacagttccatttcacctcctggccagaccacggtgttcccgacaccactgacctgctcatcaacttccggtacctcgttcgtgactacatgaagcagagtcctcccgaatcgccgattctggtgcattgcagtgctggggtcggaaggacgggcactttcattgccattgatcgtctcatctaccagatagagaatgagaacaccgtggatgtgtatgggattgtgtatgaccttcgaatgcataggcctttaatggtgcagacagaggaccagtatgttttcctcaatcagtgtgttttggatattgtcagatcccagaaagactcaaaagtagatcttatctaccagaacacaactgcaatgacaatctatgaaaaccttgcgcccgtgaccacatttggaaagaccaatggttacatcgcctaattccaaaggaataacctttctggagtgaaccagaccgtcgcacccacagcgaaggcacatgccccgatgtcgacatgtttttatatgtctaatatcttaattctttgttctgttttgtgagaactaattttgagggcatgaagctgcatatgatagatgacaaattggggctgtcgggggctgtggatgggtggggagcaaatcatctgcattcctgatgaccaatgggatgaggtcactttttttttttttcccccttgaggattgtggaaaaccaggaaaagggagctatgatttttttttccaaaacaatttcttttttaaaaaagactattttatatgattcacatgctaaagccaggattgtgttgggttgaatatattttaagtatcagaggtctatttttacctactgtgtcttggaatctagccgatggaaaatacctaattgtggatgatgattgcgcagggaggggtacgtggcacctcttccgaatgggttttctatttgaacatgtgccttttctgaattatgcttccacaggcaaaactcagtagagatctatatttttgtactgaatctcataattggaatatacggaatatttaaacagtagcttagcatcagaggtttgcttcctcagtaacatttctgttctcatttgatcaggggaggcctctttgccccgactccgcttcccctgccccctgtacatttgtgctccattttttcttcccttttccctcccagttttc

SEQ ID NO: 171834 - DNA, 3158 bp, Homo sapiens
  Payload ID: 13768
  Gene Symbol: PTPRJ
  Gene Name: protein tyrosine phosphatase, receptor type, J
  Uniprot ID: Q12913
  ENST ID: ENST00000440289
  CDS Start-End: 334-1953
ggaggaggcagcgggagcagccgcgggagccgggaccgggtagccgcgcgctgggggtgggcgccgctcgctccgccccgcgaagcccctgcgcgctcagggacgcggcccccccgcggcagccgcgctaggctccggcgtgtggccgcggccgccgccgccgctgccatgtctccggggaagcccggggcgggcggagcggggacgaggcggaccggctggcggaggaggaggcgaaggagacggcaggaggcggcgacgacggtgcccgggctcgggcgcacggcggggcccgattcgcgcgtccggggcacgttccagggcgcgcggggcatgaagccggcggcgcgggaggcgcggctgcctccgcgctcgcccgggctgcgctgggcgctgccgctgctgctgctgctgctgcgcctgggccagatcctgtgcgcaggtggcacccctagtccaattcctgacccttcagtagcaactgttgccacaggggaaaatggcataacgcagatcagcagtacagcagaatcctttcataaacagaatggaactggaacacctcaggtggaaacaaacaccagtgaggatggtgaaagctctggagccaacgatagtttaagaacacctgaacaaggatctaatgggactgatggggcatctcaaaaaactcccagtagcactgggcccagtcctgtgtttgacattaaagctgtttccatcagtccaaccaatgtgatcttaacttggaaaagtaatgacacagctgcttctgagtacaagtatgtagtaaagcataagatggaaaatgagaagacaattactgttgtgcatcaaccatggtgtaacatcacaggcttacgtccagcgacttcatatgtattctccatcactccaggaataggcaatgagacttggggagatcccagagtcataaaagtcatcacagagccgatcccagtttctgatctccgtgttgccctcacgggtgtgaggaaggctgctctctcctggagcaatggcaatggcactgcctcctgccgggttcttcttgaaagcattggaagccatgaggagttgactcaagactcaagacttcaggtcaatatctcgggcctgaagccaggggttcaatacaacatcaacccgtatcttctacaatcaaataagacaaagggagaccccttgggcacagaaggtggcttggatgccagcaatacagagagaagccgggcagggagccccaccgcccctgtgcatgatgagtccctcgtgggacctgtggacccatcctccggccagcagtcccgagacacggaagtcctgcttgtcgggttagagcctggcacccgatacaatgccaccgtttattcccaagcagcgaatggcacagaaggacagccccaggccatagagttcaggacaaatgctattcaggtttttgacgtcaccgctgtgaacatcagtgccacaagcctgaccctgatctggaaagtcagcgataacgagtcgtcatctaactatacctacaagatacatgtggcgggggagacagattcttccaatctcaacgtcagtgagcctcgcgctgtcatccccggactccgctccagcaccttctacaacatcacagtgtgtcctgtcctaggtgacatcgagggcacgccgggcttcctccaagtgcacaccccccctgttccagtttctgacttccgagtgacagtggtcagcacgacggagatcggcttagcatggagcagccatgatgcagaatcatttcagatgcatatcacacaggagggagctggcaattctcgggtagaaataaccaccaaccaaagtattatcattggtggcttgttccctggaaccaagtattgctttgaaatagttccaaaaggaccaaatgggactgaaggggcatctcggacagtttgcaatagaactggatgatttgaacacctgcctggaattccatcatctgaaacagagttggcagataagaatggcccctatgccaaatttggctcattgtctgtttttgtaaataaagttttattggatcacagccatgttcatttgcttatgtactgtctatggctactttggtgctagaattgagtagtggcagcagagaacgtgtggcttgtgaagcctgagatatttattttctggccattacagagaatgtttgctgacctctgggctagatcagtggttttcaaattgtggtccagggctctctagggatccctaggttctttcaaggggtctccaaggtagtattatcataacaatactaaaatgttatttggctttttcattctcattctcttttggagttttccaactttgatccgatatgggatgacattgtctctcaggtctaatggaatatatgctgtggattcttacattttaaaaatttcttcattttaaatccctgatatagtaaatattaataaatataacctatgtaaatacaaattctctgagagccttaataacttttaagatggtaaagaagtcctgagagcaaaaagtttaagaacctctggtcaagatgtgttagaaattaactactgtgctgtgttgggcaggtggactgttcacagtctttcctaaacaacactgtgatgagatactttgttagttctagaaggctaattgaaattgataaaatcattttatagtcagctacggtggcctgcacccatcgtcccagctacttgagaggctgcggcaggaggattgcttggcccaacagttgcagactagcaccagcctgggagaccctgtctcaaaaaaaaatttttttttatagaaacagtttaaattattaaattatttctaggcctacaggagaaacttctgggaaatcctagagagtaatgttcattattgttgttttaaaattttgaaataattgttttttggaaaggttgaaaaacatacagtcttccttgatctaagattcaagatagttgaaatcttttatacagagggtagaataaagatatacctaatgtaaatgatgagttaatgggtgcagcacaccaacatggcacatgtatacatatgtaacaaacctgcacgttgtgcacatgtaccctagaacttaaagtataataaaaacatatatatatatataaaagaaa

SEQ ID NO: 171835 - DNA, 546 bp, Homo sapiens
  Payload ID: 13768
  Gene Symbol: PTPRJ
  Gene Name: protein tyrosine phosphatase, receptor type, J
  ENST ID: ENST00000534219
  CDS Start-End: 187-546
gcggccgccgccgccgctgccatgtctccggggaagcccggggcgggcggagcggggacgaggcggaccggctggcggaggaggaggcgaaggagacggcaggaggcggcgacgacggtgcccgggctcgggcgcacggcggggcccgattcgcgcgtccggggcacgttccagggcgcgcggggcatgaagccggcggcgcgggaggcgcggctgcctccgcgctcgcccgggctgcgctgggcgctgccgctgctgctgctgctgctgcgcctgggccagatcctgtgcgcaggtggcaggcccagtcctgtgtttgacattaaagctgtttccatcagtccaaccaatgtgatcttaacttggaaaagtaatgacacagctgcttctgagtacaagtatgtagtaaagcataagatggaaaatgagaagacaattactgttgtgcatcaaccatggtgtaacatcacaggcttacgtccagcgacttcatatgtattctccatcactccaggaataggcaatgagacttggggagatcccaga

SEQ ID NO: 171836 - DNA, 626 bp, Homo sapiens
  Payload ID: 13768
  Gene Symbol: PTPRJ
  Gene Name: protein tyrosine phosphatase, receptor type, J
  ENST ID: ENST00000527952
  CDS Start-End: 187-626
gcggccgccgccgccgctgccatgtctccggggaagcccggggcgggcggagcggggacgaggcggaccggctggcggaggaggaggcgaaggagacggcaggaggcggcgacgacggtgcccgggctcgggcgcacggcggggcccgattcgcgcgtccggggcacgttccagggcgcgcggggcatgaagccggcggcgcgggaggcgcggctgcctccgcgctcgcccgggctgcgctgggcgctgccgctgctgctgctgctgctgcgcctgggccagatcctgtgcgcaggtggcacccctagtccaattcctgacccttcagtagcaactgttgccacaggggaaaatggcataacgcagatcagcagtacagcagaatcctttcataaacagaatggaactggaacacctcaggtggaaacaaacaccagtgaggatggtgaaagctctggagccaacgatagtttaagaacacctgaacaaggatctaatgggactgatggggcatctcaaaaaactcccagtagcactgagccgatcccagtttctgatctccgtgttgccctcacgggtgtgaggaaggctgctctctcctggagcaatggcaatggcactgcctc

SEQ ID NO: 171837 - DNA, 7851 bp, Homo sapiens
  Payload ID: 13768
  Gene Symbol: PTPRJ
  Gene Name: protein tyrosine phosphatase, receptor type, J
  ENST ID: ENST00000613246
  CDS Start-End: 356-4372
cagccccagccgcatgacgcgcggaggaggcagcgggagcagccgcgggagccgggaccgggtagccgcgcgctgggggtgggcgccgctcgctccgccccgcgaagcccctgcgcgctcagggacgcggcccccccgcggcagccgcgctaggctccggcgtgtggccgcggccgccgccgccgctgccatgtctccggggaagcccggggcgggcggagcggggacgaggcggaccggctggcggaggaggaggcgaaggagacggcaggaggcggcgacgacggtgcccgggctcgggcgcacggcggggcccgattcgcgcgtccggggcacgttccagggcgcgcggggcatgaagccggcggcgcgggaggcgcggctgcctccgcgctcgcccgggctgcgctgggcgctgccgctgctgctgctgctgctgcgcctgggccagatcctgtgcgcaggtggcacccctagtccaattcctgacccttcagtagcaactgttgccacaggggaaaatggcataacgcagatcagcagtacagcagaatcctttcataaacagaatggaactggaacacctcaggtggaaacaaacaccagtgaggatggtgaaagctctggagccaacgatagtttaagaacacctgaacaaggatctaatgggactgatggggcatctcaaaaaactcccagtagcactgggcccagtcctgtgtttgacattaaagctgtttccatcagtccaaccaatgtgatcttaacttggaaaagtaatgacacagctgcttctgagtacaagtatgtagtaaagcataagatggaaaatgagaagacaattactgttgtgcatcaaccatggtgtaacatcacaggcttacgtccagcgacttcatatgtattctccatcactccaggaataggcaatgagacttggggagatcccagagtcataaaagtcatcacagagccgatcccagtttctgatctccgtgttgccctcacgggtgtgaggaaggctgctctctcctggagcaatggcaatggcactgcctcctgccgggttcttcttgaaagcattggaagccatgaggagttgactcaagactcaagacttcaggtcaatatctcgggcctgaagccaggggttcaatacaacatcaacccgtatcttctacaatcaaataagacaaagggagaccccttgggcacagaaggtggcttggatgccagcaatacagagagaagccgggcagggagccccaccgcccctgtgcatgatgagtccctcgtgggacctgtggacccatcctccggccagcagtcccgagacacggaagtcctgcttgtcgggttagagcctggcacccgatacaatgccaccgtttattcccaagcagcgaatggcacagaaggacagccccaggccatagagttcaggacaaatgctattcaggtttttgacgtcaccgctgtgaacatcagtgccacaagcctgaccctgatctggaaagtcagcgataacgagtcgtcatctaactatacctacaagatacatgtggcgggggagacagattcttccaatctcaacgtcagtgagcctcgcgctgtcatccccggactccgctccagcaccttctacaacatcacagtgtgtcctgtcctaggtgacatcgagggcacgccgggcttcctccaagtgcacaccccccctgttccagtttctgacttccgagtgacagtggtcagcacgacggagatcggcttagcatggagcagccatgatgcagaatcatttcagatgcatatcacacaggagggagctggcaattctcgggtagaaataaccaccaaccaaagtattatcattggtggcttgttccctggaaccaagtattgctttgaaatagttccaaaaggaccaaatgggactgaaggggcatctcggacagtttgcaatagaactgttcccagtgcagtgtttgacatccacgtggtctacgtcaccaccacggagatgtggctggactggaagagccctgacggtgcttccgagtatgtctaccatttagtcatagagtccaagcatggctctaaccacacaagcacgtatgacaaagcgattactctccagggcctgattccgggcaccttatataacatcaccatctctccagaagtggaccacgtctggggggaccccaactccactgcacagtacacacggcccagcaatgtgtccaacattgatgtaagtaccaacaccacagcagcaactttaagttggcagaactttgatgacgcctctcccacgtactcctactgccttcttattgagaaggctggaaattccagcaacgcaacacaagtagtcacggacattggaattactgacgctacagtcactgaattaatacctggctcatcatacacagtggagatctttgcacaagtaggggatgggatcaagtcactggaacctggccggaagtcattctgtacagatcctgcgtccatggcctccttcgactgcgaagtggtccccaaagagccagccctggttctcaaatggacctgccctcctggcgccaatgcaggctttgagctggaggtcagcagtggagcctggaacaatgcgacccacctggagagctgctcctctgagaatggcactgagtatagaacggaagtcacgtatttgaatttttctacctcgtacaacatcagcatcaccactgtgtcctgtggaaagatggcagcccccacccggaacacctgcactactggcatcacagatccccctcctccagatggatcccctaatattacatctgtcagtcacaattcagtaaaggtcaagttcagtggatttgaagccagccacggacccatcaaagcctatgctgtcattctcaccaccggggaagctggtcacccttctgcagatgtcctgaaatacacgtatgaggatttcaaaaagggagcctcagatacttatgtgacatacctcataagaacagaagaaaagggacgttctcagagcttgtctgaagttttgaaatatgaaattgacgttgggaatgagtcaaccacacttggttattacaatgggaagctggaacctctgggctcctaccgggcttgtgtggctggcttcaccaacattaccttccaccctcaaaacaaggggctcattgatggggctgagagctatgtgtccttcagtcgctactcagatgctgtttccttgccccaggatccaggtgtcatctgtggagcggtttttggctgtatctttggtgccctggttattgtgactgtgggaggcttcatcttctggagaaagaagaggaaagatgcaaagaataatgaagtgtccttttctcaaattaagtctctcaaaagatctaagttaatcagagtggagaattttgaggcctacttcaagaagcagcaagctgactccaactgtgggttcgcagaggaatacgaagatctgaagcttgttggaattagtcaacctaaatatgcagcagaactggctgagaatagaggaaagaatcgctataataatgttctgccctatgatatttcccgtgtcaaactttcggtccagacccattcaacggatgactacatcaatgccaactacatgcctggctaccactccaagaaagattttattgccacacaaggacctttaccgaacactttgaaagatttttggcgtatggtttgggagaaaaatgtatatgccatcattatgttgactaaatgtgttgaacagggaagaaccaaatgtgaggagtattggccctccaagcaggctcaggactatggagacataactgtggcaatgacatcagaaattgttcttccggaatggaccatcagagatttcacagtgaaaaatatccagacaagtgagagtcaccctctgagacagttccatttcacctcctggccagaccacggtgttcccgacaccactgacctgctcatcaacttccggtacctcgttcgtgactacatgaagcagagtcctcccgaatcgccgattctggtgcattgcagtgctggggtcggaaggacgggcactttcattgccattgatcgtctcatctaccagatagagaatgagaacaccgtggatgtgtatgggattgtgtatgaccttcgaatgcataggcctttaatggtgcagacagaggaccagtatgttttcctcaatcagtgtgttttggatattgtcagatcccagaaagactcaaaagtagatcttatctaccagaacacaactgcaatgacaatctatgaaaaccttgcgcccgtgaccacatttggaaagaccaatggttacatcgcctaattccaaaggaataacctttctggagtgaaccagaccgtcgcacccacagcgaaggcacatgccccgatgtcgacatgtttttatatgtctaatatcttaattctttgttctgttttgtgagaactaattttgagggcatgaagctgcatatgatagatgacaaattggggctgtcgggggctgtggatgggtggggagcaaatcatctgcattcctgatgaccaatgggatgaggtcactttttttttttttcccccttgaggattgtggaaaaccaggaaaagggagctatgatttttttttccaaaacaatttcttttttaaaaaagactattttatatgattcacatgctaaagccaggattgtgttgggttgaatatattttaagtatcagaggtctatttttacctactgtgtcttggaatctagccgatggaaaatacctaattgtggatgatgattgcgcagggaggggtacgtggcacctcttccgaatgggttttctatttgaacatgtgccttttctgaattatgcttccacaggcaaaactcagtagagatctatatttttgtactgaatctcataattggaatatacggaatatttaaacagtagcttagcatcagaggtttgcttcctcagtaacatttctgttctcatttgatcaggggaggcctctttgccccgactccgcttcccctgccccctgtacatttgtgctccattttttcttcccttttccctcccagttttctccaaagactcttctgttggcaacattttcaacccattggttgggtgagaatggcgactcaaatatcaccttgagaatttctgtgggtgggaatgggagaagcagaggaatcctacagtggcagaaatccttttcttgtccctgtattatcctttttctcatgtctgtatttggtatgaaggattatttaaaggtgcaatatgtgaattagtgattcatgatgttctaggtttttagtaacgttttactcaggttggcattttatgtgtctgtgtctgtatgtgtgtgtgtatgttcagaagcgtggcaatctgtgaacacttcagcgtgaattcagtgtcagattaatccctccttccccaaagtccactggctttcgtctctctctgccgtgacacatatcggaatctactgtgtatatatatatatatatatatatatatatatatatatatatatatatacactaagctctcaaaaacagtcattcctatgaattgaggtgtacaaagtttgaatttgtatcaaagatgtaattattatttttaaaaccttttcactatactgctgctgtaattactttgatttttaaaatgtagattaatttttttttttttgcttcaggtgtgtatccaccaagaatttcaaatttatgtggatttattttattggtacataatctgtaaacttcttaaggcattaacatgaaaagattttttctttttattttatattgtggctcaggttatattttgaagatgttttgagtttatcctccaataggcaatgaagttgacaaggttttatgaaggaataaccaagtccctggagtcctgtggctgttgccacagtaatgtgtcctgctgtaaacaggacaggtgtgtcctgttgagaatgtgagcgggctcttccagcctcctggtccctcctgactctgccacgcccctcacctcactggcacttcgataactgactggacgtgttaatgggtcttttagggttctaaagggtgaaccacacttttaaagccccggctgtggttcggagggttagtgctgtatgccttttatttccctttccctttgaggtactgaaaggatgaaaaggtggtgtcatgttttggggagaatcttacttctcaaatggaaattgcactttttgctgaatcctttgcatttttttggtagtaagcagttcattgagtatcaggtcctcaaaggaatgagttggcccggctagggtgggccctcttgacctaacttcagagggggccttggctcagtaggtgtgaatcagggaagccacattgtcctcagggtgctgtatgaagctgggtgtgggcggattcctcccacaccttcacactggcctgcctccaactcatacagatctcggagcggtcggtacttcattcataggtccctgttcaggcagcagttctgtgggctgtggccctctcccctccaatatgtccgaaaccattgtgatgggtggcaaatcccagggagctcctaagccctgctctgcccacatcactgccacagagaagtcagaggaagggacttgttgctaaaaaatcctttaaaaggttaaatactttaaaagattaaagcaacataactgtaaacatattgtataaaaatgaaaaacacaggaaccctcttcccttccgcctggtgtgggcttgggaaatgggcaagcggccccagcaatcatgggaggaactcttgcgggggagcggtctgggattccaaatgggcaggtcacacgaaggtcacgatgcttctctgcatcctgaaaagggctggggacagggccagtgggggtggtaagggtatttatagcacagtgcttgaaaagggaagattaatgtgtaaatataaaggacacacaggctgggggttggtcagaggcaagaggagggtgcctctgagcttcaacccctcccaggaacaatgagctcaaattggaagagtccagtggaatcggggggatggtgtgagcacccctgttcagtctttgacaattgcatacagaaaagcagctggtatgggtttgggtgtcaatgaaagggccaaagactggtggccagctggtttgggggatttgggccattgatagcatctcccaggaacaacgactttttgcctccaaagttggatctagtgatgatcagcaccagcaggaaatgacatttggtgtctgcccactgcagccatactgtgacctccagccagacttccgcctaattgactccactggatttgtgctctgttgagtcagaggctcccgggggttggggatcgaggggcgggggtcagctatgcagcccatcacgtgtgtttttcatctgggatgaaaaagcctggttctcttttgaaatgcttgattgtacttattgagctaaacaagtcttggtgactgttgttgatttgcctcaaaagttttaagtcctgggttttcagactactgtgtagcagctgtgtgtttaacatactgtagctttttctcccttgggggcacatacaaataggatgtgttgatgtggactctaaactgtaattttcctgtaactattttggaatgatgcatatttctaatgtttgttatacttgtacagagtattgctgttggttgctttttttttttttaaggaaaaaatggcctgaaaacatttttttaaagacttacaaataccaaatataaaaaaatgtcaatgcatt

SEQ ID NO: 171838 - DNA, 4773 bp, Homo sapiens
  Payload ID: 13768
  Gene Symbol: PTPRJ
  Gene Name: protein tyrosine phosphatase, receptor type, J
  ENST ID: ENST00000615445
  CDS Start-End: 345-4373
gcatgacgcgcggaggaggcagcgggagcagccgcgggagccgggaccgggtagccgcgcgctgggggtgggcgccgctcgctccgccccgcgaagcccctgcgcgctcagggacgcggcccccccgcggcagccgcgctaggctccggcgtgtggccgcggccgccgccgccgctgccatgtctccggggaagcccggggcgggcggagcggggacgaggcggaccggctggcggaggaggaggcgaaggagacggcaggaggcggcgacgacggtgcccgggctcgggcgcacggcggggcccgattcgcgcgtccggggcacgttccagggcgcgcggggcatgaagccggcggcgcgggaggcgcggctgcctccgcgctcgcccgggctgcgctgggcgctgccgctgctgctgctgctgctgcgcctgggccagatcctgtgcgcaggtggcacccctagtccaattcctgacccttcagtagcaactgttgccacaggggaaaatggcataacgcagatcagcagtacagcagaatcctttcataaacagaatggaactggaacacctcaggtggaaacaaacaccagtgaggatggtgaaagctctggagccaacgatagtttaagaacacctgaacaaggatctaatgggactgatggggcatctcaaaaaactcccagtagcactgggcccagtcctgtgtttgacattaaagctgtttccatcagtccaaccaatgtgatcttaacttggaaaagtaatgacacagctgcttctgagtacaagtatgtagtaaagcataagatggaaaatgagaagacaattactgttgtgcatcaaccatggtgtaacatcacaggcttacgtccagcgacttcatatgtattctccatcactccaggaataggcaatgagacttggggagatcccagagtcataaaagtcatcacagagccgatcccagtttctgatctccgtgttgccctcacgggtgtgaggaaggctgctctctcctggagcaatggcaatggcactgcctcctgccgggttcttcttgaaagcattggaagccatgaggagttgactcaagactcaagacttcaggtcaatatctcgggcctgaagccaggggttcaatacaacatcaacccgtatcttctacaatcaaataagacaaagggagaccccttgggcacagaaggtggcttggatgccagcaatacagagagaagccgggcagggagccccaccgcccctgtgcatgatgagtccctcgtgggacctgtggacccatcctccggccagcagtcccgagacacggaagtcctgcttgtcgggttagagcctggcacccgatacaatgccaccgtttattcccaagcagcgaatggcacagaaggacagccccaggccatagagttcaggacaaatgctattcaggtttttgacgtcaccgctgtgaacatcagtgccacaagcctgaccctgatctggaaagtcagcgataacgagtcgtcatctaactatacctacaagatacatgtggcgggggagacagattcttccaatctcaacgtcagtgagcctcgcgctgtcatccccggactccgctccagcaccttctacaacatcacagtgtgtcctgtcctaggtgacatcgagggcacgccgggcttcctccaagtgcacaccccccctgttccagtttctgacttccgagtgacagtggtcagcacgacggagatcggcttagcatggagcagccatgatgcagaatcatttcagatgcatatcacacaggagggagctggcaattctcgggtagaaataaccaccaaccaaagtattatcattggtggcttgttccctggaaccaagtattgctttgaaatagttccaaaaggaccaaatgggactgaaggggcatctcggacagtttgcaatagaactgttcccagtgcagtgtttgacatccacgtggtctacgtcaccaccacggagatgtggctggactggaagagccctgacggtgcttccgagtatgtctaccatttagtcatagagtccaagcatggctctaaccacacaagcacgtatgacaaagcgattactctccagggcctgattccgggcaccttatataacatcaccatctctccagaagtggaccacgtctggggggaccccaactccactgcacagtacacacggcccagcaatgtgtccaacattgatgtaagtaccaacaccacagcagcaactttaagttggcagaactttgatgacgcctctcccacgtactcctactgccttcttattgagaaggctggaaattccagcaacgcaacacaagtagtcacggacattggaattactgacgctacagtcactgaattaatacctggctcatcatacacagtggagatctttgcacaagtaggggatgggatcaagtcactggaacctggccggaagtcattctgtacagatcctgcgtccatggcctccttcgactgcgaagtggtccccaaagagccagccctggttctcaaatggacctgccctcctggcgccaatgcaggctttgagctggaggtcagcagtggagcctggaacaatgcgacccacctggagagctgctcctctgagaatggcactgagtatagaacggaagtcacgtatttgaatttttctacctcgtacaacatcagcatcaccactgtgtcctgtggaaagatggcagcccccacccggaacacctgcactactggcatcacagatccccctcctccagatggatcccctaatattacatctgtcagtcacaattcagtaaaggtcaagttcagtggatttgaagccagccacggacccatcaaagcctatgctgtcattctcaccaccggggaagctggtcacccttctgcagatgtcctgaaatacacgtatgaggatttcaaaaagggagcctcagatacttatgtgacatacctcataagaacagaagaaaagggacgttctcagagcttgtctgaagttttgaaatatgaaattgacgttgggaatgagtcaaccacacttggttattacaatgggaagctggaacctctgggctcctaccggtgtcttctgagggcttgtgtggctggcttcaccaacattaccttccaccctcaaaacaaggggctcattgatggggctgagagctatgtgtccttcagtcgctactcagatgctgtttccttgccccaggatccaggtgtcatctgtggagcggtttttggctgtatctttggtgccctggttattgtgactgtgggaggcttcatcttctggagaaagaagaggaaagatgcaaagaataatgaagtgtccttttctcaaattaagtctctcaaaagatctaagttaatcagagtggagaattttgaggcctacttcaagaagcagcaagctgactccaactgtgggttcgcagaggaatacgaagatctgaagcttgttggaattagtcaacctaaatatgcagcagaactggctgagaatagaggaaagaatcgctataataatgttctgccctatgatatttcccgtgtcaaactttcggtccagacccattcaacggatgactacatcaatgccaactacatgcctggctaccactccaagaaagattttattgccacacaaggacctttaccgaacactttgaaagatttttggcgtatggtttgggagaaaaatgtatatgccatcattatgttgactaaatgtgttgaacagggaagaaccaaatgtgaggagtattggccctccaagcaggctcaggactatggagacataactgtggcaatgacatcagaaattgttcttccggaatggaccatcagagatttcacagtgaaaaatatccagacaagtgagagtcaccctctgagacagttccatttcacctcctggccagaccacggtgttcccgacaccactgacctgctcatcaacttccggtacctcgttcgtgactacatgaagcagagtcctcccgaatcgccgattctggtgcattgcagtgctggggtcggaaggacgggcactttcattgccattgatcgtctcatctaccagatagagaatgagaacaccgtggatgtgtatgggattgtgtatgaccttcgaatgcataggcctttaatggtgcagacagaggaccagtatgttttcctcaatcagtgtgttttggatattgtcagatcccagaaagactcaaaagtagatcttatctaccagaacacaactgcaatgacaatctatgaaaaccttgcgcccgtgaccacatttggaaagaccaatggttacatcgcctaattccaaaggaataacctttctggagtgaaccagaccgtcgcacccacagcgaaggcacatgccccgatgtcgacatgtttttatatgtctaatatcttaattctttgttctgttttgtgagaactaattttgagggcatgaagctgcatatgatagatgacaaattggggctgtcgggggctgtggatgggtggggagcaaatcatctgcattcctgatgaccaatgggatgaggtcactttttttttttttcccccttgaggattgtggaaaaccaggaaaagggagctatgatttttttttccaaaacaatttcttttttaaaaaagactattttatatgattcacatgctaaagccaggattgtgttgggttgaatatattttaagtatcagaggtc

SEQ ID NO: 171839 - DNA, 4758 bp, Homo sapiens
  Payload ID: 13769
  Gene Symbol: PTPRK
  Gene Name: protein tyrosine phosphatase, receptor type, K
  ENST ID: ENST00000368207
  CDS Start-End: 226-4644
tccgccgagcatggagagctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatgtgcctggtcccgtaccagtaaaatctcttcaaggaacatcctttgaaaataagatcttcttgaactggaaagaacctttggatccaaatggaatcatcactcaatatgagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcagctccaactttacctgactatgaaggagttgatgcctctctcaatgaaactgccaccacaataactgtattgttgagaccagcacaagccaaaggtgctcctatcagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagcagcagcaacagaagaaccagaagtgatcccagatcccgccaagcagacagacagagtggtgaaaatagcaggaattagtgctggaattttggtgttcatcctccttctcctagttgtcatattaattgtaaaaaagaggaggagctactattcttactcctactacctcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagattgcccaatgatccacttgtaccgactgctgtgttagttcctataacagatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatatttggctgtacagggatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttagttgggtgagactctttaaagtgcatccatgaagaaacctgtccatctattgagccagcagctgttgtacctgttacacttgtgcagaaagattttaatgtggggggtgggagac

SEQ ID NO: 171840 - DNA, 5025 bp, Homo sapiens
  Payload ID: 13769
  Gene Symbol: PTPRK
  Gene Name: protein tyrosine phosphatase, receptor type, K
  ENST ID: ENST00000368210
  CDS Start-End: 259-4635
gagcaaagtaactcttgactaacaggagcagcctccgccgagcatggagagctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatgtgcctggtcccgtaccagtaaaatctcttcaaggaacatcctttgaaaataagatcttcttgaactggaaagaacctttggatccaaatggaatcatcactcaatatgagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcagctccaactttacctgactatgaaggagttgatgcctctctcaatgaaactgccaccacaataactgtattgttgagaccagcacaagccaaaggtgctcctatcagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagcagcagcaacagaagaaccagaagtgatcccagatcccgccaagcagacagacagagtggtgaaaatagcaggaattagtgctggaattttggtgttcatcctccttctcctagttgtcatattaattgtaaaaaagagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagattgcccaatgatccacttgtaccgactgctgtgttagatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatatttggctgtacagggatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttagttgggtgagactctttaaagtgcatccatgaagaaacctgtccatctattgagccagcagctgttgtacctgttacacttgtgcagaaagattttaatgtggggggtgggagacttttacatttgagaggtaaaagtattttttttatgaagttgtgtatcttaataaaaaggactgaattagtttttattactatattaaagcatcaacatttcatgccacataaattatatttaataagaaccagattgaaatgagaacgtattggtgtttgtacagtgaacatgccaccttttttctcatggtttcagtagagcagctaccacatgttgcatgagttcatactttctacgtggcatttttctccctttctaaaatgaaagctgatga

SEQ ID NO: 171841 - DNA, 5816 bp, Homo sapiens
  Payload ID: 13769
  Gene Symbol: PTPRK
  Gene Name: protein tyrosine phosphatase, receptor type, K
  Uniprot ID: Q15262
  ENST ID: ENST00000368213
  CDS Start-End: 226-4566
tccgccgagcatggagagctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatgtgcctggtcccgtaccagtaaaatctcttcaaggaacatcctttgaaaataagatcttcttgaactggaaagaacctttggatccaaatggaatcatcactcaatatgagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcagctccaactttacctgactatgaaggagttgatgcctctctcaatgaaactgccaccacaataactgtattgttgagaccagcacaagccaaaggtgctcctatcagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagcagcagcaacagaagaaccagaagtgatcccagatcccgccaagcagacagacagagtggtgaaaatagcaggaattagtgctggaattttggtgttcatcctccttctcctagttgtcatattaattgtaaaaaagagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagatatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatatttggctgtacagggatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttagttgggtgagactctttaaagtgcatccatgaagaaacctgtccatctattgagccagcagctgttgtacctgttacacttgtgcagaaagattttaatgtggggggtgggagacttttacatttgagaggtaaaagtattttttttatgaagttgtgtatcttaataaaaaggactgaattagtttttattactatattaaagcatcaacatttcatgccacataaattatatttaataagaaccagattgaaatgagaacgtattggtgtttgtacagtgaacatgccaccttttttctcatggtttcagtagagcagctaccacatgttgcatgagttcatactttctacgtggcatttttctccctttctaaaatgaaagctgatgaatcttaaaaggaagaagaaaagaaaagctgtgcaaattcatagtaaagttcgttttttatatgtttccagtgtagcagatctctatataaatatataaatatatataactggcttattttcttttaatgtgcaatgatggctggatcatttaaagttctttttagaaaataacataagccaaagactcaagtgtaaatatgtctatatggagaaagcacattatatttattggttacttacattccttttttgatggctaaaatactaccaccacacaatcatcttttttttcctgaagaaagctttttctttagctaaaatcaattgtaaacgatttttgtagattattttttgtatgttttagtgtaagtagaagataaactttttattcataaaccaggaagcaatgttctttatagtgattctcttgtgtacatgcttgtgaattaaatttgtgtaaaatcccttggcaattgggtcttttaatataggaccaaattaaaacattttgctgaatatgtatagtttttcacaatttcattaggtaaataatggtttggtgatcatacatgagaaatgtacacattaaaaggccttgctgacaacttgcacaatgttgaacatagcctttaagcatcatttaaattttaaaggaatggagtttttcagcctgtggcccagcactggtcaagaaaacaagatggcaacatatatgctttcagggtcaaatttgagcaaactgtaaactgtcagggtgataaaatgtttctcttgatgtttacatgcacaagctttgcgttctgactataaaaagtgtgaacaaatcaatgccagattcctgttttgcgcattgtcatgg

SEQ ID NO: 171842 - DNA, 4651 bp, Homo sapiens
  Payload ID: 13769
  Gene Symbol: PTPRK
  Gene Name: protein tyrosine phosphatase, receptor type, K
  Uniprot ID: Q15262
  ENST ID: ENST00000368215
  CDS Start-End: 1-4320
atggatacgactgcggcggcggcgctgcctgcttttgtggcgctcttgctcctctctccttggcctctcctgggatcggcccaaggccagttctccgcaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatgtgcctggtcccgtaccagtaaaatctcttcaaggaacatcctttgaaaataagatcttcttgaactggaaagaacctttggatccaaatggaatcatcactcaatatgagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcagctccaactttacctgactatgaaggagttgatgcctctctcaatgaaactgccaccacaataactgtattgttgagaccagcacaagccaaaggtgctcctatcagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagcagcaacagaagaaccagaagtgatcccagatcccgccaagcagacagacagagtggtgaaaatagcaggaattagtgctggaattttggtgttcatcctccttctcctagttgtcatattaattgtaaaaaagagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagatatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttagttgggtgagactctttaaagtgcatccatgaagaaacctgtccatctattgagccagcagctgttgtacctgttacacttgtgcagaaagattttaatgtggggggtgggagacttttacatttgagaggtaaaagtattttttttatgaagttgtgtatcttaataaaaaggactgaattagtttttattactatattaaagcatcaacatttcatgccacataaattatatttaataagaaccagattgaaatgagaacgtattggtgtttgtacagtgaacatgccaccttttttctcatggtttcagtagagcagctaccacatgtt

SEQ ID NO: 171843 - DNA, 6087 bp, Homo sapiens
  Payload ID: 13769
  Gene Symbol: PTPRK
  Gene Name: protein tyrosine phosphatase, receptor type, K
  Uniprot ID: Q15262
  ENST ID: ENST00000368226
  CDS Start-End: 317-4639
agaagcgcccggagcccgcggggcgacgtcacccccggctccgcccccgtccctccccgagcaaagtaactcttgactaacaggagcagcctccgccgagcatggagagctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatgtgcctggtcccgtaccagtaaaatctcttcaaggaacatcctttgaaaataagatcttcttgaactggaaagaacctttggatccaaatggaatcatcactcaatatgagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcagctccaactttacctgactatgaaggagttgatgcctctctcaatgaaactgccaccacaataactgtattgttgagaccagcacaagccaaaggtgctcctatcagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagcagcagcaacagaagaaccagaagtgatcccagatcccgccaagcagacagacagagtggtgaaaatagcaggaattagtgctggaattttggtgttcatcctccttctcctagttgtcatattaattgtaaaaaagagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagatatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttagttgggtgagactctttaaagtgcatccatgaagaaacctgtccatctattgagccagcagctgttgtacctgttacacttgtgcagaaagattttaatgtggggggtgggagacttttacatttgagaggtaaaagtattttttttatgaagttgtgtatcttaataaaaaggactgaattagtttttattactatattaaagcatcaacatttcatgccacataaattatatttaataagaaccagattgaaatgagaacgtattggtgtttgtacagtgaacatgccaccttttttctcatggtttcagtagagcagctaccacatgttgcatgagttcatactttctacgtggcatttttctccctttctaaaatgaaagctgatgaatcttaaaaggaagaagaaaagaaaagctgtgcaaattcatagtaaagttcgttttttatatgtttccagtgtagcagatctctatataaatatataaatatatataactggcttattttcttttaatgtgcaatgatggctggatcatttaaagttctttttagaaaataacataagccaaagactcaagtgtaaatatgtctatatggagaaagcacattatatttattggttacttacattccttttttgatggctaaaatactaccaccacacaatcatcttttttttcctgaagaaagctttttctttagctaaaatcaattgtaaacgatttttgtagattattttttgtatgttttagtgtaagtagaagataaactttttattcataaaccaggaagcaatgttctttatagtgattctcttgtgtacatgcttgtgaattaaatttgtgtaaaatcccttggcaattgggtcttttaatataggaccaaattaaaacattttgctgaatatgtatagtttttcacaatttcattaggtaaataatggtttggtgatcatacatgagaaatgtacacattaaaaggccttgctgacaacttgcacaatgttgaacatagcctttaagcatcatttaaattttaaaggaatggagtttttcagcctgtggcccagcactggtcaagaaaacaagatggcaacatatatgctttcagggtcaaatttgagcaaactgtaaactgtcagggtgataaaatgtttctcttgatgtttacatgcacaagctttgcgttctgactataaaaagtgtgaacaaatcaatgccagattcctgttttgcgcattgtcatgggattcttaagtgaacctttctaaatgtggtcttgttcacatgctccacgtagctgtaacttcacatcatcagcttgcagtttgtaattgactaaagcattccagtgtcctctttctagattgccagctcatgacatggtgcttataaagatttaattaaagtaagaatgaaataaagtttttataattataacagtta

SEQ ID NO: 171844 - DNA, 1456 bp, Homo sapiens
  Payload ID: 13769
  Gene Symbol: PTPRK
  Gene Name: protein tyrosine phosphatase, receptor type, K
  ENST ID: ENST00000392449
  CDS Start-End: 208-441
ctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcagtgtctgtgcttgtggtcggtaacttttgctgctgttgttctgctgctgtctgccattccattcgccatctatcacgcacacagaaccctggccaggatcatgaagggcgattgaaaaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatcatctgtacttttctggtgtatgttttgatgtcatcagttctcactatatgtgtaatacatagatgtaaatatgcatctcatggtaatgagagattgccctcttgcctcccccacccccattattggggaagtgtcatacatagatatacatatgcatcccatggtaatgagagattgcccctctttcttccccaccctgttgatgaggaagtgtttggagacattggcacaaaaccttcaaactagagaaagtatttctatgtgttaaaataagtttaggtccaaaatttgttggtggtttgacaaagagctacttattgacagattctttcctacagctttgttcaggaagaaatagcctttttgagtttattgtaatcttcagactggactgatttactgactttttgaaagtaacatttgggaaataaatgtgatgtagagtttcatgaactatgttaagggggaggcattttcattaattattttaattttgattaattaattgaataaattaaatgacatataaaaataagccaaaaaggataagttattcacaaagctttggatgtttgtttcagaaatgattcattgaattatgattaaatcagacaatcaatagtgtcagta

SEQ ID NO: 171845 - DNA, 1029 bp, Homo sapiens
  Payload ID: 13769
  Gene Symbol: PTPRK
  Gene Name: protein tyrosine phosphatase, receptor type, K
  ENST ID: ENST00000415046
  CDS Start-End: 1-1029
caaaagcagcagcaacagaagaaccagaagtgatcccagatcccgccaagcagacagacagagtggtgaaaatagcaggaattagtgctggaattttggtgttcatcctccttctcctagttgtcatattaattgtaaaaaagaggaggagctactattcttactcctactacctcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagattgcccaatgatccacttgtaccgactgctgtgttagatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctg

SEQ ID NO: 171846 - DNA, 782 bp, Homo sapiens
  Payload ID: 13769
  Gene Symbol: PTPRK
  Gene Name: protein tyrosine phosphatase, receptor type, K
  ENST ID: ENST00000415055
  CDS Start-End: 1-782
tggagaagacacatctgcattagaaacattaggaggagctactattcttactcctactacctcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagattgcccaatgatccacttgtaccgactgctgtgttagttcctataacagatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctga

SEQ ID NO: 171847 - DNA, 2515 bp, Homo sapiens
  Payload ID: 13769
  Gene Symbol: PTPRK
  Gene Name: protein tyrosine phosphatase, receptor type, K
  ENST ID: ENST00000531050
  CDS Start-End: 1-63
gtgcatgttagtgctcaagagcctcattatctaccacccgagatgccccaaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatgtgcctggtcccgtaccagtaaaatctcttcaaggaacatcctttgaaaataagatcttcttgaactggaaagaacctttggatccaaatggaatcatcactcaatatgagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcagctccaactttacctgactatgaaggagttgatgcctctctcaatgaaactgccaccacaataactgtattgttgagaccagcacaagccaaaggtgctcctatcagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagcagcagcaacagaagaaccagaagtgatcccagatcccgccaagcagacagacagagtggtgaaaatagcaggaattagtgctggaattttggtgttcatcctccttctcctagttgtcatattaattgtaaaaaagagatatatatgttggagaagacacatctgcattagaaacattaggaggagctactattcttactcctactacctcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagattgcccaatgatccacttgtaccgactgctgtgttagttcctataacaggaagaaaaaatgtttatcatggggacaacaattcattttttgctatatcctatttgtagagttggtgatagaacaggcaaatgtactagcacttgaaatatgtttatctgttaattaaatatcattctctacagtatgcattatcattaaaaaaaaagttcccctaagagtgtattttctcttctgttaatgagtatgacggtataatgcttttcaaagtaacaccccttaaaacatttgtttttttttttaagtggtaagtttaaatgtgataaatatgagcatgcttctcgttgtaatgtttagtacttcggtcattaaagtactgtttattcttcataggc

SEQ ID NO: 171848 - DNA, 5757 bp, Homo sapiens
  Payload ID: 13769
  Gene Symbol: PTPRK
  Gene Name: protein tyrosine phosphatase, receptor type, K
  Uniprot ID: Q15262
  ENST ID: ENST00000532331
  CDS Start-End: 119-4507
ggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatgtgcctggtcccgtaccagtaaaatctcttcaaggaacatcctttgaaaataagatcttcttgaactggaaagaacctttggatccaaatggaatcatcactcaatatgagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcagctccaactttacctgactatgaaggagttgatgcctctctcaatgaaactgccaccacaataactgtattgttgagaccagcacaagccaaaggtgctcctatcagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagcagcagcaacagaagaaccagaagtgatcccagatcccgccaagcagacagacagagtggtgaaaatagcaggaattagtgctggaattttggtgttcatcctccttctcctagttgtcatattaattgtaaaaaagagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagattgcccaatgatccacttgtaccgactgctgtgttagttcctataacagatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatatttggctgtacagggatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttagttgggtgagactctttaaagtgcatccatgaagaaacctgtccatctattgagccagcagctgttgtacctgttacacttgtgcagaaagattttaatgtggggggtgggagacttttacatttgagaggtaaaagtattttttttatgaagttgtgtatcttaataaaaaggactgaattagtttttattactatattaaagcatcaacatttcatgccacataaattatatttaataagaaccagattgaaatgagaacgtattggtgtttgtacagtgaacatgccaccttttttctcatggtttcagtagagcagctaccacatgttgcatgagttcatactttctacgtggcatttttctccctttctaaaatgaaagctgatgaatcttaaaaggaagaagaaaagaaaagctgtgcaaattcatagtaaagttcgttttttatatgtttccagtgtagcagatctctatataaatatataaatatatataactggcttattttcttttaatgtgcaatgatggctggatcatttaaagttctttttagaaaataacataagccaaagactcaagtgtaaatatgtctatatggagaaagcacattatatttattggttacttacattccttttttgatggctaaaatactaccaccacacaatcatcttttttttcctgaagaaagctttttctttagctaaaatcaattgtaaacgatttttgtagattattttttgtatgttttagtgtaagtagaagataaactttttattcataaaccaggaagcaatgttctttatagtgattctcttgtgtacatgcttgtgaattaaatttgtgtaaaatcccttggcaattgggtcttttaatataggaccaaattaaaacattttgctgaatatgtatagtttttcacaatttcattaggtaaataatggtttggtgatcatacatgagaaatgtacacattaaaaggccttgctgacaacttgcacaatgttgaacatagcctttaagcatcatttaaattttaaaggaatggagtttttcagcctgtggcccagcactggtcaagaaaacaagatggcaacatatatgctttcagggtcaaatttgagcaaactgtaaactgtcagggtgataaaatgtttctcttgatgtttacatgcacaagctttgcgttctgactataaaaagtgtgaacaaatcaatgccagattcctgttttgcgcattgtcatgg

SEQ ID NO: 171849 - DNA, 612 bp, Homo sapiens
  Payload ID: 13769
  Gene Symbol: PTPRK
  Gene Name: protein tyrosine phosphatase, receptor type, K
  ENST ID: ENST00000490332
  CDS Start-End: 1-612
tgaatcctggcactttgaacatattagttagggtgaataaaggacctcttgccaatccaatttggaatgtgactggattcacgggtagagattggcttcgggctgagctagcagtgagcaccttttggcccaatgaatatcagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcag

SEQ ID NO: 171850 - DNA, 1722 bp, Homo sapiens
  Payload ID: 13769
  Gene Symbol: PTPRK
  Gene Name: protein tyrosine phosphatase, receptor type, K
  ENST ID: ENST00000525459
  CDS Start-End: 230-976
agcctccgccgagcatggagagctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatcatctgtacttttctggtgtatgttttgatgtcatcagttctcactatatgtgtaatacatagatgtaaatatgcatctcatggtaatgagagattgccctcttgcctcccccacccccattattggggaagtgtcatacatagatatacatatgcatcccatggtaatgagagattgcccctctttcttccccaccctgttgatgaggaagtgtttggagacattggcacaaaaccttcaaactagagaaagtatttctatgtgttaaaataagtttaggtccaaaatttgttggtggtttgacaaagagctacttattgacagattctttcctacagctttgttcaggaagaaatagcctttttgagtttattgtaatcttcagactggactgatttactgactttttgaaagtaacatttgggaaataaatgtgatgtagagtttcatgaactatgttaagggggaggcattttcattaattattttaattttgattaattaattgaataaattaaatgacatataaaaataagccaaaaaggataagttattcacaaagctttggatgtttgtttcagaaatgattcattgaattatgattaaatcagacaatcaatagtgtcagtacccactttatgattctgtgactgagtttatatgctcttaacaaaaaaaaggttcatttactagtttggagagtttgttcagtaaccctcactatgaggttccgtccctggatgctgttatttctttaaaaggtcaattttgtgttagaccttgagatttaaacttttaaaggacttgtttatttgtagcttattataaagcctaaagagaatacatttatgtaaaagtatattttatgatggtcagcaagcaatatataaactaatagttttatttctgccttttaaaaatgaattatgtctttaagttaggtttgtctttattcttgaaggggaaaaaagaaatgctttgctttaattgct

SEQ ID NO: 171851 - DNA, 563 bp, Homo sapiens
  Payload ID: 13769
  Gene Symbol: PTPRK
  Gene Name: protein tyrosine phosphatase, receptor type, K
  ENST ID: ENST00000532751
  CDS Start-End: 242-361
actaacaggagcagcctccgccgagcatggagagctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcagaaaaggcctgcagttactgaaatgacaagtgaaaaggaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagc

SEQ ID NO: 171852 - DNA, 5757 bp, Homo sapiens; identical to SEQ ID NO: 171848
  Payload ID: 13769
  Gene Symbol: PTPRK
  Gene Name: protein tyrosine phosphatase, receptor type, K
  Uniprot ID: Q15262
  ENST ID: ENST00000619256
  CDS Start-End: 119-4507

SEQ ID NO: 171853 - DNA, 1456 bp, Homo sapiens; identical to SEQ ID NO: 171844
  Payload ID: 13769
  Gene Symbol: PTPRK
  Gene Name: protein tyrosine phosphatase, receptor type, K
  ENST ID: ENST00000621720
  CDS Start-End: 208-441

SEQ ID NO: 171854 - DNA, 6087 bp, Homo sapiens; identical to SEQ ID NO: 171843
  Payload ID: 13769
  Gene Symbol: PTPRK
  Gene Name: protein tyrosine phosphatase, receptor type, K
  Uniprot ID: Q15262
  ENST ID: ENST00000618924
  CDS Start-End: 317-4639

SEQ ID NO: 171855 - DNA, 5816 bp, Homo sapiens; identical to SEQ ID NO: 171841
  Payload ID: 13769
  Gene Symbol: PTPRK
  Gene Name: protein tyrosine phosphatase, receptor type, K
  Uniprot ID: Q15262
  ENST ID: ENST00000618215
  CDS Start-End: 226-4566

SEQ ID NO: 171856 - DNA, 941 bp, Homo sapiens
  Payload ID: 13769
  Gene Symbol: PTPRK
  Gene Name: protein tyrosine phosphatase, receptor type, K
  ENST ID: ENST00000625615
  CDS Start-End: 1-941
cagcagcaacagaagaaccagaagtgatcccagatcccgccaagcagacagacagagtggtgaaaatagcaggaattagtgctggaattttggtgttcatcctccttctcctagttgtcatattaattgtaaaaaagaggaggagctactattcttactcctactacctcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagattgcccaatgatccacttgtaccgactgctgtgttagatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatat

SEQ ID NO: 171857 - DNA, 563 bp, Homo sapiens; identical to SEQ ID NO: 171851
  Payload ID: 13769
  Gene Symbol: PTPRK
  Gene Name: protein tyrosine phosphatase, receptor type, K
  ENST ID: ENST00000627768
  CDS Start-End: 242-361

SEQ ID NO: 171858 - DNA, 2515 bp, Homo sapiens; identical to SEQ ID NO: 171847
  Payload ID: 13769
  Gene Symbol: PTPRK
  Gene Name: protein tyrosine phosphatase, receptor type, K
  ENST ID: ENST00000628245
  CDS Start-End: 1-63

SEQ ID NO: 171859 - DNA, 4651 bp, Homo sapiens; identical to SEQ ID NO: 171842
  Payload ID: 13769
  Gene Symbol: PTPRK
  Gene Name: protein tyrosine phosphatase, receptor type, K
  Uniprot ID: Q15262
  ENST ID: ENST00000628183
  CDS Start-End: 1-4320

SEQ ID NO: 171860 - DNA, 1722 bp, Homo sapiens; identical to SEQ ID NO: 171850
  Payload ID: 13769
  Gene Symbol: PTPRK
  Gene Name: protein tyrosine phosphatase, receptor type, K
  ENST ID: ENST00000628472
  CDS Start-End: 230-976

SEQ ID NO: 171861 - DNA, 4758 bp, Homo sapiens; identical to SEQ ID NO: 171839
  Payload ID: 13769
  Gene Symbol: PTPRK
  Gene Name: protein tyrosine phosphatase, receptor type, K
  ENST ID: ENST00000626594
  CDS Start-End: 226-4644

SEQ ID NO: 171862 - DNA, 5025 bp, Homo sapiens; identical to SEQ ID NO: 171840
  Payload ID: 13769
  Gene Symbol: PTPRK
  Gene Name: protein tyrosine phosphatase, receptor type, K
  ENST ID: ENST00000625760
  CDS Start-End: 259-4635

SEQ ID NO: 171863 - DNA, 612 bp, Homo sapiens; identical to SEQ ID NO: 171849
  Payload ID: 13769
  Gene Symbol: PTPRK
  Gene Name: protein tyrosine phosphatase, receptor type, K
  ENST ID: ENST00000628824
  CDS Start-End: 1-612

SEQ ID NO: 171864 - DNA, 782 bp, Homo sapiens; identical to SEQ ID NO: 171846
  Payload ID: 13769
  Gene Symbol: PTPRK
  Gene Name: protein tyrosine phosphatase, receptor type, K
  ENST ID: ENST00000625418
  CDS Start-End: 1-782

SEQ ID NO: 171865 - DNA, 6095 bp, Homo sapiens
  Payload ID: 13770
  Gene Symbol: PTPRM
  Gene Name: protein tyrosine phosphatase, receptor type, M
  Uniprot ID: P28827
  ENST ID: ENST00000332175
  CDS Start-End: 1038-5396
gcggcgtagagaagctcgcagccctccggagcctcagcgatctcctggctcgcttttcccgcagccgccgagcagcgcaggcccggcgactccgggtgcagctggccctgtgcggtgacatcgccgtccggcgccaggctcgaagccgcctggccgcgcccgcggggtcgcaggccgctggtcccgcccggccgcgctcacaaactactcgcggctcgtgacccgggacaaacttctggcggcggcgcagcctcttccacagtcaccctccccagagccagctaccaaaatagaagacgcggccggggcgaggaggtgggcggggggagcccggtggccgctcctccccgcgcggctgacgcccgcttcggcggcggtagtggctgtggccgcggggccgcccccagccgagctcccggaggcgctcgggcgcgggccggcggggcacgggcgctcacgccctctagcgggccgcggcggcgccgggcggccgtgacgtgagcgctcccttcagccggcctgcggggcaccgccagtcagtcggggagcaagagccccgcgcgcagccggcgcgggctcggtcatcggcgcgccgccgcccggggctgggcttggggctgcctgtggagaggcggcgggcggaacgcgcgcggccacggccacggccaccgccacggccacggccggcagctcgggtcccgggtcccgggcaggggaaggggagaggcggcgagctcagcaaccggaaccgagggaagattttggctccgcgggctcgccctccgctccctctgccagcggcgccagacgccgagtggggccagggacaggggaggaggacccaggaccctgtgcccgcgcccctggagccgctggagttcggacttctgcaactgttggcactttgggggcttggcttagcgctctgctgtttacccgtctctcctcgctgcctcggaaccaaagctcccggccccctccgccctcgcgcgcccacccaccgccgccggggagcggcccggcccgcactcagcaccatgaggggacttgggacttgcctggcgactttggccggacttttgctaactgcggcgggcgagacgttctcaggtggctgcctctttgatgagccgtatagcacatgtggatatagtcaatctgaaggtgatgacttcaattgggagcaagtgaacaccttgactaaaccgacttctgatccatggatgccatcaggttctttcatgctggtgaatgcctctgggagacctgaggggcagagagcccacctgctcttaccccaacttaaagaaaatgacacccactgcatcgattttcactattttgtgtccagcaagagtaattctcctccggggttactcaatgtctacgtgaaggtcaataacgggccactggggaatcctatctggaatatatctggagacccaacacgtacatggaacagggcagaactggccattagtactttctggcctaacttttatcaggtgatttttgaagtgataacttctggacatcaaggctatctcgctatcgatgaggtgaaggtgttaggacatccatgtaccaggactcctcacttcctgcggattcagaatgtggaagttaatgctggccagtttgctaccttccagtgcagtgccatcggcaggaccgtggcaggagacaggctctggttacagggcattgatgtgcgagatgctcctctgaaggaaatcaaggtgaccagctcccgacgcttcattgcttcatttaatgttgtgaataccaccaaacgagatgctggaaagtaccgctgcatgattcgcactgaaggaggtgttggaatatcaaactatgcagagttggtagttaaagaaccacccgttcctattgccccacctcagctcgcctctgtaggagccacctacctgtggatacagctcaacgccaactccatcaatggggatgggcccattgtggcccgagaggtggagtactgcacggccagtgggagctggaatgaccggcagccagtcgattccacgagctataaaattggacaccttgacccagatacagaatatgagattagtgtgctcctgaccaggccaggggagggtggcactggctctcctggtccagctctcaggacaagaacaaagtgtgctgatcccatgcgaggcccaagaaaactagaagtagtggaggtcaaatctcggcaaatcactatccgctgggagccatttggatataatgtaactcgttgccacagttataatctcactgtccactactgttaccaagttggaggacaagaacaagtgcgagaagaagtaagctgggatacagaaaactcacaccctcaacacacgatcactaacctgtcaccatacaccaatgtcagtgtgaaactgatcctcatgaacccagagggccggaaggaaagccaagaactcatagtgcagacagatgaagacctcccaggtgctgttcccactgaatccatacaaggaagtacctttgaagagaagatatttcttcagtggagagaaccaactcaaacatatggtgtaatcactttatatgagatcacctacaaagcagtcagttcctttgacccagaaatagatttatccaatcagagtggaagagtttcaaagctgggaaatgaaacccattttctgttttttggactgtatccggggaccacatactcctttaccatccgagctagcacagctaagggttttgggcctccagcaacaaaccagttcaccaccaaaatatcagcaccctctatgccagcttatgaacttgagacacctttgaatcaaactgacaataccgtgacagtcatgctgaaacctgcccacagcagaggagcacctgtcagtgtctatcaaatagttgttgaggaagaacgtcctcgaagaactaaaaagacgacagaaatcttaaagtgctacccagtgccaattcacttccagaatgcttctctgctgaactcacagtactactttgctgcagaatttcctgcagacagcctccaagctgcgcagccttttacaattggtgataataagacatataatggatactggaacactccccttctcccctataaaagctacagaatttatttccaagctgctagtagagccaatggggaaaccaaaatagactgtgtccaagtggccacaaaaggagctgccactccgaaaccagtcccagaacccgagaaacagacagaccatacagttaaaattgctggagtcatcgcgggcatcttgctgttcgtgattatatttcttggagttgtgttggtaatgaagaaaaggaaactggccaagaagcggaaagagaccatgagcagcacccgacaggagatgactgtgatggtgaactcaatggacaagagctatgctgagcagggcacaaactgcgacgaggctttctcattcatggacacgcacaatctgaatgggagatctgtgtcttcaccatcgtccttcacaatgaaaacaaatacactgagcacatcggtgcctaattcctattacccagatgaaacccacacaatggccagcgataccagcagcctggtgcagtcccatacttacaagaagcgagagccggccgacgtgccctatcagactgggcagctccaccccgccatccgggtggcagacctccttcagcacatcacacagatgaagtgtgcggagggctacggcttcaaggaggaatacgagagcttctttgaagggcagtctgcaccatgggactcggctaagaaagatgagaacagaatgaagaacagatacgggaatatcattgcatacgatcattcccgagtgaggctgcagacaatagaaggagacacaaactcagactatatcaatggcaattatatcgatggttatcatcgacccaatcattacattgctacccaagggccaatgcaggaaaccatctatgacttctggaggatggtgtggcacgaaaacactgcaagtatcatcatggtgaccaatcttgtggaagtgggaagggtcaaatgctgcaaatactggccagatgacacagagatatataaagacattaaagttaccctaatagaaacagaactactggcagaatatgtgataagaacatttgctgttgaaaagagaggtgtgcatgaaatccgagagatcagacagtttcacttcactggctggccggatcatggggtcccctaccatgccaccggcctgctgggattcgtgcggcaagtcaagtccaagagcccgcccagtgcaggcccactggtggtgcactgcagtgctggtgcagggaggactggctgtttcatcgtcattgatatcatgttggacatggccgaaagggaaggggtcgtagacatctacaactgcgtcagggagctgcggtcacggagggtgaacatggtgcaaacagaggagcagtatgtgtttatccacgatgcgatcctggaagcctgtctttgtggggacacctctgtgcctgcttcccaagttaggtctctgtattatgacatgaacaaactggatccacagacaaactcaagccagattaaagaggaattccggacgctaaacatggtgacaccaacgctgcgagtagaggactgcagcatcgcactgttgccccggaaccatgagaaaaaccggtgcatggacatcctgcccccagaccgctgcctgcccttcctcatcaccatcgatggggagagcagcaactacatcaatgctgccctcatggacagctataaacagccttcagcttttatagtcacccagcatcctttgccaaacacagtgaaagacttttggagactggtcctggattatcactgcacatccgtagttatgctaaatgatgtggatcctgcccagttgtgtccacagtactggccagaaaacggagtacacagacacggccccatccaggtggaatttgtctctgctgacctggaagaggacatcatcagcaggatattccgcatttacaatgccgccagaccccaagatggatatcggatggtgcagcaattccagttcctgggctggccgatgtacagggacacaccagtgtctaagcgctccttcttgaagctcattcgccaggtggacaagtggcaagaggagtacaatggcggggaaggccgcacggttgtgcactgcttgaacgggggaggccgcagtgggacgttctgcgccatcagcatcgtatgtgagatgctccggcaccagagaaccgtggatgtctttcacgctgtgaagacactgaggaacaacaagcccaacatggtcgacctcctggatcagtacaagttctgctacgaggtggccctggaatacttgaattctggctgatggtgtaaacagctctgcaaacaatccctttcataccacaaagccaagacgttccatggtatttgtgcaaaagagatgaagacttctcaatatgcttattttgctttgcataattggctctttttaagagcccaagaaagtgtttctaaaattgcttgcactgcccaatcccagtaatgctgctgcctgacagaaacacacacacagccacagttgccaaatcccgtactccttgccaccggcttcctagagcagcgtagacagctggtaaactgaagagcacaactatattcttatgaaggaatttgtacctttggggtattattttgtggcccgtgaccctcgttattgttacagctgagtgtatgtttttgttctgtggagaatgctatctggcattatggtaatatattattttaggtaatatttgtactttaacatgttgcataatatatgcttatgtagctttccaggactaacagataaatgtgtaatgaacaaagatatgttgtatgagtcgtcgtttctgtcagatttgtattgtttccaagggaaaagcttgggggaggactcagttcacaaaatgcaaaactcaacgatcagattcacggacccagagcttttccatgtgtttatattgtaaatatttttgatttcatcaaattatttattcattaaaagaaatttttgtgaagcaca

SEQ ID NO: 171866 - DNA, 5292 bp, Homo sapiens
  Payload ID: 13770
  Gene Symbol: PTPRM
  Gene Name: protein tyrosine phosphatase, receptor type, M
  ENST ID: ENST00000400053
  CDS Start-End: 426-4598
gtgctgtggcccaatcctgtgcgtgtctcctcttcaggctcctgccggagcatgcttctctaatcttaccatttatcactgacccttcggtgaaactctcttctgtttaaatttaccagggtacactttgtaatacttgggaccaagaatttgaagatagtaatcagacaaatcaaacaactagtagtagtggagagacacgtagccctacaggaaggggtagaattatcattaaaaacacagacaaaccagagactgcctgaaaaaaaaaaaaagatgaactggaaagattcaaagtaggctctattggaggtggctgcctctttgatgagccgtatagcacatgtggatatagtcaatctgaaggtgatgacttcaattgggagcaagtgaacaccttgactaaaccgacttctgatccatggatgccatcaggttctttcatgctggtgaatgcctctgggagacctgaggggcagagagcccacctgctcttaccccaacttaaagaaaatgacacccactgcatcgattttcactattttgtgtccagcaagagtaattctcctccggggttactcaatgtctacgtgaaggtcaataacgggccactggggaatcctatctggaatatatctggagacccaacacgtacatggaacagggcagaactggccattagtactttctggcctaacttttatcaggtgatttttgaagtgataacttctggacatcaaggctatctcgctatcgatgaggtgaaggtgttaggacatccatgtaccaggactcctcacttcctgcggattcagaatgtggaagttaatgctggccagtttgctaccttccagtgcagtgccatcggcaggaccgtggcaggagacaggctctggttacagggcattgatgtgcgagatgctcctctgaaggaaatcaaggtgaccagctcccgacgcttcattgcttcatttaatgttgtgaataccaccaaacgagatgctggaaagtaccgctgcatgattcgcactgaaggaggtgttggaatatcaaactatgcagagttggtagttaaagaaccacccgttcctattgccccacctcagctcgcctctgtaggagccacctacctgtggatacagctcaacgccaactccatcaatggggatgggcccattgtggcccgagaggtggagtactgcacggccagtgggagctggaatgaccggcagccagtcgattccacgagctataaaattggacaccttgacccagatacagaatatgagattagtgtgctcctgaccaggccaggggagggtggcactggctctcctggtccagctctcaggacaagaacaaagtgtgctgatcccatgcgaggcccaagaaaactagaagtagtggaggtcaaatctcggcaaatcactatccgctgggagccatttggatataatgtaactcgttgccacagttataatctcactgtccactactgttaccaagttggaggacaagaacaagtgcgagaagaagtaagctgggatacagaaaactcacaccctcaacacacgatcactaacctgtcaccatacaccaatgtcagtgtgaaactgatcctcatgaacccagagggccggaaggaaagccaagaactcatagtgcagacagatgaagacctcccaggtgctgttcccactgaatccatacaaggaagtacctttgaagagaagatatttcttcagtggagagaaccaactcaaacatatggtgtaatcactttatatgagatcacctacaaagcagtcagttcctttgacccagaaatagatttatccaatcagagtggaagagtttcaaagctgggaaatgaaacccattttctgttttttggactgtatccggggaccacatactcctttaccatccgagctagcacagctaagggttttgggcctccagcaacaaaccagttcaccaccaaaatatcagcaccctctatgccagcttatgaacttgagacacctttgaatcaaactgacaataccgtgacagtcatgctgaaacctgcccacagcagaggagcacctgtcagtgtctatcaaatagttgttgaggaagaacgtcctcgaagaactaaaaagacgacagaaatcttaaagtgctacccagtgccaattcacttccagaatgcttctctgctgaactcacagtactactttgctgcagaatttcctgcagacagcctccaagctgcgcagccttttacaattggtgataataagacatataatggatactggaacactccccttctcccctataaaagctacagaatttatttccaagctgctagtagagccaatggggaaaccaaaatagactgtgtccaagtggccacaaaaggagctgccactccgaaaccagtcccagaacccgagaaacagacagaccatacagttaaaattgctggagtcatcgcgggcatcttgctgttcgtgattatatttcttggagttgtgttggtaatgaagaaaaggaaactggccaagaagcggaaagagaccatgagcagcacccgacaggagatgactgtgatggtgaactcaatggacaagagctatgctgagcagggcacaaactgcgacgaggctttctcattcatggacacgcacaatctgaatgggagatctgtgtcttcaccatcgtccttcacaatgaaaacaaatacactgagcacatcggtgcctaattcctattacccagatgaaacccacacaatggccagcgataccagcagcctggtgcagtcccatacttacaagaagcgagagccggccgacgtgccctatcagactgggcagctccaccccgccatccgggtggcagacctccttcagcacatcacacagatgaagtgtgcggagggctacggcttcaaggaggaatacgagagcttctttgaagggcagtctgcaccatgggactcggctaagaaagatgagaacagaatgaagaacagatacgggaatatcattgcatacgatcattcccgagtgaggctgcagacaatagaaggagacacaaactcagactatatcaatggcaattatatcgatggttatcatcgacccaatcattacattgctacccaagggccaatgcaggaaaccatctatgacttctggaggatggtgtggcacgaaaacactgcaagtatcatcatggtgaccaatcttgtggaagtgggaagggtcaaatgctgcaaatactggccagatgacacagagatatataaagacattaaagttaccctaatagaaacagaactactggcagaatatgtgataagaacatttgctgttgaaaagagaggtgtgcatgaaatccgagagatcagacagtttcacttcactggctggccggatcatggggtcccctaccatgccaccggcctgctgggattcgtgcggcaagtcaagtccaagagcccgcccagtgcaggcccactggtggtgcactgcagtgctggtgcagggaggactggctgtttcatcgtcattgatatcatgttggacatggccgaaagggaaggggtcgtagacatctacaactgcgtcagggagctgcggtcacggagggtgaacatggtgcaaacagaggagcagtatgtgtttatccacgatgcgatcctggaagcctgtctttgtggggacacctctgtgcctgcttcccaagttaggtctctgtattatgacatgaacaaactggatccacagacaaactcaagccagattaaagaggaattccggacgctaaacatggtgacaccaacgctgcgagtagaggactgcagcatcgcactgttgccccggaaccatgagaaaaaccggtgcatggacatcctgcccccagaccgctgcctgcccttcctcatcaccatcgatggggagagcagcaactacatcaatgctgccctcatggacagctataaacagccttcagcttttatagtcacccagcatcctttgccaaacacagtgaaagacttttggagactggtcctggattatcactgcacatccgtagttatgctaaatgatgtggatcctgcccagttgtgtccacagtactggccagaaaacggagtacacagacacggccccatccaggtggaatttgtctctgctgacctggaagaggacatcatcagcaggatattccgcatttacaatgccgccagaccccaagatggatatcggatggtgcagcaattccagttcctgggctggccgatgtacagggacacaccagtgtctaagcgctccttcttgaagctcattcgccaggtggacaagtggcaagaggagtacaatggcggggaaggccgcacggttgtgcactgcttgaacgggggaggccgcagtgggacgttctgcgccatcagcatcgtatgtgagatgctccggcaccagagaaccgtggatgtctttcacgctgtgaagacactgaggaacaacaagcccaacatggtcgacctcctggatcagtacaagttctgctacgaggtggccctggaatacttgaattctggctgatggtgtaaacagctctgcaaacaatccctttcataccacaaagccaagacgttccatggtatttgtgcaaaagagatgaagacttctcaatatgcttattttgctttgcataattggctctttttaagagcccaagaaagtgtttctaaaattgcttgcactgcccaatcccagtaatgctgctgcctgacagaaacacacacacagccacagttgccaaatcccgtactccttgccaccggcttcctagagcagcgtagacagctggtaaactgaagagcacaactatattcttatgaaggaatttgtacctttggggtattattttgtggcccgtgaccctcgttattgttacagctgagtgtatgtttttgttctgtggagaatgctatctggcattatggtaatatattattttaggtaatatttgtactttaacatgttgcataatatatgcttatgtagctttccaggactaacagataaatgtgtaatgaacaaagatatgttgtatgagtcgtcgtttctgtcagatttgtattgtttccaagggaaaagcttgggggaggactcagttcacaaaatgcaaaactcaacgatcagattcacggacccagagcttttccatgtgtttatattgtaaatatttttgatttcatcaaattatttattcattaaaagaaatttttgtgaa

SEQ ID NO: 171867 - DNA, 5030 bp, Homo sapiens
  Payload ID: 13770
  Gene Symbol: PTPRM
  Gene Name: protein tyrosine phosphatase, receptor type, M
  ENST ID: ENST00000400060
  CDS Start-End: 3495-4334
acattttaggtggctgcctctttgatgagccgtatagcacatgtggatatagtcaatctgaaggtgatgacttcaattgggagcaagtgaacaccttgactaaaccgacttctgatccatggatgccatcaggttctttcatgctggtgaatgcctctgggagacctgaggggcagagagcccacctgctcttaccccaacttaaagaaaatgacacccactgcatcgattttcactattttgtgtccagcaagagtaattctcctccggggttactcaatgtctacgtgaaggtcaataacgggccactggggaatcctatctggaatatatctggagacccaacacgtacatggaacagggcagaactggccattagtactttctggcctaacttttatcaggtgatttttgaagtgataacttctggacatcaaggctatctcgctatcgatgaggtgaaggtgttaggacatccatgtaccaggactcctcacttcctgcggattcagaatgtggaagttaatgctggccagtttgctaccttccagtgcagtgccatcggcaggaccgtggcaggagacaggctctggttacagggcattgatgtgcgagatgctcctctgaaggaaatcaaggtgaccagctcccgacgcttcattgcttcatttaatgttgtgaataccaccaaacgagatgctggaaagtaccgctgcatgattcgcactgaaggaggtgttggaatatcaaactatgcagagttggtagttaaagaaccacccgttcctattgccccacctcagctcgcctctgtaggagccacctacctgtggatacagctcaacgccaactccatcaatggggatgggcccattgtggcccgagaggtggagtactgcacggccagtgggagctggaatgaccggcagccagtcgattccacgagctataaaattggacaccttgacccagatacagaatatgagattagtgtgctcctgaccaggccaggggagggtggcactggctctcctggtccagctctcaggacaagaacaaagtgtgctgatcccatgcgaggcccaagaaaactagaagtagtggaggtcaaatctcggcaaatcactatccgctgggagccatttggatataatgtaactcgttgccacagttataatctcactgtccactactgttaccaagttggaggacaagaacaagtgcgagaagaagtaagctgggatacagaaaactcacaccctcaacacacgatcactaacctgtcaccatacaccaatgtcagtgtgaaactgatcctcatgaacccagagggccggaaggaaagccaagaactcatagtgcagacagatgaagacctcccaggtgctgttcccactgaatccatacaaggaagtacctttgaagagaagatatttcttcagtggagagaaccaactcaaacatatggtgtaatcactttatatgagatcacctacaaagcagtcagttcctttgacccagaaatagatttatccaatcagagtggaagagtttcaaagctgggaaatgaaacccattttctgttttttggactgtatccggggaccacatactcctttaccatccgagctagcacagctaagggttttgggcctccagcaacaaaccagttcaccaccaaaatatcagcaccctctatgccagcttatgaacttgagacacctttgaatcaaactgacaataccgtgacagtcatgctgaaacctgcccacagcagaggagcacctgtcagtgtctatcaaatagttgttgaggaagaacgtcctcgaagaactaaaaagacgacagaaatcttaaagtgctacccagtgccaattcacttccagaatgcttctctgctgaactcacagtactactttgctgcagaatttcctgcagacagcctccaagctgcgcagccttttacaattggtgataataagacatataatggatactggaacactccccttctcccctataaaagctacagaatttatttccaagctgctagtagagccaatggggaaaccaaaatagactgtgtccaagtggccacaaaaggagctgccactccgaaaccagtcccagaacccgagaaacagacagaccatacagttaaaattgctggagtcatcgcgggcatcttgctgttcgtgattatatttcttggagttgtgttggtaatgaagaaaaggaaactggccaagaagcggaaagagaccatgagcagcacccgacaggagatgactgtgatggtgaactcaatggacaagagctatgctgagcagggcacaaactgcgacgaggctttctcattcatggacacgcacaatctgaatgggagatctgtgtcttcaccatcgtccttcacaatgaaaacaaatacactgagcacatcggtgcctaattcctattacccagacccatttgtgccaactgcaattttagtgccaataaatgatgaaacccacacaatggccagcgataccagcagcctggtgcagtcccatacttacaagaagcgagagccggccgacgtgccctatcagactgggcagctccaccccgccatccgggtggcagacctccttcagcacatcacacagatgaagtgtgcggagggctacggcttcaaggaggaatacgagagcttctttgaagggcagtctgcaccatgggactcggctaagaaagatgagaacagaatgaagaacagatacgggaatatcattgcatacgatcattcccgagtgaggctgcagacaatagaaggagacacaaactcagactatatcaatggcaattatatcgatggttatcatcgacccaatcattacattgctacccaagggccaatgcaggaaaccatctatgacttctggaggatggtgtggcacgaaaacactgcaagtatcatcatggtgaccaatcttgtggaagtgggaagggtcaaatgctgcaaatactggccagatgacacagagatatataaagacattaaagttaccctaatagaaacagaactactggcagaatatgtgataagaacatttgctgttgaaaagagaggtgtgcatgaaatccgagagatcagacagtttcacttcactggctggccggatcatggggtcccctaccatgccaccggcctgctgggattcgtgcggcaagtcaagtccaagagcccgcccagtgcaggcccactggtggtgcactgcagtgctggtgcagggaggactggctgtttcatcgtcattgatatcatgttggacatggccgaaagggaaggggtcgtagacatctacaactgcgtcagggagctgcggtcacggagggtgaacatggtgcaaacagaggagcagtatgtgtttatccacgatgcgatcctggaagcctgtctttgtggggacacctctgtgcctgcttcccaagttaggtctctgtattatgacatgaacaaactggatccacagacaaactcaagccagattaaagaggaattccggacgctaaacatggtgacaccaacgctgcgagtagaggactgcagcatcgcactgttgccccggaaccatgagaaaaaccggtgcatggacatcctgcccccagaccgctgcctgcccttcctcatcaccatcgatggggagagcagcaactacatcaatgctgccctcatggacagctataaacagccttcagcttttatagtcacccagcatcctttgccaaacacagtgaaagacttttggagactggtcctggattatcactgcacatccgtagttatgctaaatgatgtggatcctgcccagttgtgtccacagtactggccagaaaacggagtacacagacacggccccatccaggtggaatttgtctctgctgacctggaagaggacatcatcagcaggatattccgcatttacaatgccgccagaccccaagatggatatcggatggtgcagcaattccagttcctgggctggccgatgtacagggacacaccagtgtctaagcgctccttcttgaagctcattcgccaggtggacaagtggcaagaggagtacaatggcggggaaggccgcacggttgtgcactgcttgaacgggggaggccgcagtgggacgttctgcgccatcagcatcgtatgtgagatgctccggcaccagagaaccgtggatgtctttcacgctgtgaagacactgaggaacaacaagcccaacatggtcgacctcctggatcagtacaagttctgctacgaggtggccctggaatacttgaattctggctgatggtgtaaacagctctgcaaacaatccctttcataccacaaagccaagacgttccatggtatttgtgcaaaagagatgaagacttctcaatatgcttattttgctttgcataattggctctttttaagagcccaagaaagtgtttctaaaattgcttgcactgcccaatcccagtaatgctgctgcctgacagaaacacacacacagccacagttgccaaatcccgtactccttgccaccggcttcctagagcagcgtagacagctggtaaactgaagagcacaactatattcttatgaaggaatttgtacctttggggtattattttgtggcccgtgaccctcgttattgttacagctgagtgtatgtttttgttctgtggagaatgctatctggcattatggtaatatattattttaggtaatatttgtactttaacatgttgcataatatatgcttatgtagctttccaggactaacagataaatgtgtaatgaacaaagatatgttgtatgagtcgtcgtttctgtcagatttgtattgtttccaagggaaaagcttgggggaggactcagttcacaaaatgcaaaactcaacgatcagattcacggacccagagcttttccatgtgtttatattgtaaatatttttgatttcatcaaattatttattcattaaaagaaatttttgtgaagc

SEQ ID NO: 171868 - DNA, 792 bp, Homo sapiens
  Payload ID: 13770
  Gene Symbol: PTPRM
  Gene Name: protein tyrosine phosphatase, receptor type, M
  ENST ID: ENST00000583289
  CDS Start-End: 1-792
cagaaatagatttatccaatcagagtggaagagtttcaaagctgggaaatgaaacccattttctgttttttggactgtatccggggaccacatactcctttaccatccgagctagcacagctaagggttttgggcctccagcaacaaaccagttcaccaccaaaatatcagcaccctctatgccagcttatgaacttgagacacctttgaatcaaactgacaataccgtgacagtcatgctgaaacctgcccacagcagaggagcacctgtcagtgtctatcaaatagttgttgaggaagaacgtcctcgaagaactaaaaagacgacagaaatcttaaagtgctacccagtgccaattcacttccagaatgcttctctgctgaactcacagtactactttgctgcagaatttcctgcagacagcctccaagctgcgcagccttttacaattggtgataataagacatataatggatactggaacactccccttctcccctataaaagctacagaatttatttccaagctgctagtagagccaatggggaaaccaaaatagactgtgtccaagtggccacaaaagctgcgataatcgtgactcagcttacaacaccttacattcgcatcgcccccgctgcaggcgacggccaactaacaggagctgccactccgaaaccagtcccagaacccgagaaacagacagaccatacagttaaaattgctggagtcatcgcgggcatcttgctgttcgtgattatatttcttggagttgtgttggtaatgaagaaaa

SEQ ID NO: 171869 - DNA, 713 bp, Homo sapiens
  Payload ID: 13770
  Gene Symbol: PTPRM
  Gene Name: protein tyrosine phosphatase, receptor type, M
  ENST ID: ENST00000583153
  CDS Start-End: 1-713
aagacattaaagttaccctaatagaaacagaactactggcagaatatgtgataagaacatttgctgttgaaaagggaggggccggaggtgaagcaaactgcagtccatccagagaagtgtcacagagaggtgtgcatgaaatccgagagatcagacagtttcacttcactggctggccggatcatggggtcccctaccatgccaccggcctgctgggattcgtgcggcaagtcaagtccaagagcccgcccagtgcaggcccactggtggtgcactgcagtgctggtgcagggaggactggctgtttcatcgtcattgatatcatgttggacatggccgaaagggaaggggtcgtagacatctacaactgcgtcagggagctgcggtcacggagggtgaacatggtgcaaacagaggagcagtatgtgtttatccacgatgcgatcctggaagcctgtctttgtggggacacctctgtgcctgcttcccaagttaggtctctgtattatgacatgaacaaactggatccacagacaaactcaagccagattaaagaggaattccggacgctaaacatggtgacaccaacgctgcgagtagaggactgcagcatcgcactgttgccccggaaccatgagaaaaaccggtgcatggacatcctgcccccagaccgctgcctgcccttcctcatcaccatcgatggggagagcagc

SEQ ID NO: 171870 - DNA, 5941 bp, Homo sapiens
  Payload ID: 13770
  Gene Symbol: PTPRM
  Gene Name: protein tyrosine phosphatase, receptor type, M
  Uniprot ID: P28827
  ENST ID: ENST00000580170
  CDS Start-End: 1038-5435
gcggcgtagagaagctcgcagccctccggagcctcagcgatctcctggctcgcttttcccgcagccgccgagcagcgcaggcccggcgactccgggtgcagctggccctgtgcggtgacatcgccgtccggcgccaggctcgaagccgcctggccgcgcccgcggggtcgcaggccgctggtcccgcccggccgcgctcacaaactactcgcggctcgtgacccgggacaaacttctggcggcggcgcagcctcttccacagtcaccctccccagagccagctaccaaaatagaagacgcggccggggcgaggaggtgggcggggggagcccggtggccgctcctccccgcgcggctgacgcccgcttcggcggcggtagtggctgtggccgcggggccgcccccagccgagctcccggaggcgctcgggcgcgggccggcggggcacgggcgctcacgccctctagcgggccgcggcggcgccgggcggccgtgacgtgagcgctcccttcagccggcctgcggggcaccgccagtcagtcggggagcaagagccccgcgcgcagccggcgcgggctcggtcatcggcgcgccgccgcccggggctgggcttggggctgcctgtggagaggcggcgggcggaacgcgcgcggccacggccacggccaccgccacggccacggccggcagctcgggtcccgggtcccgggcaggggaaggggagaggcggcgagctcagcaaccggaaccgagggaagattttggctccgcgggctcgccctccgctccctctgccagcggcgccagacgccgagtggggccagggacaggggaggaggacccaggaccctgtgcccgcgcccctggagccgctggagttcggacttctgcaactgttggcactttgggggcttggcttagcgctctgctgtttacccgtctctcctcgctgcctcggaaccaaagctcccggccccctccgccctcgcgcgcccacccaccgccgccggggagcggcccggcccgcactcagcaccatgaggggacttgggacttgcctggcgactttggccggacttttgctaactgcggcgggcgagacgttctcaggtggctgcctctttgatgagccgtatagcacatgtggatatagtcaatctgaaggtgatgacttcaattgggagcaagtgaacaccttgactaaaccgacttctgatccatggatgccatcaggttctttcatgctggtgaatgcctctgggagacctgaggggcagagagcccacctgctcttaccccaacttaaagaaaatgacacccactgcatcgattttcactattttgtgtccagcaagagtaattctcctccggggttactcaatgtctacgtgaaggtcaataacgggccactggggaatcctatctggaatatatctggagacccaacacgtacatggaacagggcagaactggccattagtactttctggcctaacttttatcaggtgatttttgaagtgataacttctggacatcaaggctatctcgctatcgatgaggtgaaggtgttaggacatccatgtaccaggactcctcacttcctgcggattcagaatgtggaagttaatgctggccagtttgctaccttccagtgcagtgccatcggcaggaccgtggcaggagacaggctctggttacagggcattgatgtgcgagatgctcctctgaaggaaatcaaggtgaccagctcccgacgcttcattgcttcatttaatgttgtgaataccaccaaacgagatgctggaaagtaccgctgcatgattcgcactgaaggaggtgttggaatatcaaactatgcagagttggtagttaaagaaccacccgttcctattgccccacctcagctcgcctctgtaggagccacctacctgtggatacagctcaacgccaactccatcaatggggatgggcccattgtggcccgagaggtggagtactgcacggccagtgggagctggaatgaccggcagccagtcgattccacgagctataaaattggacaccttgacccagatacagaatatgagattagtgtgctcctgaccaggccaggggagggtggcactggctctcctggtccagctctcaggacaagaacaaagtgtgctgatcccatgcgaggcccaagaaaactagaagtagtggaggtcaaatctcggcaaatcactatccgctgggagccatttggatataatgtaactcgttgccacagttataatctcactgtccactactgttaccaagttggaggacaagaacaagtgcgagaagaagtaagctgggatacagaaaactcacaccctcaacacacgatcactaacctgtcaccatacaccaatgtcagtgtgaaactgatcctcatgaacccagagggccggaaggaaagccaagaactcatagtgcagacagatgaagacctcccaggtgctgttcccactgaatccatacaaggaagtacctttgaagagaagatatttcttcagtggagagaaccaactcaaacatatggtgtaatcactttatatgagatcacctacaaagcagtcagttcctttgacccagaaatagatttatccaatcagagtggaagagtttcaaagctgggaaatgaaacccattttctgttttttggactgtatccggggaccacatactcctttaccatccgagctagcacagctaagggttttgggcctccagcaacaaaccagttcaccaccaaaatatcagcaccctctatgccagcttatgaacttgagacacctttgaatcaaactgacaataccgtgacagtcatgctgaaacctgcccacagcagaggagcacctgtcagtgtctatcaaatagttgttgaggaagaacgtcctcgaagaactaaaaagacgacagaaatcttaaagtgctacccagtgccaattcacttccagaatgcttctctgctgaactcacagtactactttgctgcagaatttcctgcagacagcctccaagctgcgcagccttttacaattggtgataataagacatataatggatactggaacactccccttctcccctataaaagctacagaatttatttccaagctgctagtagagccaatggggaaaccaaaatagactgtgtccaagtggccacaaaaggagctgccactccgaaaccagtcccagaacccgagaaacagacagaccatacagttaaaattgctggagtcatcgcgggcatcttgctgttcgtgattatatttcttggagttgtgttggtaatgaagaaaaggaaactggccaagaagcggaaagagaccatgagcagcacccgacaggagatgactgtgatggtgaactcaatggacaagagctatgctgagcagggcacaaactgcgacgaggctttctcattcatggacacgcacaatctgaatgggagatctgtgtcttcaccatcgtccttcacaatgaaaacaaatacactgagcacatcggtgcctaattcctattacccagacccatttgtgccaactgcaattttagtgccaataaatgatgaaacccacacaatggccagcgataccagcagcctggtgcagtcccatacttacaagaagcgagagccggccgacgtgccctatcagactgggcagctccaccccgccatccgggtggcagacctccttcagcacatcacacagatgaagtgtgcggagggctacggcttcaaggaggaatacgagagcttctttgaagggcagtctgcaccatgggactcggctaagaaagatgagaacagaatgaagaacagatacgggaatatcattgcatacgatcattcccgagtgaggctgcagacaatagaaggagacacaaactcagactatatcaatggcaattatatcgatggttatcatcgacccaatcattacattgctacccaagggccaatgcaggaaaccatctatgacttctggaggatggtgtggcacgaaaacactgcaagtatcatcatggtgaccaatcttgtggaagtgggaagggtcaaatgctgcaaatactggccagatgacacagagatatataaagacattaaagttaccctaatagaaacagaactactggcagaatatgtgataagaacatttgctgttgaaaagagaggtgtgcatgaaatccgagagatcagacagtttcacttcactggctggccggatcatggggtcccctaccatgccaccggcctgctgggattcgtgcggcaagtcaagtccaagagcccgcccagtgcaggcccactggtggtgcactgcagtgctggtgcagggaggactggctgtttcatcgtcattgatatcatgttggacatggccgaaagggaaggggtcgtagacatctacaactgcgtcagggagctgcggtcacggagggtgaacatggtgcaaacagaggagcagtatgtgtttatccacgatgcgatcctggaagcctgtctttgtggggacacctctgtgcctgcttcccaagttaggtctctgtattatgacatgaacaaactggatccacagacaaactcaagccagattaaagaggaattccggacgctaaacatggtgacaccaacgctgcgagtagaggactgcagcatcgcactgttgccccggaaccatgagaaaaaccggtgcatggacatcctgcccccagaccgctgcctgcccttcctcatcaccatcgatggggagagcagcaactacatcaatgctgccctcatggacagctataaacagccttcagcttttatagtcacccagcatcctttgccaaacacagtgaaagacttttggagactggtcctggattatcactgcacatccgtagttatgctaaatgatgtggatcctgcccagttgtgtccacagtactggccagaaaacggagtacacagacacggccccatccaggtggaatttgtctctgctgacctggaagaggacatcatcagcaggatattccgcatttacaatgccgccagaccccaagatggatatcggatggtgcagcaattccagttcctgggctggccgatgtacagggacacaccagtgtctaagcgctccttcttgaagctcattcgccaggtggacaagtggcaagaggagtacaatggcggggaaggccgcacggttgtgcactgcttgaacgggggaggccgcagtgggacgttctgcgccatcagcatcgtatgtgagatgctccggcaccagagaaccgtggatgtctttcacgctgtgaagacactgaggaacaacaagcccaacatggtcgacctcctggatcagtacaagttctgctacgaggtggccctggaatacttgaattctggctgatggtgtaaacagctctgcaaacaatccctttcataccacaaagccaagacgttccatggtatttgtgcaaaagagatgaagacttctcaatatgcttattttgctttgcataattggctctttttaagagcccaagaaagtgtttctaaaattgcttgcactgcccaatcccagtaatgctgctgcctgacagaaacacacacacagccacagttgccaaatcccgtactccttgccaccggcttcctagagcagcgtagacagctggtaaactgaagagcacaactatattcttatgaaggaatttgtacctttggggtattattttgtggcccgtgaccctcgttattgttacagctgagtgtatgtttttgttctgtggagaatgctatctggcattatggtaatatattattttaggtaatatttgtactttaacatgttgcataatatatgcttatgtagctttccaggactaacagataaatgtgtaatgaacaaagata

SEQ ID NO: 171871 - DNA, 604 bp, Homo sapiens
  Payload ID: 13770
  Gene Symbol: PTPRM
  Gene Name: protein tyrosine phosphatase, receptor type, M
  ENST ID: ENST00000578916
  CDS Start-End: 85-604
tttctcactgcccaagctgaagctgcctgggaggaagggctgagcatgcctagcccagccccttctttggggagctgactgcctatgggaaccctctccctccatcctggcattgatgtgcgagatgctcctctgaaggaaatcaaggtgaccagctcccgacgcttcattgcttcatttaatgttgtgaataccaccaaacgagatgctggaaagtaccgctgcatgattcgcactgaaggaggtgttggaatatcaaactatgcagagttggtagttaaagaaccacccgttcctattgccccacctcagctcgcctctgtaggagccacctacctgtggatacagctcaacgccaactccatcaatggggatgggcccattgtggcccgagaggtggagtactgcacggccagtgggagctggaatgaccggcagccagtcgattccacgagctataaaattggacaccttgacccagatacagaatatgagattagtgtgctcctgaccaggccaggggagggtggcactggctctcctggtccagctctcaggacaagaacaaagtgtgctgatcccatgcgaggcccaagaaaactag

SEQ ID NO: 171872 - DNA, 701 bp, Homo sapiens
  Payload ID: 13770
  Gene Symbol: PTPRM
  Gene Name: protein tyrosine phosphatase, receptor type, M
  ENST ID: ENST00000577468
  CDS Start-End: 1-624
cacttccagaatgcttctctgctgaactcacagtactactttgctgcagaatttcctgcagacagcctccaagctgcgcagccttttacaattggtgataataagacatataatggatactggaacactccccttctcccctataaaagctacagaatttatttccaagctgctagtagagccaatggggaaaccaaaatagactgtgtccaagtggccacaaaaggagctgccactccgaaaccagtcccagaacccgagaaacagacagaccatacagttaaaattgctggagtcatcgcgggcatcttgctgttcgtgattatatttcttggagttgtgttggtaatgaagaaaaggaaactggccaagaagcggaaagagaccatgagcagcacccgacaggagatgactgtgatggtgaactcaatggacaagagctatgctgagcagggcacaaactgcgacgaggctttctcattcatggacacgcacaatctgaatgggagatctgtgtcttcaccatcgtccttcacaatgaaaacaaatacactgagcacatcggtgcctaattcctattacccagacccatttgtgccaactgcaattttagagcttctttgaagggcagtctgcaccatgggactcggctaagaaagatgagaacagaatgaagaacagatacgggaatatcattgcat

SEQ ID NO: 171873 - DNA, 3784 bp, Homo sapiens
  Payload ID: 13771
  Gene Symbol: PTPRN
  Gene Name: protein tyrosine phosphatase, receptor type, N
  Uniprot ID: Q16849
  ENST ID: ENST00000295718
  CDS Start-End: 242-3181
aggtaggtcccccgctccgacagggctcttacgccatatgtgacgcaaattagcttacgagccgggggtggaggtgtcgtcagcacccgcctgcggttggccgcgttgcagcgagaggggcatgtagaccccgcctcgtagggaggtggggagcggcaagccccgcctcagcccctctggcaggctcccgccagcgtcgctgcggctccggcccgggagcgagcgcccggagctcggaaagatgcggcgcccgcggcggcctgggggtctcgggggatccgggggtctccggctgctcctctgcctcctgctgctgagcagccgcccggggggctgcagcgccgttagtgcccacggctgtctatttgaccgcaggctctgctctcacctggaagtctgtattcaggatggcttgtttgggcagtgccaggtgggagtggggcaggcccggccccttttgcaagtcacctccccagttctccaacgcttacaaggtgtgctccgacaactcatgtcccaaggattgtcctggcacgatgacctcacccagtatgtgatctctcaggagatggagcgcatccccaggcttcgccccccagagccccgtccaagggacaggtctggcttggcacccaagagacctggtcctgctggagagctgcttttacaggacatccccactggctccgcccctgctgcccagcatcggcttccacaaccaccagtgggcaaaggtggagctggggccagctcctctctgtcccctctgcaggctgagctgctcccgcctctcttggagcacctgctgctgcccccacagcctccccacccttcactgagttacgaacctgccttgctgcagccctacctgttccaccagtttggctcccgtgatggctccagggtctcagagggctccccagggatggtcagtgtcggccccctgcccaaggctgaagcccctgccctcttcagcagaactgcctccaagggcatatttggggaccaccctggccactcctacggggaccttccagggccttcacctgcccagctttttcaagactctgggctgctctatctggcccaggagttgccagcacccagcagggccagggtgccaaggctgccagagcaagggagcagcagccgggcagaggactccccagagggctatgagaaggaaggactaggggatcgtggagagaagcctgcttccccagctgtgcagccagatgcggctctgcagaggctggccgctgtgctggcgggctatggggtagagctgcgtcagctgacccctgagcagctctccacactcctgaccctgctgcagctactgcccaagggtgcaggaagaaatccgggaggggttgtaaatgttggagctgatatcaagaaaacaatggaggggccggtggagggcagagacacagcagagcttccagcccgcacatcccccatgcctggacaccccactgccagccctacctccagtgaagtccagcaggtgccaagccctgtctcctctgagcctcccaaagctgccagaccccctgtgacacctgtcctgctagagaagaaaagcccactgggccagagccagcccacggtggcaggacagccctcagcccgcccagcagcagaggaatatggctacatcgtcactgatcagaagcccctgagcctggctgcaggagtgaagctgctggagatcctggctgagcatgtgcacatgtcctcaggcagcttcatcaacatcagtgtggtgggaccagccctcaccttccgcatccggcacaatgagcagaacctgtctttggctgatgtgacccaacaagcagggctggtgaagtctgaactggaagcacagacagggctccaaatcttgcagacaggagtgggacagagggaggaggcagctgcagtccttccccaaactgcgcacagcacctcacccatgcgctcagtgctgctcactctggtggccctggcaggtgtggctgggctgctggtggctctggctgtggctctgtgtgtgcggcagcatgcgcggcagcaagacaaggagcgcctggcagccctggggcctgagggggcccatggtgacactacctttgagtaccaggacctgtgccgccagcacatggccacgaagtccttgttcaaccgggcagagggtccaccggagccttcacgggtgagcagtgtgtcctcccagttcagcgacgcagcccaggccagccccagctcccacagcagcaccccgtcctggtgcgaggagccggcccaagccaacatggacatctccacgggacacatgattctggcatacatggaggatcacctgcggaaccgggaccgccttgccaaggagtggcaggccctctgtgcctaccaagcagagccaaacacctgtgccaccgcgcagggggagggcaacatcaaaaagaaccggcatcctgacttcctgccctatgaccatgcccgcataaaactgaaggtggagagcagcccttctcggagcgattacatcaacgccagccccattattgagcatgaccctcggatgccagcctacatagccacgcagggcccgctgtcccataccatcgcagacttctggcagatggtgtgggagagcggctgcaccgtcatcgtcatgctgaccccgctggtggaggatggtgtcaagcagtgtgaccgctactggccagatgagggtgcctccctctaccacgtatatgaggtgaacctggtgtcggagcacatctggtgcgaggactttctggtgcggagcttctacctgaagaacgtgcagacccaggagacgcgcacgctcacgcagttccacttcctcagctggccggcagagggcacaccggcctccacgcggcccctgctggacttccgcaggaaggtgaacaagtgctaccggggccgctcctgccccatcatcgtgcactgcagtgatggtgcggggaggaccggcacctacatcctcatcgacatggtcctgaaccgcatggcaaaaggagtgaaggagattgacatcgctgccaccctggagcatgtccgtgaccagcggcctggccttgtccgctctaaggaccagtttgaatttgccctgacagccgtggcggaggaagtgaatgccatcctcaaggccctgccccagtgagaccctggggccccttggcgggcagcccagcctctgtccctctttgcctgtgtgagcatctctgtgtacccactcctcactgccccaccagccacctcttgggcatgctcagcccttcctagaagagtcaggaagggaaagccagaaggggcacgcctgcccagcctcgcatgccagagcctggggcatcccagagcccagggcatcccatgggggtgctgcagccaggaggagaggaaaggacatgggtagcaattctacccagagccttctcctgcctacattccctggcctggctctcctgtagctctcctggggttctgggagttccctgaacatctgtgtgtgtccccctatgctccagtatggaagaatggggtggagggtcgccacacccggctccccctgcttctcagccccgggcctgcctctgactcacacttgggcgctctgccctccctggcctcacgcccagcctcctcccaccaccctcccaccatgcgctgctcaacctctctccttctggcgcaagagaacatttctagaaaaaactacttttgtaccagtgtgaataaagttagtgtgttgtctgtgcagctgcaa

SEQ ID NO: 171874 - DNA, 3622 bp, Homo sapiens
  Payload ID: 13771
  Gene Symbol: PTPRN
  Gene Name: protein tyrosine phosphatase, receptor type, N
  Uniprot ID: Q16849
  ENST ID: ENST00000409251
  CDS Start-End: 167-3019
gtcgtcagcacccgcctgcggttggccgcgttgcagcgagaggggcatgtagaccccgcctcgtagggaggtggggagcggcaagccccgcctcagcccctctggcaggctcccgccagcgtcgctgcggctccggcccgggagcgagcgcccggagctcggaaagatgcggcgcccgcggcggcctgggggtctcgggggatccgggggtctccggctgctcctctgcctcctgctgctgagcagccgcccggggggctgcagcgccgttagtgcccacggctgtctatttgaccgcaggctctgctctcacctggaagtctgtattcaggatggcttgtttgggcagtgccaggtgggagtggggcaggcccggccccttttgcaagtcacctccccagttctccaacgcttacaaggtgtgctccgacaactcatgtcccaaggattgtcctggcacgatgacctcacccagtatgtgatctctcaggagatggagcgcatccccaggcttcgccccccagagccccgtccaagggacaggtctggcttggcacccaagagacctggtcctgctggagagctgcttttacaggacatccccactggctccgcccctgctgcccagcatcggcttccacaaccaccagtgggcaaaggtggagctggggccagctcctctctgtcccctctgcaggctgagctgctcccgcctctcttggagcacctgctgctgcccccacagcctccccacccttcactgagttacgaacctgccttgctgcagccctacctgttccaccagtttggctcccgtgatggctccagggtctcagagggctccccagggatggtcagtgtcggccccctgcccaaggctgaagcccctgccctcttcagcagaactgcctccaagggcatatttggggaccaccctggccactcctacggggaccttccagggccttcacctgcccagctttttcaagactctgggctgctctatctggcccaggagttgccagcacccagcagggccagggtgccaaggctgccagagcaagggagcagcagccgggcagaggactccccagagggctatgagaaggaaggactaggggatcgtggagagaagcctgcttccccagctgtgcagccagatgcggctctgcagaggctggccgctgtgctggcgggctatggggtagagctgcgtcagctgacccctgagcagctctccacactcctgaccctgctgcagctactgcccaagggtgcaggaagaaatccgggaggggttgtaaatgttggagctgatatcaagaaaacaatggaggggccggtggagggcagagacacagcagagcttccagcccgcacatcccccatgcctggacaccccactgccagccctacctccagtgaagtccagcaggtgccaagccctgtctcctctgagcctcccaaagctgccagaccccctgtgacacctgtcctgctagagaagaaaagcccactgggccagagccagcccacggtggcaggacagccctcagcccgcccagcagcagaggaatatggctacatcgtcactgatcagaatgtggtgggaccagccctcaccttccgcatccggcacaatgagcagaacctgtctttggctgatgtgacccaacaagcagggctggtgaagtctgaactggaagcacagacagggctccaaatcttgcagacaggagtgggacagagggaggaggcagctgcagtccttccccaaactgcgcacagcacctcacccatgcgctcagtgctgctcactctggtggccctggcaggtgtggctgggctgctggtggctctggctgtggctctgtgtgtgcggcagcatgcgcggcagcaagacaaggagcgcctggcagccctggggcctgagggggcccatggtgacactacctttgagtaccaggacctgtgccgccagcacatggccacgaagtccttgttcaaccgggcagagggtccaccggagccttcacgggtgagcagtgtgtcctcccagttcagcgacgcagcccaggccagccccagctcccacagcagcaccccgtcctggtgcgaggagccggcccaagccaacatggacatctccacgggacacatgattctggcatacatggaggatcacctgcggaaccgggaccgccttgccaaggagtggcaggccctctgtgcctaccaagcagagccaaacacctgtgccaccgcgcagggggagggcaacatcaaaaagaaccggcatcctgacttcctgccctatgaccatgcccgcataaaactgaaggtggagagcagcccttctcggagcgattacatcaacgccagccccattattgagcatgaccctcggatgccagcctacatagccacgcagggcccgctgtcccataccatcgcagacttctggcagatggtgtgggagagcggctgcaccgtcatcgtcatgctgaccccgctggtggaggatggtgtcaagcagtgtgaccgctactggccagatgagggtgcctccctctaccacgtatatgaggtgaacctggtgtcggagcacatctggtgcgaggactttctggtgcggagcttctacctgaagaacgtgcagacccaggagacgcgcacgctcacgcagttccacttcctcagctggccggcagagggcacaccggcctccacgcggcccctgctggacttccgcaggaaggtgaacaagtgctaccggggccgctcctgccccatcatcgtgcactgcagtgatggtgcggggaggaccggcacctacatcctcatcgacatggtcctgaaccgcatggcaaaaggagtgaaggagattgacatcgctgccaccctggagcatgtccgtgaccagcggcctggccttgtccgctctaaggaccagtttgaatttgccctgacagccgtggcggaggaagtgaatgccatcctcaaggccctgccccagtgagaccctggggccccttggcgggcagcccagcctctgtccctctttgcctgtgtgagcatctctgtgtacccactcctcactgccccaccagccacctcttgggcatgctcagcccttcctagaagagtcaggaagggaaagccagaaggggcacgcctgcccagcctcgcatgccagagcctggggcatcccagagcccagggcatcccatgggggtgctgcagccaggaggagaggaaaggacatgggtagcaattctacccagagccttctcctgcctacattccctggcctggctctcctgtagctctcctggggttctgggagttccctgaacatctgtgtgtgtccccctatgctccagtatggaagaatggggtggagggtcgccacacccggctccccctgcttctcagccccgggcctgcctctgactcacacttgggcgctctgccctccctggcctcacgcccagcctcctcccaccaccctcccaccatgcgctgctcaacctctctccttctggcgcaagagaacatttctagaaaaaactacttttgtaccagtgtgaataaagttagtgtgttgtctgtgcagctgcaa

SEQ ID NO: 171875 - DNA, 563 bp, Homo sapiens
  Payload ID: 13771
  Gene Symbol: PTPRN
  Gene Name: protein tyrosine phosphatase, receptor type, N
  ENST ID: ENST00000412847
  CDS Start-End: 188-563
ctaagagaattgggctctggggaaaattgcaggctgtctatttgaccgcaggctctgctctcacctggaagtctgtattcaggatggcttgtttgggcagtgccaggtgggagtggggcaggcccggccccttttgcaagtcacctccccagttctccaacgcttacaaggtgtgctccgacaactcatgtcccaaggattgtcctggcacgatgacctcacccagtatgtgatctctcaggagatggagcgcatccccaggcttcgccccccagagccccgtccaagggacaggtctggcttggcacccaagagacctggtcctgctggagagctgcttttacaggacatccccactggctccgcccctgctgcccagcatcggcttccacaaccaccagtgggcaaaggtggagctggggccagctcctctctgtcccctctgcaggctgagctgctcccgcctctcttggagcacctgctgctgcccccacagcctccccacccttcactgagttacgaacctgccttgctgcagccctacctgttccaccagtttggct

SEQ ID NO: 171876 - DNA, 3313 bp, Homo sapiens
  Payload ID: 13771
  Gene Symbol: PTPRN
  Gene Name: protein tyrosine phosphatase, receptor type, N
  Uniprot ID: Q16849
  ENST ID: ENST00000423636
  CDS Start-End: 259-2928
attgcaggttcgggagaaggacacggggtgcatgtgggcagagggacttagagaccggctgcgagaccacaggagaagccacttgctccgaggcgcctgggaggctgtctatttgaccgcaggctctgctctcacctggaagtctgtattcaggatggcttgtttgggcagtgccaggtgggagtggggcaggcccggccccttttgcaagtcacctccccagttctccaacgcttacaaggtgtgctccgacaactcatgtcccaaggattgtcctggcacgatgacctcacccagtatgtgatctctcaggagatggagcgcatccccaggcttcgccccccagagccccgtccaagggacaggtctggcttggcacccaagagacctggtcctgctggagagctgcttttacaggacatccccactggctccgcccctgctgcccagcatcggcttccacaaccaccagtgggcaaaggtggagctggggccagctcctctctgtcccctctgcaggctgagctgctcccgcctctcttggagcacctgctgctgcccccacagcctccccacccttcactgagttacgaacctgccttgctgcagccctacctgttccaccagtttggctcccgtgatggctccagggtctcagagggctccccagggatggtcagtgtcggccccctgcccaaggctgaagcccctgccctcttcagcagaactgcctccaagggcatatttggggaccaccctggccactcctacggggaccttccagggccttcacctgcccagctttttcaagactctgggctgctctatctggcccaggagttgccagcacccagcagggccagggtgccaaggctgccagagcaagggagcagcagccgggcagaggactccccagagggctatgagaaggaaggactaggggatcgtggagagaagcctgcttccccagctgtgcagccagatgcggctctgcagaggctggccgctgtgctggcgggctatggggtagagctgcgtcagctgacccctgagcagctctccacactcctgaccctgctgcagctactgcccaagggtgcaggaagaaatccgggaggggttgtaaatgttggagctgatatcaagaaaacaatggaggggccggtggagggcagagacacagcagagcttccagcccgcacatcccccatgcctggacaccccactgccagccctacctccagtgaagtccagcaggtgccaagccctgtctcctctgagcctcccaaagctgccagaccccctgtgacacctgtcctgctagagaagaaaagcccactgggccagagccagcccacggtggcaggacagccctcagcccgcccagcagcagaggaatatggctacatcgtcactgatcagaagcccctgagcctggctgcaggagtgaagctgctggagatcctggctgagcatgtgcacatgtcctcaggcagcttcatcaacatcagtgtggtgggaccagccctcaccttccgcatccggcacaatgagcagaacctgtctttggctgatgtgacccaacaagcagggctggtgaagtctgaactggaagcacagacagggctccaaatcttgcagacaggagtgggacagagggaggaggcagctgcagtccttccccaaactgcgcacagcacctcacccatgcgctcagtgctgctcactctggtggccctggcaggtgtggctgggctgctggtggctctggctgtggctctgtgtgtgcggcagcatgcgcggcagcaagacaaggagcgcctggcagccctggggcctgagggggcccatggtgacactacctttgagtaccaggacctgtgccgccagcacatggccacgaagtccttgttcaaccgggcagagggtccaccggagccttcacgggtgagcagtgtgtcctcccagttcagcgacgcagcccaggccagccccagctcccacagcagcaccccgtcctggtgcgaggagccggcccaagccaacatggacatctccacgggacacatgattctggcatacatggaggatcacctgcggaaccgggaccgccttgccaaggagtggcaggccctctgtgcctaccaagcagagccaaacacctgtgccaccgcgcagggggagggcaacatcaaaaagaaccggcatcctgacttcctgccctatgaccatgcccgcataaaactgaaggtggagagcagcccttctcggagcgattacatcaacgccagccccattattgagcatgaccctcggatgccagcctacatagccacgcagggcccgctgtcccataccatcgcagacttctggcagatggtgtgggagagcggctgcaccgtcatcgtcatgctgaccccgctggtggaggatggtgtcaagcagtgtgaccgctactggccagatgagggtgcctccctctaccacgtatatgaggtgaacctggtgtcggagcacatctggtgcgaggactttctggtgcggagcttctacctgaagaacgtgcagacccaggagacgcgcacgctcacgcagttccacttcctcagctggccggcagagggcacaccggcctccacgcggcccctgctggacttccgcaggaaggtgaacaagtgctaccggggccgctcctgccccatcatcgtgcactgcagtgatggtgcggggaggaccggcacctacatcctcatcgacatggtcctgaaccgcatggcaaaaggagtgaaggagattgacatcgctgccaccctggagcatgtccgtgaccagcggcctggccttgtccgctctaaggaccagtttgaatttgccctgacagccgtggcggaggaagtgaatgccatcctcaaggccctgccccagtgagaccctggggccccttggcgggcagcccagcctctgtccctctttgcctgtgtgagcatctctgtgtacccactcctcactgccccaccagccacctcttgggcatgctcagcccttcctagaagagtcaggaagggaaagccagaaggggcacgcctgcccagcctcgcatgccagagcctggggcatcccagagcccagggcatcccatgggggtgctgcagccaggaggagaggaaaggacatgggtagcaattctacccagagccttctcctgcctacattccctggcctggctctcctgtagctctcctggggttctgggagttccctgaacatctgtgtgtgtccccctatgctccagtatggaagaatggggtggagg

SEQ ID NO: 171877 - DNA, 606 bp, Homo sapiens
  Payload ID: 13771
  Gene Symbol: PTPRN
  Gene Name: protein tyrosine phosphatase, receptor type, N
  ENST ID: ENST00000446182
  CDS Start-End: 233-606
gaagagggctacagggatggggccaagtgggaattctagcgaggcgcctactatttgatggaggagggatgggctaggctgtctatttgaccgcaggctctgctctcacctggaagtctgtattcaggatggcttgtttgggcagtgccaggtgggagtggggcaggcccggccccttttgcaagtcacctccccagttctccaacgcttacaaggtgtgctccgacaactcatgtcccaaggattgtcctggcacgatgacctcacccagtatgtgatctctcaggagatggagcgcatccccaggcttcgccccccagagccccgtccaagggacaggtctggcttggcacccaagagacctggtcctgctggagagctgcttttacaggacatccccactggctccgcccctgctgcccagcatcggcttccacaaccaccagtgggcaaaggtggagctggggccagctcctctctgtcccctctgcaggctgagctgctcccgcctctcttggagcacctgctgctgcccccacagcctccccacccttcactgagttacgaacctgccttgctgcagccctacctgttccaccagtttgg

SEQ ID NO: 171878 - DNA, 541 bp, Homo sapiens
  Payload ID: 13771
  Gene Symbol: PTPRN
  Gene Name: protein tyrosine phosphatase, receptor type, N
  ENST ID: ENST00000442029
  CDS Start-End: 282-541
aagagaattgggctctggggaaaattgcaggttcgggagaaggacacggggtgcatgtgggcagagggacttagagaccggctgcgagaccacaggagaagccacttgctccgaggcgcctgggaggctgtctatttgaccgcaggctctgctctcacctggaagtctgtattcaggatggcttgtttgggcagtgccaggtgggagtggggcaggcccggccccttttgcaagtcacctccccagttctccaacgcttacaaggtgtgctccgacaactcatgtcccaaggattgtcctggcacgatgacctcacccagtatgtgatctctcaggagatggagcgcatccccaggcttcgccccccagagccccgtccaagggacaggtctggcttggcacccaagagacctggtcctgctggagagctgcttttacaggacatccccactggctccgcccctgctgcccagcatcggcttccacaaccaccagtgggcaaaggtggagctggggccagctcctctctgtcccctctgca

SEQ ID NO: 171879 - DNA, 1051 bp, Homo sapiens
  Payload ID: 13771
  Gene Symbol: PTPRN
  Gene Name: protein tyrosine phosphatase, receptor type, N
  ENST ID: ENST00000443981
  CDS Start-End: 1-413
tgtgggagagcggctgcaccgtcatcgtcatgctgaccccgctggtggaggatggtgtcaagcagtgtgaccgctactggccagatgagggtgcctccctctaccacgtatatgaggtgaacctggtgtcggagcacatctggtgcgaggactttctggtgcggagcttctacctgaagaacgtgcagacccaggagacgcgcacgctcacgcagttccacttcctcagctggccggcagagggcacaccggcctccacgcggcccctgctggacttccgcaggaaggtgaacaagtgctaccggggccgctcctgccccatcatcgtgcactgcagtgatggtgcggggaggaccggcacctacatcctcatcgacatggtcctgaaccgcatggcaaaaggaccagtttgaatttgccctgacagccgtggcggaggaagtgaatgccatcctcaaggccctgccccagtgagaccctggggccccttggcgggcagcccagcctctgtccctctttgcctgtgtgagcatctctgtgtacccactcctcactgccccaccagccacctcttgggcatgctcagcccttcctagaagagtcaggaagggaaagccagaaggggcacgcctgcccagcctcgcatgccagagcctggggcatcccagagcccagggcatcccatgggggtgctgcagccaggaggagaggaaaggacatgggtagcaattctacccagagccttctcctgcctacattccctggcctggctctcctgtagctctcctggggttctgggagttccctgaacatctgtgtgtgtccccctatgctccagtatggaagaatggggtggagggtcgccacacccggctccccctgcttctcagccccgggcctgcctctgactcacacttgggcgctctgccctccctggcctcacgcccagcctcctcccaccaccctcccaccatgcgctgctcaacctctctccttctggcgcaagagaacatttctagaaaaaactacttttgtaccagtgtgaataaag

SEQ ID NO: 171880 - DNA, 466 bp, Homo sapiens
  Payload ID: 13771
  Gene Symbol: PTPRN
  Gene Name: protein tyrosine phosphatase, receptor type, N
  ENST ID: ENST00000451506
  CDS Start-End: 266-466
atatgtgacgcaaattagcttacgagccgggggtggaggtgtcgtcagcacccgcctgcggttggccgcgttgcagcgagaggggcatgtagaccccgcctcgtagggaggctgtctatttgaccgcaggctctgctctcacctggaagtctgtattcaggatggcttgtttgggcagtgccaggtgggagtggggcaggcccggccccttttgcaagtcacctccccagttctccaacgcttacaaggtgtgctccgacaactcatgtcccaaggattgtcctggcacgatgacctcacccagtatgtgatctctcaggagatggagcgcatccccaggcttcgccccccagagccccgtccaagggacaggtctggcttggcacccaagagacctggtcctgctggagagctgcttttacaggacatccccactggctccgcccctgctgcccagcatcggctt

SEQ ID NO: 171881 - DNA, 579 bp, Homo sapiens
  Payload ID: 13771
  Gene Symbol: PTPRN
  Gene Name: protein tyrosine phosphatase, receptor type, N
  ENST ID: ENST00000440552
  CDS Start-End: 82-579
agcttggggcctggagcgaaactcggtgggggtgagggtgaaatgtcatgaagctcggggagaatatgggttgggggaggcatgcgagatgaggaaggctgtctatttgaccgcaggctctgctctcacctggaagtctgtattcaggatggcttgtttgggcagtgccaggtgggagtggggcaggcccggccccttttgcaagtcacctccccagttctccaacgcttacaaggtgtgctccgacaactcatgtcccaaggattgtcctggcacgatgacctcacccagtatgtgatctctcaggagatggagcgcatccccaggcttcgccccccagagccccgtccaagggacaggtctggcttggcacccaagagacctggtcctgctggagagctgcttttacaggacatccccactggctccgcccctgctgcccagcatcggcttccacaaccaccagtgggcaaaggtggagctggggccagctcctctctgtcccctctgcaggctgagctgctcccgcctctcttggagcacctgctgctgcccccacagcctccccacccttcactg

SEQ ID NO: 171882 - DNA, 592 bp, Homo sapiens
  Payload ID: 13771
  Gene Symbol: PTPRN
  Gene Name: protein tyrosine phosphatase, receptor type, N
  ENST ID: ENST00000606213
  CDS Start-End: 50-208
agcgtcgctgcggctccggcccgggagcgagcgcccggagctcggaaagatgcggcgcccgcggcggcctgggggtctcgggggatccgggggtctccggctgctcctctgcctcctgctgctgagcagccgcccggggggctgcagcgccgttagtgcccacggttcgggagaaggacacggggtgcatgtgggcagagggacttagagaccggctgcgagaccacaggagaagccacttgctccgaggcgcctgggaggctgtctatttgaccgcaggctctgctctcacctggaagtctgtattcaggatggcttgtttgggcagtgccaggtgggagtggggcaggcccggccccttttgcaagtcacctccccagttctccaacgcttacaaggtgtgctccgacaactcatgtcccaaggattgtcctggcacgatgacctcacccagtatgtgatctctcaggagatggagcgcatccccaggcttcgccccccagagccccgtccaagggacaggtctggcttggcacccaagagacctggtcctgctggagagctgcttttacaggacatccccactggctcc

SEQ ID NO: 171883 - DNA, 4723 bp, Homo sapiens
  Payload ID: 13772
  Gene Symbol: PTPRN2
  Gene Name: protein tyrosine phosphatase, receptor type, N polypeptide 2
  Uniprot ID: Q92932
  ENST ID: ENST00000389413
  CDS Start-End: 105-3065
ggcgggaggagccggcggcgcgcgcctccctgggcccggactcggccgcctcccgccgcctcccgcgcggccatggactgagcgccgccggccaggccgcggggatggggccgccgctcccgctgctgctgctgctactgctgctgctgccgccacgcgtcctgcctgccgccccttcgtccgtcccccgcggccggcagctcccggggcgtctgggctgcctgctcgaggagggcctctgcggagcgtccgaggcctgtgtgaacgatggagtgtttggaaggtgccagaaggttccggcaatggacttttaccgctacgaggtgtcgcccgtggccctgcagcgcctgcgcgtggcgttgcagaagctttccggcacaggtttcacgtggcaggatgactatactcagtatgtgatggaccaggaacttgcagacctcccgaaaacctacctgaggcgtcctgaagcatccagcccagccaggccctcaaaacacagcgttggcagcgagaggaggtacagtcgggagggcggtgctgccctggccaacgccctccgacgccacctgcccttcctggaggccctgtcccaggccccagcctcagacgtgctcgccaggacccatacggcgcaggacagaccccccgctgagggtgatgaccgcttctccgagagcatcctgacctatgtggcccacacgtctgcgctgacctaccctcccgggtcccggacccagctccgcgaggacctcctgccgcggaccctcggccagctccagccagatgagctcagccctaaggtggacagtggtgtggacagacaccatctgatggcggccctcagtgcctatgctgcccagaggcccccagctccccccggggagggcagcctggagccacagtaccttctgcgtgcaccctcaagaatgcccaggcctttgctggcaccagccgccccccagaagtggccttcacctctgggagattccgaagacccctccagcacaggcgatggagcacggattcataccctcctgaaggacctgcagaggcagccggctgaggtgaggggcctgagtggcctggagctggacggcatggctgagctgatggctggcctgatgcaaggcgtggaccatggagtagctcgaggcagccctgggagagcggccctgggagagtctggagaacaggcggatggccccaaggccaccctccgtggagacagctttccagatgacggagtgcaggacgacgatgatagactttaccaagaggtccatcgtctgagtgccacactcgggggcctcctgcaggaccacgggtctcgactcttacctggagccctcccctttgcaaggcccctcgacatggagaggaagaagtccgagcaccctgagtcttccctgtcttcagaagaggagactgccggagtggagaacgtcaagagccagacgtattccaaagatctgctggggcagcagccgcattcggagcccggggccgctgcgtttggggagctccaaaaccagatgcctgggccctcgaaggaggagcagagccttccagcgggtgctcaggaggccctcagcgacggcctgcaattggaggtccagccttccgaggaagaggcgcggggctacatcgtgacagacagagaggttctcggaccagcagtgaccttcaaagtgagcgccaatgtccaaaacgtgaccactgaggatgtggagaaggccacagttgacaacaaagacaaactggaggaaacctctggactgaaaattcttcaaaccggagtcgggtcgaaaagcaaactcaagttcctgcctcctcaggcggagcaagaagactccaccaagttcatcgcgctcaccctggtctccctcgcctgcatcctgggcgtcctcctggcctctggcctcatctactgcctccgccatagctctcagcacaggctgaaggagaagctctcgggactagggggcgacccaggtgcagatgccactgccgcctaccaggagctgtgccgccagcgtatggccacgcggccaccagaccgacctgagggcccgcacacgtcacgcatcagcagcgtctcatcccagttcagcgacgggccgatccccagcccctccgcacgcagcagcgcctcatcctggtccgaggagcctgtgcagtccaacatggacatctccaccggccacatgatcctgtcctacatggaggaccacctgaagaacaagaaccggctggagaaggagtgggaagcgctgtgcgcctaccaggcggagcccaacagctcgttcgtggcccagagggaggagaacgtgcccaagaaccgctccctggccgtgctgacctatgaccactcccgggtcctgctgaaggcggagaacagccacagccactcagactacatcaacgctagccccatcatggatcacgacccgaggaaccccgcgtacatcgccacccagggaccgctgcccgccaccgtggctgacttttggcagatggtgtgggagagcggctgcgtggtgatcgtcatgctgacacccctcgcggagaacggcgtccggcagtgctaccactactggccggatgaaggctccaatctctaccacatctatgaggtgaacctggtctccgagcacatctggtgtgaggacttcctggtgaggagcttctatctgaagaacctgcagaccaacgagacgcgcaccgtgacgcagttccacttcctgagttggtatgaccgaggagtcccttcctcctcaaggtccctcctggacttccgcagaaaagtaaacaagtgctacaggggccgttcttgtccaataattgttcattgcagtgacggtgcaggccggagcggcacctacgtcctgatcgacatggttctcaacaagatggccaaaggtgctaaagagattgatatcgcagcgaccctggagcacttgagggaccagagacccggcatggtccagacgaaggagcagtttgagttcgcgctgacagccgtggctgaggaggtgaacgccatcctcaaggcccttccccagtgagcggcagcctcaggggcctcaggggagcccccaccccacggatgttgtcaggaatcatgatctgactttaattgtgtgtcttctattataactgcatagtaatagggcccttagctctcccgtagtcagcgcagtttagcagttaaaagtgtatttttgtttaatcaaacaataataaagagagatttgtggaaaaatccagttacgggtggaggggaatcggttcatcaattttcacttgcttaaaaaaaatactttttcttaaagcacccgttcaccttcttggttgaagttgtgttaacaatgcagtagccagcacgttcgaggcggtttccaggaagagtgtgcttgtcatctgccactttcgggagggtggatccactgtgcaggagtggccggggaagctggcagcactcagtgaggccgcccggcacacaaggcacgtttggcatttctctttgagagagtttatcattgggagaagccgcagggacagaactgaacgtcctgcagcttcggggcaagtgagacaatcacagctcctcgctgcgtctccatcaacactgcgccgggtaccatggacggccccgtcagccacacctgtcagcccaagcagagtgattcaggggctccccgggggcagacacctgtgcaccccatgagtagtgcccacttgaggctggcactcccctgacctcacctttgcaaagttacagatgcaccccaacattgagatgtgtttttaatgttaaaatattgatttctacgttatgaaaacagatgcccccgtgaatgcttacctgtgagataaccacaaccaggaagaacaaatctgggcattgagcaagctatgagggtccccgggagcacacgaaccctgccaggcccccgctggctcctccaggcacgtcccggacctgtggggccccagagaggggacatttccctcctgggagagaaggagatcagggcaactcggagagggctgcgagcatttccctcccgggagaggagatcagggcgacctgcacgcactgcgtagagcctggaagggaagtgagaaaccagccgaccggccctgcccctcttcccgggatcacttaatgaaccacgtgttttgacatcatgtaaacctaagcacgtagagatgattcggatttgacaaaataacatttgagtatccgattcgccatcaccccctaccccagaaataggacaattcacttcattgaccaagatgatcacatggaaggcggcacagaggcagctgtgtgggctgcagatttcctgtgtggggttcagcgtagaaaacgcacctccatcccgcccttcccacagcattcctccatcttagatagatggtactctccaaaggccctaccagagggaacacggcctactgagcggacagaatgatgccaaaatattgcttatgtctctacatggtattgtaatgaatatctgctttaatatagctatcatttcttttccaaaattacttctctctatctggaatttaattaatcgaaatgaatttatctgaatataggaagcatatgcctacttgtaatttctaactccttatgtttgaagagaaacctccggtgtgagatatacaaatatatttaattgtgtcatattaaacttctgatttcaca

SEQ ID NO: 171884 - DNA, 4692 bp, Homo sapiens
  Payload ID: 13772
  Gene Symbol: PTPRN2
  Gene Name: protein tyrosine phosphatase, receptor type, N polypeptide 2
  Uniprot ID: Q92932
  ENST ID: ENST00000389416
  CDS Start-End: 43-3039
ccgcgcggccatggactgagcgccgccggccaggccgcggggatggggccgccgctcccgctgctgctgctgctactgctgctgctgccgccacgcgtcctgcctgccgccccttcgtccgtcccccgcggccggcagctcccggggcgtctggatggagtgtttggaaggtgccagaaggttccggcaatggacttttaccgctacgaggtgtcgcccgtggccctgcagcgcctgcgcgtggcgttgcagaagctttccggcacaggtttcacgtggcaggatgactatactcagtatgtgatggaccaggaacttgcagacctcccgaaaacctacctgaggcgtcctgaagcatccagcccagccaggccctcaaaacacagcgttggcagcgagaggaggtacagtcgggagggcggtgctgccctggccaacgccctccgacgccacctgcccttcctggaggccctgtcccaggccccagcctcagacgtgctcgccaggacccatacggcgcaggacagaccccccgctgagggtgatgaccgcttctccgagagcatcctgacctatgtggcccacacgtctgcgctgacctaccctcccgggtcccggacccagctccgcgaggacctcctgccgcggaccctcggccagctccagccagatgagctcagccctaaggtggacagtggtgtggacagacaccatctgatggcggccctcagtgcctatgctgcccagaggcccccagctccccccggggagggcagcctggagccacagtaccttctgcgtgcaccctcaagaatgcccaggcctttgctggcaccagccgccccccagaagtggccttcacctctgggagattccgaagacccctccagcacaggcgatggagcacggattcataccctcctgaaggacctgcagaggcagccggctgaggtgaggggcctgagtggcctggagctggacggcatggctgagctgatggctggcctgatgcaaggcgtggaccatggagtagctcgaggcagccctgggagagcggccctgggagagtctggagaacaggcggatggccccaaggccaccctccgtggagacagctttccagatgacggagtgcaggacgacgatgatagactttaccaagaggtccatcgtctgagtgccacactcgggggcctcctgcaggaccacgggtctcgactcttacctggagccctcccctttgcaaggcccctcgacatggagaggaagaagtccgagcaccctgagtcttccctgtcttcagaagaggagactgccggagtggagaacgtcaagagccagacgtattccaaagatctgctggggcagcagccgcattcggagcccggggccgctgcgtttggggagctccaaaaccagatgcctgggccctcgaaggaggagcagagccttccagcgggtgctcaggaggccctcagcgacggcctgcaattggaggtccagccttccgaggaagaggcgcggggctacatcgtgacagacagagaccccctgcgccccgaggaaggaaggcggctggtggaggacgtcgcccgcctcctgcaggtgcccagcagtgcgttcgctgacgtggaggttctcggaccagcagtgaccttcaaagtgagcgccaatgtccaaaacgtgaccactgaggatgtggagaaggccacagttgacaacaaagacaaactggaggaaacctctggactgaaaattcttcaaaccggagtcgggtcgaaaagcaaactcaagttcctgcctcctcaggcggagcaagaagactccaccaagttcatcgcgctcaccctggtctccctcgcctgcatcctgggcgtcctcctggcctctggcctcatctactgcctccgccatagctctcagcacaggctgaaggagaagctctcgggactagggggcgacccaggtgcagatgccactgccgcctaccaggagctgtgccgccagcgtatggccacgcggccaccagaccgacctgagggcccgcacacgtcacgcatcagcagcgtctcatcccagttcagcgacgggccgatccccagcccctccgcacgcagcagcgcctcatcctggtccgaggagcctgtgcagtccaacatggacatctccaccggccacatgatcctgtcctacatggaggaccacctgaagaacaagaaccggctggagaaggagtgggaagcgctgtgcgcctaccaggcggagcccaacagctcgttcgtggcccagagggaggagaacgtgcccaagaaccgctccctggccgtgctgacctatgaccactcccgggtcctgctgaaggcggagaacagccacagccactcagactacatcaacgctagccccatcatggatcacgacccgaggaaccccgcgtacatcgccacccagggaccgctgcccgccaccgtggctgacttttggcagatggtgtgggagagcggctgcgtggtgatcgtcatgctgacacccctcgcggagaacggcgtccggcagtgctaccactactggccggatgaaggctccaatctctaccacatctatgaggtgaacctggtctccgagcacatctggtgtgaggacttcctggtgaggagcttctatctgaagaacctgcagaccaacgagacgcgcaccgtgacgcagttccacttcctgagttggtatgaccgaggagtcccttcctcctcaaggtccctcctggacttccgcagaaaagtaaacaagtgctacaggggccgttcttgtccaataattgttcattgcagtgacggtgcaggccggagcggcacctacgtcctgatcgacatggttctcaacaagatggccaaaggtgctaaagagattgatatcgcagcgaccctggagcacttgagggaccagagacccggcatggtccagacgaaggagcagtttgagttcgcgctgacagccgtggctgaggaggtgaacgccatcctcaaggcccttccccagtgagcggcagcctcaggggcctcaggggagcccccaccccacggatgttgtcaggaatcatgatctgactttaattgtgtgtcttctattataactgcatagtaatagggcccttagctctcccgtagtcagcgcagtttagcagttaaaagtgtatttttgtttaatcaaacaataataaagagagatttgtggaaaaatccagttacgggtggaggggaatcggttcatcaattttcacttgcttaaaaaaaatactttttcttaaagcacccgttcaccttcttggttgaagttgtgttaacaatgcagtagccagcacgttcgaggcggtttccaggaagagtgtgcttgtcatctgccactttcgggagggtggatccactgtgcaggagtggccggggaagctggcagcactcagtgaggccgcccggcacacaaggcacgtttggcatttctctttgagagagtttatcattgggagaagccgcagggacagaactgaacgtcctgcagcttcggggcaagtgagacaatcacagctcctcgctgcgtctccatcaacactgcgccgggtaccatggacggccccgtcagccacacctgtcagcccaagcagagtgattcaggggctccccgggggcagacacctgtgcaccccatgagtagtgcccacttgaggctggcactcccctgacctcacctttgcaaagttacagatgcaccccaacattgagatgtgtttttaatgttaaaatattgatttctacgttatgaaaacagatgcccccgtgaatgcttacctgtgagataaccacaaccaggaagaacaaatctgggcattgagcaagctatgagggtccccgggagcacacgaaccctgccaggcccccgctggctcctccaggcacgtcccggacctgtggggccccagagaggggacatttccctcctgggagagaaggagatcagggcaactcggagagggctgcgagcatttccctcccgggagaggagatcagggcgacctgcacgcactgcgtagagcctggaagggaagtgagaaaccagccgaccggccctgcccctcttcccgggatcacttaatgaaccacgtgttttgacatcatgtaaacctaagcacgtagagatgattcggatttgacaaaataacatttgagtatccgattcgccatcaccccctaccccagaaataggacaattcacttcattgaccaagatgatcacatggaaggcggcacagaggcagctgtgtgggctgcagatttcctgtgtggggttcagcgtagaaaacgcacctccatcccgcccttcccacagcattcctccatcttagatagatggtactctccaaaggccctaccagagggaacacggcctactgagcggacagaatgatgccaaaatattgcttatgtctctacatggtattgtaatgaatatctgctttaatatagctatcatttcttttccaaaattacttctctctatctggaatttaattaatcgaaatgaatttatctgaatataggaagcatatgcctacttgtaatttctaactccttatgtttgaagagaaacctccggtgtgagatatacaaatatatttaattgtgtcatattaaacttctgatt

SEQ ID NO: 171885 - DNA, 4706 bp, Homo sapiens
  Payload ID: 13772
  Gene Symbol: PTPRN2
  Gene Name: protein tyrosine phosphatase, receptor type, N polypeptide 2
  Uniprot ID: Q92932
  ENST ID: ENST00000389418
  CDS Start-End: 11-3058
ggccgcggggatggggccgccgctcccgctgctgctgctgctactgctgctgctgccgccacgcgtcctgcctgccgccccttcgtccgtcccccgcggccggcagctcccggggcgtctgggctgcctgctcgaggagggcctctgcggagcgtccgaggcctgtgtgaacgatggagtgtttggaaggtgccagaaggttccggcaatggacttttaccgctacgaggtgtcgcccgtggccctgcagcgcctgcgcgtggcgttgcagaagctttccggcacaggtttcacgtggcaggatgactatactcagtatgtgatggaccaggaacttgcagacctcccgaaaacctacctgaggcgtcctgaagcatccagcccagccaggccctcaaaacacagcgttggcagcgagaggaggtacagtcgggagggcggtgctgccctggccaacgccctccgacgccacctgcccttcctggaggccctgtcccaggccccagcctcagacgtgctcgccaggacccatacggcgcaggacagaccccccgctgagggtgatgaccgcttctccgagagcatcctgacctatgtggcccacacgtctgcgctgacctaccctcccgggtcccggacccagctccgcgaggacctcctgccgcggaccctcggccagctccagccagatgagctcagccctaaggtggacagtggtgtggacagacaccatctgatggcggccctcagtgcctatgctgcccagaggcccccagctccccccggggagggcagcctggagccacagtaccttctgcgtgcaccctcaagaatgcccaggcctttgctggcaccagccgccccccagaagtggccttcacctctgggagattccgaagacccctccagcacaggcgatggagcacggattcataccctcctgaaggacctgcagaggcagccggctgaggtgaggggcctgagtggcctggagctggacggcatggctgagctgatggctggcctgatgcaaggcgtggaccatggagtagctcgaggcagccctgggagagcggccctgggagagtctggagaacaggcggatggccccaaggccaccctccgtggagacagctttccagatgacggagtgcaggacgacgatgatagactttaccaagaggtccatcgtctgagtgccacactcgggggcctcctgcaggaccacgggtctcgactcttacctggagccctcccctttgcaaggcccctcgacatggagaggaagaagtccgagcaccctgagtcttccctgtcttcagaagaggagactgccggagtggagaacgtcaagagccagacgtattccaaagatctgctggggcagcagccgcattcggagcccggggccgctgcgtttggggagctccaaaaccagatgcctgggccctcgaaggaggagcagagccttccagcgggtgctcaggaggccctcagcgacggcctgcaattggaggtccagccttccgaggaagaggcgcggggctacatcgtgacagacagagaccccctgcgccccgaggaaggaaggcggctggtggaggacgtcgcccgcctcctgcaggtgcccagcagtgcgttcgctgacgtggaggttctcggaccagcagtgaccttcaaagtgagcgccaatgtccaaaacgtgaccactgaggatgtggagaaggccacagttgacaacaaagacaaactggaggaaacctctggactgaaaattcttcaaaccggagtcgggtcgaaaagcaaactcaagttcctgcctcctcaggcggagcaagaagactccaccaagttcatcgcgctcaccctggtctccctcgcctgcatcctgggcgtcctcctggcctctggcctcatctactgcctccgccatagctctcagcacaggctgaaggagaagctctcgggactagggggcgacccaggtgcagatgccactgccgcctaccaggagctgtgccgccagcgtatggccacgcggccaccagaccgacctgagggcccgcacacgtcacgcatcagcagcgtctcatcccagttcagcgacgggccgatccccagcccctccgcacgcagcagcgcctcatcctggtccgaggagcctgtgcagtccaacatggacatctccaccggccacatgatcctgtcctacatggaggaccacctgaagaacaagaaccggctggagaaggagtgggaagcgctgtgcgcctaccaggcggagcccaacagctcgttcgtggcccagagggaggagaacgtgcccaagaaccgctccctggccgtgctgacctatgaccactcccgggtcctgctgaaggcggagaacagccacagccactcagactacatcaacgctagccccatcatggatcacgacccgaggaaccccgcgtacatcgccacccagggaccgctgcccgccaccgtggctgacttttggcagatggtgtgggagagcggctgcgtggtgatcgtcatgctgacacccctcgcggagaacggcgtccggcagtgctaccactactggccggatgaaggctccaatctctaccacatctatgaggtgaacctggtctccgagcacatctggtgtgaggacttcctggtgaggagcttctatctgaagaacctgcagaccaacgagacgcgcaccgtgacgcagttccacttcctgagttggtatgaccgaggagtcccttcctcctcaaggtccctcctggacttccgcagaaaagtaaacaagtgctacaggggccgttcttgtccaataattgttcattgcagtgacggtgcaggccggagcggcacctacgtcctgatcgacatggttctcaacaagatggccaaaggtgctaaagagattgatatcgcagcgaccctggagcacttgagggaccagagacccggcatggtccagacgaaggagcagtttgagttcgcgctgacagccgtggctgaggaggtgaacgccatcctcaaggcccttccccagtgagcggcagcctcaggggcctcaggggagcccccaccccacggatgttgtcaggaatcatgatctgactttaattgtgtgtcttctattataactgcatagtaatagggcccttagctctcccgtagtcagcgcagtttagcagttaaaagtgtatttttgtttaatcaaacaataataaagagagatttgtggaaaaatccagttacgggtggaggggaatcggttcatcaattttcacttgcttaaaaaaaatactttttcttaaagcacccgttcaccttcttggttgaagttgtgttaacaatgcagtagccagcacgttcgaggcggtttccaggaagagtgtgcttgtcatctgccactttcgggagggtggatccactgtgcaggagtggccggggaagctggcagcactcagtgaggccgcccggcacacaaggcacgtttggcatttctctttgagagagtttatcattgggagaagccgcagggacagaactgaacgtcctgcagcttcggggcaagtgagacaatcacagctcctcgctgcgtctccatcaacactgcgccgggtaccatggacggccccgtcagccacacctgtcagcccaagcagagtgattcaggggctccccgggggcagacacctgtgcaccccatgagtagtgcccacttgaggctggcactcccctgacctcacctttgcaaagttacagatgcaccccaacattgagatgtgtttttaatgttaaaatattgatttctacgttatgaaaacagatgcccccgtgaatgcttacctgtgagataaccacaaccaggaagaacaaatctgggcattgagcaagctatgagggtccccgggagcacacgaaccctgccaggcccccgctggctcctccaggcacgtcccggacctgtggggccccagagaggggacatttccctcctgggagagaaggagatcagggcaactcggagagggctgcgagcatttccctcccgggagaggagatcagggcgacctgcacgcactgcgtagagcctggaagggaagtgagaaaccagccgaccggccctgcccctcttcccgggatcacttaatgaaccacgtgttttgacatcatgtaaacctaagcacgtagagatgattcggatttgacaaaataacatttgagtatccgattcgccatcaccccctaccccagaaataggacaattcacttcattgaccaagatgatcacatggaaggcggcacagaggcagctgtgtgggctgcagatttcctgtgtggggttcagcgtagaaaacgcacctccatcccgcccttcccacagcattcctccatcttagatagatggtactctccaaaggccctaccagagggaacacggcctactgagcggacagaatgatgccaaaatattgcttatgtctctacatggtattgtaatgaatatctgctttaatatagctatcatttcttttccaaaattacttctctctatctggaatttaattaatcgaaatgaatttatctgaatataggaagcatatgcctacttgtaatttctaactccttatgtttgaagagaaacctccggtgtgagatatacaaatatatttaattgtgtcatattaaacttc

SEQ ID NO: 171886 - DNA, 1374 bp, Homo sapiens
  Payload ID: 13772
  Gene Symbol: PTPRN2
  Gene Name: protein tyrosine phosphatase, receptor type, N polypeptide 2
  ENST ID: ENST00000404321
  CDS Start-End: 1-1374
acaggtttcacgtggcaggatgactatactcagtatgtgatggaccaggaacttgcagacctcccgaaaacctacctgaggcgtcctgaagcatccagcccagccaggccctcaaaacacagcgttggcagcgagaggaggtacagtcgggagggcggtgctgccctggccaacgccctccgacgccacctgcccttcctggaggccctgtcccaggccccagcctcagacgtgctcgccaggacccatacggcgcaggacagaccccccgctgagggtgatgaccgcttctccgagagcatcctgacctatgtggcccacacgtctgcgctgacctaccctcccgggtcccggacccagctccgcgaggacctcctgccgcggaccctcggccagctccagccagatgagctcagccctaaggtggacagtggtgtggacagacaccatctgatggcggccctcagtgcctatgctgcccagaggcccccagctccccccggggagggcagcctggagccacagtaccttctgcgtgcaccctcaagaatgcccaggcctttgctggcaccagccgccccccagaagtggccttcacctctgggagattccgaagacccctccagcacaggcgatggagcacggattcataccctcctgaaggacctgcagaggcagccggctgaggtgaggggcctgagtggcctggagctggacggcatggctgagctgatggctggcctgatgcaaggcgtggaccatggagtagctcgaggcagccctgggagagcggccctgggagagtctggagaacaggcggatggccccaaggccaccctccgtggagacagctttccagatgacggagtgcaggacgacgatgatagactttaccaagaggtccatcgtctgagtgccacactcgggggcctcctgcaggaccacgggtctcgactcttacctggagccctcccctttgcaaggcccctcgacatggagaggaagaagtccgagcaccctgagtcttccctgtcttcagaagaggagactgccggagtggagaacgtcaagagccagacgtattccaaagatctgctggggcagcagccgcattcggagcccggggccgctgcgtttggggagctccaaaaccagatgcctgggccctcgaaggaggagcagagccttccagcgggtgctcaggaggccctcagcgacggcctgcaattggaggtccagccttccgaggaagaggcgcggggctacatcgtgacagacagagaccccctgcgccccgaggaaggaaggcggctggtggaggacgtcgcccgcctcctgcaggtgcccagcagtgcgttcgctgacgtggagtaa

SEQ ID NO: 171887 - DNA, 4711 bp, Homo sapiens
  Payload ID: 13772
  Gene Symbol: PTPRN2
  Gene Name: protein tyrosine phosphatase, receptor type, N polypeptide 2
  ENST ID: ENST00000409483
  CDS Start-End: 120-3053
gagcgcgagaggcgcggcgggaggagccggcggcgcgcgcctccctgggcccggactcggccgcctcccgccgcctcccgcgcggccatggactgagcgccgccggccaggccgcggggatggggccgccgctcccgctgctgctgctgctactgctgctgctgccgccacgcgtcctgcctgccgccccttcgtccgtcccccgcggccggcagctcccggggcgtctgggctgcctgctcgaggagggcctctgcggagcgtccgaggcctgtgtgaacggtttcacgtggcaggatgactatactcagtatgtgatggaccaggaacttgcagacctcccgaaaacctacctgaggcgtcctgaagcatccagcccagccaggccctcaaaacacagcgttggcagcgagaggaggtacagtcgggagggcggtgctgccctggccaacgccctccgacgccacctgcccttcctggaggccctgtcccaggccccagcctcagacgtgctcgccaggacccatacggcgcaggacagaccccccgctgagggtgatgaccgcttctccgagagcatcctgacctatgtggcccacacgtctgcgctgacctaccctcccgggtcccggacccagctccgcgaggacctcctgccgcggaccctcggccagctccagccagatgagctcagccctaaggtggacagtggtgtggacagacaccatctgatggcggccctcagtgcctatgctgcccagaggcccccagctccccccggggagggcagcctggagccacagtaccttctgcgtgcaccctcaagaatgcccaggcctttgctggcaccagccgccccccagaagtggccttcacctctgggagattccgaagacccctccagcacaggcgatggagcacggattcataccctcctgaaggacctgcagaggcagccggctgaggtgaggggcctgagtggcctggagctggacggcatggctgagctgatggctggcctgatgcaaggcgtggaccatggagtagctcgaggcagccctgggagagcggccctgggagagtctggagaacaggcggatggccccaaggccaccctccgtggagacagctttccagatgacggagtgcaggacgacgatgatagactttaccaagaggtccatcgtctgagtgccacactcgggggcctcctgcaggaccacgggtctcgactcttacctggagccctcccctttgcaaggcccctcgacatggagaggaagaagtccgagcaccctgagtcttccctgtcttcagaagaggagactgccggagtggagaacgtcaagagccagacgtattccaaagatctgctggggcagcagccgcattcggagcccggggccgctgcgtttggggagctccaaaaccagatgcctgggccctcgaaggaggagcagagccttccagcgggtgctcaggaggccctcagcgacggcctgcaattggaggtccagccttccgaggaagaggcgcggggctacatcgtgacagacagagaccccctgcgccccgaggaaggaaggcggctggtggaggacgtcgcccgcctcctgcaggtgcccagcagtgcgttcgctgacgtggaggttctcggaccagcagtgaccttcaaagtgagcgccaatgtccaaaacgtgaccactgaggatgtggagaaggccacagttgacaacaaagacaaactggaggaaacctctggactgaaaattcttcaaaccggagtcgggtcgaaaagcaaactcaagttcctgcctcctcaggcggagcaagaagactccaccaagttcatcgcgctcaccctggtctccctcgcctgcatcctgggcgtcctcctggcctctggcctcatctactgcctccgccatagctctcagcacaggctgaaggagaagctctcgggactagggggcgacccaggtgcagatgccactgccgcctaccaggagctgtgccgccagcgtatggccacgcggccaccagaccgacctgagggcccgcacacgtcacgcatcagcagcgtctcatcccagttcagcgacgggccgatccccagcccctccgcacgcagcagcgcctcatcctggtccgaggagcctgtgcagtccaacatggacatctccaccggccacatgatcctgtcctacatggaggaccacctgaagaacaagaaccggctggagaaggagtgggaagcgctgtgcgcctaccaggcggagcccaacagctcgttcgtggcccagagggaggagaacgtgcccaagaaccgctccctggccgtgctgacctatgaccactcccgggtcctgctgaaggcggagaacagccacagccactcagactacatcaacgctagccccatcatggatcacgacccgaggaaccccgcgtacatcgccacccagggaccgctgcccgccaccgtggctgacttttggcagatggtgtgggagagcggctgcgtggtgatcgtcatgctgacacccctcgcggagaacggcgtccggcagtgctaccactactggccggatgaaggctccaatctctaccacatctatgaggtgaacctggtctccgagcacatctggtgtgaggacttcctggtgaggagcttctatctgaagaacctgcagaccaacgagacgcgcaccgtgacgcagttccacttcctgagttggtatgaccgaggagtcccttcctcctcaaggtccctcctggacttccgcagaaaagtaaacaagtgctacaggggccgttcttgtccaataattgttcattgcagtgacggtgcaggccggagcggcacctacgtcctgatcgacatggttctcaacaagatggccaaaggtgctaaagagattgatatcgcagcgaccctggagcacttgagggaccagagacccggcatggtccagacgaaggagcagtttgagttcgcgctgacagccgtggctgaggaggtgaacgccatcctcaaggcccttccccagtgagcggcagcctcaggggcctcaggggagcccccaccccacggatgttgtcaggaatcatgatctgactttaattgtgtgtcttctattataactgcatagtaatagggcccttagctctcccgtagtcagcgcagtttagcagttaaaagtgtatttttgtttaatcaaacaataataaagagagatttgtggaaaaatccagttacgggtggaggggaatcggttcatcaattttcacttgcttaaaaaaaatactttttcttaaagcacccgttcaccttcttggttgaagttgtgttaacaatgcagtagccagcacgttcgaggcggtttccaggaagagtgtgcttgtcatctgccactttcgggagggtggatccactgtgcaggagtggccggggaagctggcagcactcagtgaggccgcccggcacacaaggcacgtttggcatttctctttgagagagtttatcattgggagaagccgcagggacagaactgaacgtcctgcagcttcggggcaagtgagacaatcacagctcctcgctgcgtctccatcaacactgcgccgggtaccatggacggccccgtcagccacacctgtcagcccaagcagagtgattcaggggctccccgggggcagacacctgtgcaccccatgagtagtgcccacttgaggctggcactcccctgacctcacctttgcaaagttacagatgcaccccaacattgagatgtgtttttaatgttaaaatattgatttctacgttatgaaaacagatgcccccgtgaatgcttacctgtgagataaccacaaccaggaagaacaaatctgggcattgagcaagctatgagggtccccgggagcacacgaaccctgccaggcccccgctggctcctccaggcacgtcccggacctgtggggccccagagaggggacatttccctcctgggagagaaggagatcagggcaactcggagagggctgcgagcatttccctcccgggagaggagatcagggcgacctgcacgcactgcgtagagcctggaagggaagtgagaaaccagccgaccggccctgcccctcttcccgggatcacttaatgaaccacgtgttttgacatcatgtaaacctaagcacgtagagatgattcggatttgacaaaataacatttgagtatccgattcgccatcaccccctaccccagaaataggacaattcacttcattgaccaagatgatcacatggaaggcggcacagaggcagctgtgtgggctgcagatttcctgtgtggggttcagcgtagaaaacgcacctccatcccgcccttcccacagcattcctccatcttagatagatggtactctccaaaggccctaccagagggaacacggcctactgagcggacagaatgatgccaaaatattgcttatgtctctacatggtattgtaatgaatatctgctttaatatagctatcatttcttttccaaaattacttctctctatctggaatttaattaatcgaaatgaatttatctgaatataggaagcatatgcctacttgtaatttctaactccttatgtttgaagagaaacctccggtgtgagatatacaaatatatttaattgtgtcatattaaacttctgatttcaca

SEQ ID NO: 171888 - DNA, 114 bp, Homo sapiens
  Payload ID: 13772
  Gene Symbol: PTPRN2
  Gene Name: protein tyrosine phosphatase, receptor type, N polypeptide 2
  ENST ID: ENST00000631503
  CDS Start-End: 1-114
atggagtgtttggaaggtgccagaaggttccggcaatggacttttaccgctacgaggtgtcgcccgtggccctgcagcgcctgcgcgtggcgttgcagaagctttccggcacag

SEQ ID NO: 171889 - DNA, 114 bp, Homo sapiens; identical to SEQ ID NO: 171888
  Payload ID: 13772
  Gene Symbol: PTPRN2
  Gene Name: protein tyrosine phosphatase, receptor type, N polypeptide 2
  ENST ID: ENST00000633393
  CDS Start-End: 1-114

SEQ ID NO: 171890 - DNA, 114 bp, Homo sapiens; identical to SEQ ID NO: 171888
  Payload ID: 13772
  Gene Symbol: PTPRN2
  Gene Name: protein tyrosine phosphatase, receptor type, N polypeptide 2
  ENST ID: ENST00000633583
  CDS Start-End: 1-114

SEQ ID NO: 171891 - DNA, 5301 bp, Homo sapiens
  Payload ID: 13773
  Gene Symbol: PTPRO
  Gene Name: protein tyrosine phosphatase, receptor type, O
  Uniprot ID: Q16827
  ENST ID: ENST00000281171
  CDS Start-End: 331-3981
cgcggggtccccgcctctcgctcaccacacagaccccgcgcctcctctggcagccgcggtggtggcggcggcagagcctcgcccactccaatccccaccctctccatccttagtcattaaagaacagcagcgcctggcacgttcttggaggaccccgggcgcagaggaggaaagggagcaggcgcagggggactggaaaggcagcatgcgctcgccaggagcaacctcggcgcccagggtctgaggctgcagccccagttcgccattgtgagccgccgccgggggagtccgctagcgcagccgtgcccccgagtccccgtccgcgcagcgatggggcacctgcccacggggatacacggcgcccgccgcctcctgcctctgctctggctctttgtgctgttcaagaatgctacagctttccatgtaactgtccaagatgataataacatcgttgtctcattagaagcttcagacgtcatcagtccagcatctgtgtatgttgtgaagataactggtgaatccaaaaattatttcttcgaatttgaggaattcaacagcactttgcctcctcctgttattttcaaggccagttatcatggcctttattatataatcactctggtagtggtaaatggaaatgtggtgaccaagccatccagatcaatcactgtgttaacaaaacctctacctgtaaccagtgtttccatatatgactataaaccttctcctgaaacaggagtcctgtttgaaatacattatccagaaaaatataacgttttcacaagagtgaacattagctactgggaaggtaaagacttccggacaatgctatataaagatttctttaagggaaaaacagtatttaatcactggctgccaggaatgtgttatagtaatatcacctttcagctggtatctgaggcaacttttaataaaagtacccttgttgagtacagtggtgtcagtcacgaacccaaacagcacagaactgccccttatccacctcaaaatatttccgttcgtatcgtaaacttgaacaaaaacaactgggaagaacagagtggcaatttcccagaagaatccttcatgagatcacaagatacaataggaaaagaaaaactcttccattttacagaagaaacccctgaaattccctcgggcaacatttcttccggttggcctgattttaatagcagtgactatgaaactacgtctcagccatattggtgggacagtgcatctgcagctcctgaaagtgaagatgaatttgtcagcgtacttcccatggaatacgaaaataacagtacactcagtgagacagagaagtcaacatcaggctctttctcctttttccctgtgcaaatgatattgacctggttaccacccaaaccacccactgcttttgatgggttccatatccatattgaacgagaagagaactttactgaatatttgatggtggatgaagaagcacatgaatttgttgcagaactgaaggaacctgggaaatataagttatctgtgacaacctttagttcctcaggatcttgtgaaactcgaaaaagtcagtcagcaaaatcactcagcttttatatcagtccttcaggagagtggattgaagaactgaccgagaagccgcagcacgtgagtgtccacgttttaagctcaaccactgccttgatgtcctggacatcttcccaagagaactacaacagcaccattgtgtctgtggtgtcgctgacctgccagaaacaaaaggagagccagaggcttgaaaagcagtactgcactcaggtgaactcaagcaaacctattattgaaaatctggttcctggtgcccagtaccaggttgtaatatacctaaggaaaggccctttgattggaccaccttcagatcctgtgacatttgctattgttcccacaggaataaaggatttaatgctctatcctttgggtcctacggccgtggttctgagctggaccagaccttatttaggcgtgttcagaaaatacgtggttgaaatgttttatttcaaccctgctacaatgacatcagagtggaccacctactatgaaatagcagcaactgtttccttaactgcatccgtgagaatagctaatctgctgccagcatggtactacaacttccgggttaccatggtgacgtggggagatccagaattgagctgctgtgacagctctaccatcagcttcataacagccccagtggctccggaaatcacttctgtggaatatttcaacagtctgttatatatcagttggacatatggggatgatacaacggacttgtcccattctagaatgcttcactggatggtggttgcagaaggaaaaaagaaaattaaaaagagtgtaacacgcaatgtcatgactgcaattctcagcttgcctccaggcgacatctataacctctcagtaactgcttgtactgaaagaggaagtaatacctccatgctccgccttgtcaagctagaaccagctccacccaaatcactcttcgcagtgaacaaaacccagacttcagtgactttgctgtgggtggaagagggagtagctgatttctttgaagttttctgtcaacaagttggctccagtcagaaaaccaaacttcaggaaccagttgctgtttcttcccatgtcgtgaccatctccagccttcttcctgccactgcctacaattgtagtgtcaccagctttagccatgacagccccagtgtccctacgttcatagccgtctcaacaatggttacagagatgaatcccaatgtggtagtgatctccgtgctggccatccttagcacacttttaattggactgttgcttgttaccctcattattcttaggaaaaagcatctgcagatggctagggagtgtggagctggtacatttgtcaattttgcatccttagagagggatggaaagcttccatacaactggcgtaggagtatatttgctttcttaaccctgctaccctcatgtctttggactgattatcttttggcattttatattaatccttggagtaaaaatggtttaaagaagaggaaactgacaaacccggttcaactggatgactttgatgcctatattaaggatatggccaaagactctgactataaattttctcttcagtttgaggagttgaaattgattggactggatatcccacactttgctgcagatcttccactgaatcgatgtaaaaaccgttacacaaacatcctaccatatgacttcagccgtgtgagattagtctccatgaatgaagaggaaggtgcagactacatcaatgccaactatattcctggatacaactcaccccaggagtatattgccacccaggggccactgcctgaaaccagaaatgacttctggaagatggtcctgcaacaaaagtctcagattattgtcatgctcactcagtgtaatgagaaaaggagggtgaaatgtgaccattactggccattcacggaagaacctatagcctatggagacatcactgtggagatgatttcagaggaagagcaggacgactgggcctgtagacacttccggatcaactatgctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcagtgctggcgtgggacggacaggaacattcattgccctggacaggctcttgcagcacattcgggatcatgagtttgttgacatcttagggctggtgtcagaaatgaggtcataccggatgtctatggtacagacagaggagcagtacatttttatccatcagtgtgtgcaactgatgtggatgaagaagaagcagcagttctgcatcagtgatgtcatatacgagaatgttagcaagtcctagttcagaatccggagcagagaggacatgatgtgcgcccatcctcccttgcttccagattgttttagtgggccctgatggtcatttttctaaacagaggccctgctttgtaatatgtggccaaggagataatttatctcacagaagcaccgggaagacttagccttaaagagcctacagtgtccttttggactctttcacttcgggacatttaataatggaccaaattcaacagaacaccaggaaggtcaagacgctctccaaagggcaggaagtacagcacttccgaagagtttagttggccctttgctggttgggctgagttttttatttttaagtgtttgtttttcagtgcaataatttttgtgtgtgtgtgattcttatcagaaagttgaattgttttctgcctacaccgttcatcagccccataacccaggaaggaacaggcattgttagcatcagattatacctcattattaaaaggaggcatggccacacatgaagaaatggtcattctacttcaaagaaattgagccagcactatctgtactccaacattaccggatctggattggggaggttggtcagggaagagaggggttctacccacagatcaactgtgtaatcttttactattcaagctataattcagcttcaaagtagagtagaaaaaaaattgtcttaactgttctagttcttgatggttttcttccttattaacagttggtgtttcttccttggcccttttggactaatgttactgtccaagttctttctcaagaaaccacatctggttcagaagagtgtcaagttggactctttgaactctgttgctgtctgagcaatcgtggtgcctagactttgcattccttgttctgttgacctgcatacatgtgagagctatttctttaagaactatataggctgtgaaaacgcactttctttcccccaaagagctgggaatttatgaagttatggcaatgaactgcagcatgctgggacaattatttgactacttttttttgtaatattgtcaaatgtctctatggattctgacagagatttctttttgttttgttattcttttggttgtcagtttcattttaacgagtgtaactagtaacattttattctttggattttgtataattacagtacatgattgtgtattgtgacatgaatgctgtcaaaatgacattgatggcattgtgaagcctgttactttgtgtcacttcctgataaataagaggtgatgacatggatatacaacagaaaacactttgagttgaaagtaaacacaagctggctgcttccctgtggcaa

SEQ ID NO: 171892 - DNA, 5061 bp, Homo sapiens
  Payload ID: 13773
  Gene Symbol: PTPRO
  Gene Name: protein tyrosine phosphatase, receptor type, O
  Uniprot ID: Q16827
  ENST ID: ENST00000348962
  CDS Start-End: 175-3741
gggcgcagaggaggaaagggagcaggcgcagggggactggaaaggcagcatgcgctcgccaggagcaacctcggcgcccagggtctgaggctgcagccccagttcgccattgtgagccgccgccgggggagtccgctagcgcagccgtgcccccgagtccccgtccgcgcagcgatggggcacctgcccacggggatacacggcgcccgccgcctcctgcctctgctctggctctttgtgctgttcaagaatgctacagctttccatgtaactgtccaagatgataataacatcgttgtctcattagaagcttcagacgtcatcagtccagcatctgtgtatgttgtgaagataactggtgaatccaaaaattatttcttcgaatttgaggaattcaacagcactttgcctcctcctgttattttcaaggccagttatcatggcctttattatataatcactctggtagtggtaaatggaaatgtggtgaccaagccatccagatcaatcactgtgttaacaaaacctctacctgtaaccagtgtttccatatatgactataaaccttctcctgaaacaggagtcctgtttgaaatacattatccagaaaaatataacgttttcacaagagtgaacattagctactgggaaggtaaagacttccggacaatgctatataaagatttctttaagggaaaaacagtatttaatcactggctgccaggaatgtgttatagtaatatcacctttcagctggtatctgaggcaacttttaataaaagtacccttgttgagtacagtggtgtcagtcacgaacccaaacagcacagaactgccccttatccacctcaaaatatttccgttcgtatcgtaaacttgaacaaaaacaactgggaagaacagagtggcaatttcccagaagaatccttcatgagatcacaagatacaataggaaaagaaaaactcttccattttacagaagaaacccctgaaattccctcgggcaacatttcttccggttggcctgattttaatagcagtgactatgaaactacgtctcagccatattggtgggacagtgcatctgcagctcctgaaagtgaagatgaatttgtcagcgtacttcccatggaatacgaaaataacagtacactcagtgagacagagaagtcaacatcaggctctttctcctttttccctgtgcaaatgatattgacctggttaccacccaaaccacccactgcttttgatgggttccatatccatattgaacgagaagagaactttactgaatatttgatggtggatgaagaagcacatgaatttgttgcagaactgaaggaacctgggaaatataagttatctgtgacaacctttagttcctcaggatcttgtgaaactcgaaaaagtcagtcagcaaaatcactcagcttttatatcagtccttcaggagagtggattgaagaactgaccgagaagccgcagcacgtgagtgtccacgttttaagctcaaccactgccttgatgtcctggacatcttcccaagagaactacaacagcaccattgtgtctgtggtgtcgctgacctgccagaaacaaaaggagagccagaggcttgaaaagcagtactgcactcaggtgaactcaagcaaacctattattgaaaatctggttcctggtgcccagtaccaggttgtaatatacctaaggaaaggccctttgattggaccaccttcagatcctgtgacatttgctattgttcccacaggaataaaggatttaatgctctatcctttgggtcctacggccgtggttctgagctggaccagaccttatttaggcgtgttcagaaaatacgtggttgaaatgttttatttcaaccctgctacaatgacatcagagtggaccacctactatgaaatagcagcaactgtttccttaactgcatccgtgagaatagctaatctgctgccagcatggtactacaacttccgggttaccatggtgacgtggggagatccagaattgagctgctgtgacagctctaccatcagcttcataacagccccagtggctccggaaatcacttctgtggaatatttcaacagtctgttatatatcagttggacatatggggatgatacaacggacttgtcccattctagaatgcttcactggatggtggttgcagaaggaaaaaagaaaattaaaaagagtgtaacacgcaatgtcatgactgcaattctcagcttgcctccaggcgacatctataacctctcagtaactgcttgtactgaaagaggaagtaatacctccatgctccgccttgtcaagctagaaccagctccacccaaatcactcttcgcagtgaacaaaacccagacttcagtgactttgctgtgggtggaagagggagtagctgatttctttgaagttttctgtcaacaagttggctccagtcagaaaaccaaacttcaggaaccagttgctgtttcttcccatgtcgtgaccatctccagccttcttcctgccactgcctacaattgtagtgtcaccagctttagccatgacagccccagtgtccctacgttcatagccgtctcaacaatggttacagagatgaatcccaatgtggtagtgatctccgtgctggccatccttagcacacttttaattggactgttgcttgttaccctcattattcttaggaaaaagcatctgcagatggctagggagtgtggagctggtacatttgtcaattttgcatccttagagagggatggaaagcttccatacaactggagtaaaaatggtttaaagaagaggaaactgacaaacccggttcaactggatgactttgatgcctatattaaggatatggccaaagactctgactataaattttctcttcagtttgaggagttgaaattgattggactggatatcccacactttgctgcagatcttccactgaatcgatgtaaaaaccgttacacaaacatcctaccatatgacttcagccgtgtgagattagtctccatgaatgaagaggaaggtgcagactacatcaatgccaactatattcctggatacaactcaccccaggagtatattgccacccaggggccactgcctgaaaccagaaatgacttctggaagatggtcctgcaacaaaagtctcagattattgtcatgctcactcagtgtaatgagaaaaggagggtgaaatgtgaccattactggccattcacggaagaacctatagcctatggagacatcactgtggagatgatttcagaggaagagcaggacgactgggcctgtagacacttccggatcaactatgctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcagtgctggcgtgggacggacaggaacattcattgccctggacaggctcttgcagcacattcgggatcatgagtttgttgacatcttagggctggtgtcagaaatgaggtcataccggatgtctatggtacagacagaggagcagtacatttttatccatcagtgtgtgcaactgatgtggatgaagaagaagcagcagttctgcatcagtgatgtcatatacgagaatgttagcaagtcctagttcagaatccggagcagagaggacatgatgtgcgcccatcctcccttgcttccagattgttttagtgggccctgatggtcatttttctaaacagaggccctgctttgtaatatgtggccaaggagataatttatctcacagaagcaccgggaagacttagccttaaagagcctacagtgtccttttggactctttcacttcgggacatttaataatggaccaaattcaacagaacaccaggaaggtcaagacgctctccaaagggcaggaagtacagcacttccgaagagtttagttggccctttgctggttgggctgagttttttatttttaagtgtttgtttttcagtgcaataatttttgtgtgtgtgtgattcttatcagaaagttgaattgttttctgcctacaccgttcatcagccccataacccaggaaggaacaggcattgttagcatcagattatacctcattattaaaaggaggcatggccacacatgaagaaatggtcattctacttcaaagaaattgagccagcactatctgtactccaacattaccggatctggattggggaggttggtcagggaagagaggggttctacccacagatcaactgtgtaatcttttactattcaagctataattcagcttcaaagtagagtagaaaaaaaattgtcttaactgttctagttcttgatggttttcttccttattaacagttggtgtttcttccttggcccttttggactaatgttactgtccaagttctttctcaagaaaccacatctggttcagaagagtgtcaagttggactctttgaactctgttgctgtctgagcaatcgtggtgcctagactttgcattccttgttctgttgacctgcatacatgtgagagctatttctttaagaactatataggctgtgaaaacgcactttctttcccccaaagagctgggaatttatgaagttatggcaatgaactgcagcatgctgggacaattatttgactacttttttttgtaatattgtcaaatgtctctatggattctgacagagatttctttttgttttgttattcttttggttgtcagtttcattttaacgagtgtaactagtaacattttattctttggattttgtataattacagtacatgattgtgtattgtgacatgaatgctgtcaaaatgacattgatggcattgtgaagcctgttactttgtgtcacttcctgataaataagaggtgatgacatggatatacaacagaaaacactttgagttgaaagtaaacacaagctggctgcttccctgtggcaa

SEQ ID NO: 171893 - DNA, 4062 bp, Homo sapiens
  Payload ID: 13773
  Gene Symbol: PTPRO
  Gene Name: protein tyrosine phosphatase, receptor type, O
  Uniprot ID: Q16827
  ENST ID: ENST00000445537
  CDS Start-End: 487-1704
aagtaaaaaaatggaagggggaaaaggcaaagtattctgccttccaagttagatagctatctttatgaaaggacatatttcaaaggcaatataaagtctttatggtgctcttacctacctatatttgaattgggggatgcttcacctgcttattagtgaaagaagaaagaatacacttagtaaattaaattttttttaaaactttgtctttgctcagaaccagctccacccaaatcactcttcgcagtgaacaaaacccagacttcagtgactttgctgtgggtggaagagggagtagctgatttctttgaagttttctgtcaacaagttggctccagtcagaaaaccaaacttcaggaaccagttgctgtttcttcccatgtcgtgaccatctccagccttcttcctgccactgcctacaattgtagtgtcaccagctttagccatgacagccccagtgtccctacgttcatagccgtctcaacaatggttacagagatgaatcccaatgtggtagtgatctccgtgctggccatccttagcacacttttaattggactgttgcttgttaccctcattattcttaggaaaaagcatctgcagatggctagggagtgtggagctggtacatttgtcaattttgcatccttagagagggatggaaagcttccatacaactggcgtaggagtatatttgctttcttaaccctgctaccctcatgtctttggactgattatcttttggcattttatattaatccttggagtaaaaatggtttaaagaagaggaaactgacaaacccggttcaactggatgactttgatgcctatattaaggatatggccaaagactctgactataaattttctcttcagtttgaggagttgaaattgattggactggatatcccacactttgctgcagatcttccactgaatcgatgtaaaaaccgttacacaaacatcctaccatatgacttcagccgtgtgagattagtctccatgaatgaagaggaaggtgcagactacatcaatgccaactatattcctggatacaactcaccccaggagtatattgccacccaggggccactgcctgaaaccagaaatgacttctggaagatggtcctgcaacaaaagtctcagattattgtcatgctcactcagtgtaatgagaaaaggagggtgaaatgtgaccattactggccattcacggaagaacctatagcctatggagacatcactgtggagatgatttcagaggaagagcaggacgactgggcctgtagacacttccggatcaactatgctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcagtgctggcgtgggacggacaggaacattcattgccctggacaggctcttgcagcacattcgggatcatgagtttgttgacatcttagggctggtgtcagaaatgaggtcataccggatgtctatggtacagacagaggagcagtacatttttatccatcagtgtgtgcaactgatgtggatgaagaagaagcagcagttctgcatcagtgatgtcatatacgagaatgttagcaagtcctagttcagaatccggagcagtaagtggagaagagctctccacgagtgctcagtcttagaactattagagggggatgtgatggatgggacaaaagacagcagtagccatttgtattgactctgacttcacatgagtatttcttcccagctcctggcctcacatgggtggtcacagggagaaacaagtactgtagcagatctttgagtttcaatgcaccttggttggtgttggcaacaaacaggagcttctgcacatcatgatgactttacctccattccctctacccagaaccctaaattattctgttattggatctgtgcctgtaatatcaggatactaccatccaaatctatctagatatcttgtgcaaatattttattgattacaagggctgtatacggggttacaaaaagacatgagctggattggacactcctaaaaccaaaaacaacagtgacaatagagtctcaggatagcagagtctgaaaataccttggtctcccccattatgtgagcccttacttgagagcttcatgaagacacttgtaacatattcaacgtcctgtactccagttttgactacgagatcagattttggaggtgtaagtaaacttggctgaggtaacagtaatctgcccatttagttcagtaaacagactgtagagtgtctgactatactgggggaagaggagccaatgacagggtagggagatgacagtggtgcatgatgggagaatcatgaaagtctgggaagcatatggaccagtgggaaggataggattagcactgcacctctacatccatcaagagagacagagcgcacaatggagcaggaaggataaaaaataaagaaagacagagagaaacaaatttgctgggagagggaaagacattcagacccacagaaaggaggcagcacacagagaaagatgcacagatcaacccacatctgcatgggttgtgagactgagcatagtgagagcagtggtggagcaatagaagattgctgtgacaccaggctgcttactgtctttctttgtctcattcacaggagaggacatgatgtgcgcccatcctcccttgcttccagattgttttagtgggccctgatggtcatttttctaaacagaggccctgctttgtaatatgtggccaaggagataatttatctcacagaagcaccgggaagacttagccttaaagagcctacagtgtccttttggactctttcacttcgggacatttaataatggaccaaattcaacagaacaccaggaaggtcaagacgctctccaaagggcaggaagtacagcacttccgaagagtttagttggccctttgctggttgggctgagttttttatttttaagtgtttgtttttcagtgcaataatttttgtgtgtgtgtgattcttatcagaaagttgaattgttttctgcctacaccgttcatcagccccataacccaggaaggaacaggcattgttagcatcagattatacctcattattaaaaggaggcatggccacacatgaagaaatggtcattctacttcaaagaaattgagccagcactatctgtactccaacattaccggatctggattggggaggttggtcagggaagagaggggttctacccacagatcaactgtgtaatcttttactattcaagctataattcagcttcaaagtagagtagaaaaaaaattgtcttaactgttctagttcttgatggttttcttccttattaacagttggtgtttcttccttggcccttttggactaatgttactgtccaagttctttctcaagaaaccacatctggttcagaagagtgtcaagttggactctttgaactctgttgctgtctgagcaatcgtggtgcctagactttgcattccttgttctgttgacctgcatacatgtgagagctatttctttaagaactatataggctgtgaaaacgcactttctttcccccaaagagctgggaatttatgaagttatggcaatgaactgcagcatgctgggacaattatttgactacttttttttgtaatattgtcaaatgtctctatggattctgacagagatttctttttgttttgttattcttttggttgtcagtttcattttaacgagtgtaactagtaacattttattctttggattttgtataattacagtacatgattgtgtattgtgacatgaatgctgtcaaaatgacattgatggcattgtgaagcctgttactttgtgtcacttcctgataaataagaggtgatgacatggatatacaacagaaaacactttgagttgaaagtaaacacaagctggctgcttccctgtggcaactgtgg

SEQ ID NO: 171894 - DNA, 3030 bp, Homo sapiens
  Payload ID: 13773
  Gene Symbol: PTPRO
  Gene Name: protein tyrosine phosphatase, receptor type, O
  Uniprot ID: Q16827
  ENST ID: ENST00000442921
  CDS Start-End: 487-1704
aagtaaaaaaatggaagggggaaaaggcaaagtattctgccttccaagttagatagctatctttatgaaaggacatatttcaaaggcaatataaagtctttatggtgctcttacctacctatatttgaattgggggatgcttcacctgcttattagtgaaagaagaaagaatacacttagtaaattaaattttttttaaaactttgtctttgctcagaaccagctccacccaaatcactcttcgcagtgaacaaaacccagacttcagtgactttgctgtgggtggaagagggagtagctgatttctttgaagttttctgtcaacaagttggctccagtcagaaaaccaaacttcaggaaccagttgctgtttcttcccatgtcgtgaccatctccagccttcttcctgccactgcctacaattgtagtgtcaccagctttagccatgacagccccagtgtccctacgttcatagccgtctcaacaatggttacagagatgaatcccaatgtggtagtgatctccgtgctggccatccttagcacacttttaattggactgttgcttgttaccctcattattcttaggaaaaagcatctgcagatggctagggagtgtggagctggtacatttgtcaattttgcatccttagagagggatggaaagcttccatacaactggcgtaggagtatatttgctttcttaaccctgctaccctcatgtctttggactgattatcttttggcattttatattaatccttggagtaaaaatggtttaaagaagaggaaactgacaaacccggttcaactggatgactttgatgcctatattaaggatatggccaaagactctgactataaattttctcttcagtttgaggagttgaaattgattggactggatatcccacactttgctgcagatcttccactgaatcgatgtaaaaaccgttacacaaacatcctaccatatgacttcagccgtgtgagattagtctccatgaatgaagaggaaggtgcagactacatcaatgccaactatattcctggatacaactcaccccaggagtatattgccacccaggggccactgcctgaaaccagaaatgacttctggaagatggtcctgcaacaaaagtctcagattattgtcatgctcactcagtgtaatgagaaaaggagggtgaaatgtgaccattactggccattcacggaagaacctatagcctatggagacatcactgtggagatgatttcagaggaagagcaggacgactgggcctgtagacacttccggatcaactatgctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcagtgctggcgtgggacggacaggaacattcattgccctggacaggctcttgcagcacattcgggatcatgagtttgttgacatcttagggctggtgtcagaaatgaggtcataccggatgtctatggtacagacagaggagcagtacatttttatccatcagtgtgtgcaactgatgtggatgaagaagaagcagcagttctgcatcagtgatgtcatatacgagaatgttagcaagtcctagttcagaatccggagcagagaggacatgatgtgcgcccatcctcccttgcttccagattgttttagtgggccctgatggtcatttttctaaacagaggccctgctttgtaatatgtggccaaggagataatttatctcacagaagcaccgggaagacttagccttaaagagcctacagtgtccttttggactctttcacttcgggacatttaataatggaccaaattcaacagaacaccaggaaggtcaagacgctctccaaagggcaggaagtacagcacttccgaagagtttagttggccctttgctggttgggctgagttttttatttttaagtgtttgtttttcagtgcaataatttttgtgtgtgtgtgattcttatcagaaagttgaattgttttctgcctacaccgttcatcagccccataacccaggaaggaacaggcattgttagcatcagattatacctcattattaaaaggaggcatggccacacatgaagaaatggtcattctacttcaaagaaattgagccagcactatctgtactccaacattaccggatctggattggggaggttggtcagggaagagaggggttctacccacagatcaactgtgtaatcttttactattcaagctataattcagcttcaaagtagagtagaaaaaaaattgtcttaactgttctagttcttgatggttttcttccttattaacagttggtgtttcttccttggcccttttggactaatgttactgtccaagttctttctcaagaaaccacatctggttcagaagagtgtcaagttggactctttgaactctgttgctgtctgagcaatcgtggtgcctagactttgcattccttgttctgttgacctgcatacatgtgagagctatttctttaagaactatataggctgtgaaaacgcactttctttcccccaaagagctgggaatttatgaagttatggcaatgaactgcagcatgctgggacaattatttgactacttttttttgtaatattgtcaaatgtctctatggattctgacagagatttctttttgttttgttattcttttggttgtcagtttcattttaacgagtgtaactagtaacattttattctttggattttgtataattacagtacatgattgtgtattgtgacatgaatgctgtcaaaatgacattgatggcattgtgaagcctgttactttgtgtcacttcctgataaataagaggtgatgacatggatatacaacagaaaacactttgagttgaaagtaaacacaagctggctgcttccctgtggcaactgtgg

SEQ ID NO: 171895 - DNA, 2946 bp, Homo sapiens
  Payload ID: 13773
  Gene Symbol: PTPRO
  Gene Name: protein tyrosine phosphatase, receptor type, O
  Uniprot ID: Q16827
  ENST ID: ENST00000542557
  CDS Start-End: 487-1620
aagtaaaaaaatggaagggggaaaaggcaaagtattctgccttccaagttagatagctatctttatgaaaggacatatttcaaaggcaatataaagtctttatggtgctcttacctacctatatttgaattgggggatgcttcacctgcttattagtgaaagaagaaagaatacacttagtaaattaaattttttttaaaactttgtctttgctcagaaccagctccacccaaatcactcttcgcagtgaacaaaacccagacttcagtgactttgctgtgggtggaagagggagtagctgatttctttgaagttttctgtcaacaagttggctccagtcagaaaaccaaacttcaggaaccagttgctgtttcttcccatgtcgtgaccatctccagccttcttcctgccactgcctacaattgtagtgtcaccagctttagccatgacagccccagtgtccctacgttcatagccgtctcaacaatggttacagagatgaatcccaatgtggtagtgatctccgtgctggccatccttagcacacttttaattggactgttgcttgttaccctcattattcttaggaaaaagcatctgcagatggctagggagtgtggagctggtacatttgtcaattttgcatccttagagagggatggaaagcttccatacaactggagtaaaaatggtttaaagaagaggaaactgacaaacccggttcaactggatgactttgatgcctatattaaggatatggccaaagactctgactataaattttctcttcagtttgaggagttgaaattgattggactggatatcccacactttgctgcagatcttccactgaatcgatgtaaaaaccgttacacaaacatcctaccatatgacttcagccgtgtgagattagtctccatgaatgaagaggaaggtgcagactacatcaatgccaactatattcctggatacaactcaccccaggagtatattgccacccaggggccactgcctgaaaccagaaatgacttctggaagatggtcctgcaacaaaagtctcagattattgtcatgctcactcagtgtaatgagaaaaggagggtgaaatgtgaccattactggccattcacggaagaacctatagcctatggagacatcactgtggagatgatttcagaggaagagcaggacgactgggcctgtagacacttccggatcaactatgctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcagtgctggcgtgggacggacaggaacattcattgccctggacaggctcttgcagcacattcgggatcatgagtttgttgacatcttagggctggtgtcagaaatgaggtcataccggatgtctatggtacagacagaggagcagtacatttttatccatcagtgtgtgcaactgatgtggatgaagaagaagcagcagttctgcatcagtgatgtcatatacgagaatgttagcaagtcctagttcagaatccggagcagagaggacatgatgtgcgcccatcctcccttgcttccagattgttttagtgggccctgatggtcatttttctaaacagaggccctgctttgtaatatgtggccaaggagataatttatctcacagaagcaccgggaagacttagccttaaagagcctacagtgtccttttggactctttcacttcgggacatttaataatggaccaaattcaacagaacaccaggaaggtcaagacgctctccaaagggcaggaagtacagcacttccgaagagtttagttggccctttgctggttgggctgagttttttatttttaagtgtttgtttttcagtgcaataatttttgtgtgtgtgtgattcttatcagaaagttgaattgttttctgcctacaccgttcatcagccccataacccaggaaggaacaggcattgttagcatcagattatacctcattattaaaaggaggcatggccacacatgaagaaatggtcattctacttcaaagaaattgagccagcactatctgtactccaacattaccggatctggattggggaggttggtcagggaagagaggggttctacccacagatcaactgtgtaatcttttactattcaagctataattcagcttcaaagtagagtagaaaaaaaattgtcttaactgttctagttcttgatggttttcttccttattaacagttggtgtttcttccttggcccttttggactaatgttactgtccaagttctttctcaagaaaccacatctggttcagaagagtgtcaagttggactctttgaactctgttgctgtctgagcaatcgtggtgcctagactttgcattccttgttctgttgacctgcatacatgtgagagctatttctttaagaactatataggctgtgaaaacgcactttctttcccccaaagagctgggaatttatgaagttatggcaatgaactgcagcatgctgggacaattatttgactacttttttttgtaatattgtcaaatgtctctatggattctgacagagatttctttttgttttgttattcttttggttgtcagtttcattttaacgagtgtaactagtaacattttattctttggattttgtataattacagtacatgattgtgtattgtgacatgaatgctgtcaaaatgacattgatggcattgtgaagcctgttactttgtgtcacttcctgataaataagaggtgatgacatggatatacaacagaaaacactttgagttgaaagtaaacacaagctggctgcttccctgtggcaactgtgg

SEQ ID NO: 171896 - DNA, 3978 bp, Homo sapiens
  Payload ID: 13773
  Gene Symbol: PTPRO
  Gene Name: protein tyrosine phosphatase, receptor type, O
  Uniprot ID: Q16827
  ENST ID: ENST00000544244
  CDS Start-End: 487-1620
aagtaaaaaaatggaagggggaaaaggcaaagtattctgccttccaagttagatagctatctttatgaaaggacatatttcaaaggcaatataaagtctttatggtgctcttacctacctatatttgaattgggggatgcttcacctgcttattagtgaaagaagaaagaatacacttagtaaattaaattttttttaaaactttgtctttgctcagaaccagctccacccaaatcactcttcgcagtgaacaaaacccagacttcagtgactttgctgtgggtggaagagggagtagctgatttctttgaagttttctgtcaacaagttggctccagtcagaaaaccaaacttcaggaaccagttgctgtttcttcccatgtcgtgaccatctccagccttcttcctgccactgcctacaattgtagtgtcaccagctttagccatgacagccccagtgtccctacgttcatagccgtctcaacaatggttacagagatgaatcccaatgtggtagtgatctccgtgctggccatccttagcacacttttaattggactgttgcttgttaccctcattattcttaggaaaaagcatctgcagatggctagggagtgtggagctggtacatttgtcaattttgcatccttagagagggatggaaagcttccatacaactggagtaaaaatggtttaaagaagaggaaactgacaaacccggttcaactggatgactttgatgcctatattaaggatatggccaaagactctgactataaattttctcttcagtttgaggagttgaaattgattggactggatatcccacactttgctgcagatcttccactgaatcgatgtaaaaaccgttacacaaacatcctaccatatgacttcagccgtgtgagattagtctccatgaatgaagaggaaggtgcagactacatcaatgccaactatattcctggatacaactcaccccaggagtatattgccacccaggggccactgcctgaaaccagaaatgacttctggaagatggtcctgcaacaaaagtctcagattattgtcatgctcactcagtgtaatgagaaaaggagggtgaaatgtgaccattactggccattcacggaagaacctatagcctatggagacatcactgtggagatgatttcagaggaagagcaggacgactgggcctgtagacacttccggatcaactatgctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcagtgctggcgtgggacggacaggaacattcattgccctggacaggctcttgcagcacattcgggatcatgagtttgttgacatcttagggctggtgtcagaaatgaggtcataccggatgtctatggtacagacagaggagcagtacatttttatccatcagtgtgtgcaactgatgtggatgaagaagaagcagcagttctgcatcagtgatgtcatatacgagaatgttagcaagtcctagttcagaatccggagcagtaagtggagaagagctctccacgagtgctcagtcttagaactattagagggggatgtgatggatgggacaaaagacagcagtagccatttgtattgactctgacttcacatgagtatttcttcccagctcctggcctcacatgggtggtcacagggagaaacaagtactgtagcagatctttgagtttcaatgcaccttggttggtgttggcaacaaacaggagcttctgcacatcatgatgactttacctccattccctctacccagaaccctaaattattctgttattggatctgtgcctgtaatatcaggatactaccatccaaatctatctagatatcttgtgcaaatattttattgattacaagggctgtatacggggttacaaaaagacatgagctggattggacactcctaaaaccaaaaacaacagtgacaatagagtctcaggatagcagagtctgaaaataccttggtctcccccattatgtgagcccttacttgagagcttcatgaagacacttgtaacatattcaacgtcctgtactccagttttgactacgagatcagattttggaggtgtaagtaaacttggctgaggtaacagtaatctgcccatttagttcagtaaacagactgtagagtgtctgactatactgggggaagaggagccaatgacagggtagggagatgacagtggtgcatgatgggagaatcatgaaagtctgggaagcatatggaccagtgggaaggataggattagcactgcacctctacatccatcaagagagacagagcgcacaatggagcaggaaggataaaaaataaagaaagacagagagaaacaaatttgctgggagagggaaagacattcagacccacagaaaggaggcagcacacagagaaagatgcacagatcaacccacatctgcatgggttgtgagactgagcatagtgagagcagtggtggagcaatagaagattgctgtgacaccaggctgcttactgtctttctttgtctcattcacaggagaggacatgatgtgcgcccatcctcccttgcttccagattgttttagtgggccctgatggtcatttttctaaacagaggccctgctttgtaatatgtggccaaggagataatttatctcacagaagcaccgggaagacttagccttaaagagcctacagtgtccttttggactctttcacttcgggacatttaataatggaccaaattcaacagaacaccaggaaggtcaagacgctctccaaagggcaggaagtacagcacttccgaagagtttagttggccctttgctggttgggctgagttttttatttttaagtgtttgtttttcagtgcaataatttttgtgtgtgtgtgattcttatcagaaagttgaattgttttctgcctacaccgttcatcagccccataacccaggaaggaacaggcattgttagcatcagattatacctcattattaaaaggaggcatggccacacatgaagaaatggtcattctacttcaaagaaattgagccagcactatctgtactccaacattaccggatctggattggggaggttggtcagggaagagaggggttctacccacagatcaactgtgtaatcttttactattcaagctataattcagcttcaaagtagagtagaaaaaaaattgtcttaactgttctagttcttgatggttttcttccttattaacagttggtgtttcttccttggcccttttggactaatgttactgtccaagttctttctcaagaaaccacatctggttcagaagagtgtcaagttggactctttgaactctgttgctgtctgagcaatcgtggtgcctagactttgcattccttgttctgttgacctgcatacatgtgagagctatttctttaagaactatataggctgtgaaaacgcactttctttcccccaaagagctgggaatttatgaagttatggcaatgaactgcagcatgctgggacaattatttgactacttttttttgtaatattgtcaaatgtctctatggattctgacagagatttctttttgttttgttattcttttggttgtcagtttcattttaacgagtgtaactagtaacattttattctttggattttgtataattacagtacatgattgtgtattgtgacatgaatgctgtcaaaatgacattgatggcattgtgaagcctgttactttgtgtcacttcctgataaataagaggtgatgacatggatatacaacagaaaacactttgagttgaaagtaaacacaagctggctgcttccctgtggcaactgtgg

SEQ ID NO: 171897 - DNA, 2070 bp, Homo sapiens
  Payload ID: 13773
  Gene Symbol: PTPRO
  Gene Name: protein tyrosine phosphatase, receptor type, O
  Uniprot ID: Q16827
  ENST ID: ENST00000543886
  CDS Start-End: 185-1978
ggaggaccccgggcgcagaggaggaaagggagcaggcgcagggggactggaaaggcagcatgcgctcgccaggagcaacctcggcgcccagggtctgaggctgcagccccagttcgccattgtgagccgccgccgggggagtccgctagcgcagccgtgcccccgagtccccgtccgcgcagcgatggggcacctgcccacggggatacacggcgcccgccgcctcctgcctctgctctggctctttgtgctgttcaagaatgctacagctttccatgtaactgtccaagatgataataacatcgttgtctcattagaagcttcagacgtcatcagtccagcatctgtgtatgttgtgaagataactggtgaatccaaaaattatttcttcgaatttgaggaattcaacagcactttgcctcctcctgttattttcaaggccagttatcatggcctttattatataatcactctggtagtggtaaatggaaatgtggtgaccaagccatccagatcaatcactgtgttaacaaaacctctacctgtaaccagtgtttccatatatgactataaaccttctcctgaaacaggagtcctgtttgaaatacattatccagaaaaatataacgttttcacaagagtgaacattagctactgggaaggtaaagacttccggacaatgctatataaagatttctttaagggaaaaacagtatttaatcactggctgccaggaatgtgttatagtaatatcacctttcagctggtatctgaggcaacttttaataaaagtacccttgttgagtacagtggtgtcagtcacgaacccaaacagcacagaactgccccttatccacctcaaaatatttccgttcgtatcgtaaacttgaacaaaaacaactgggaagaacagagtggcaatttcccagaagaatccttcatgagatcacaagatacaataggaaaagaaaaactcttccattttacagaagaaacccctgaaattccctcgggcaacatttcttccggttggcctgattttaatagcagtgactatgaaactacgtctcagccatattggtgggacagtgcatctgcagctcctgaaagtgaagatgaatttgtcagcgtacttcccatggaatacgaaaataacagtacactcagtgagacagagaagtcaacatcaggctctttctcctttttccctgtgcaaatgatattgacctggttaccacccaaaccacccactgcttttgatgggttccatatccatattgaacgagaagagaactttactgaatatttgatggtggatgaagaagcacatgaatttgttgcagaactgaaggaacctgggaaatataagttatctgtgacaacctttagttcctcaggatcttgtgaaactcgaaaaagtcagtcagcaaaatcactcagcttttatatcagtccttcaggagagtggattgaagaactgaccgagaagccgcagcacgtgagtgtccacgttttaagctcaaccactgccttgatgtcctggacatcttcccaagagaactacaacagcaccattgtgtctgtggtgtcgctgacctgccagaaacaaaaggagagccagaggcttgaaaagcagtactgcactcaggtgaactcaagcaaacctattattgaaaatctggttcctggtgcccagtaccaggttgtaatatacctaaggaaaggccctttgattggaccaccttcagatcctgtgacatttgctattgttcccacaggaataaaggatttaatgctctatcctttgggtcctacggccgtggttctgagctggaccagaccttatttaggcgtgttcagaaaatacgtggttgaaatgttttatttcaaccctgctacaatgacatcagagtggaccacctactatgaaatagcagcaactgtttccttaactgcatccgtggtaatcttcccttaaccaactgtcagtctttcctatgggaacaggcaaacctttatgtaccaaatgtgtctttaagaaattatctataaatttgattattttgtaaa

SEQ ID NO: 171898 - DNA, 533 bp, Homo sapiens
  Payload ID: 13773
  Gene Symbol: PTPRO
  Gene Name: protein tyrosine phosphatase, receptor type, O
  ENST ID: ENST00000535311
  CDS Start-End: 1-265
agtgactttgctgtgggtggaagagggagtagctgatttctttgaagttttctgtcaacaagttggctccagtcagaaaaccaaacttcaggaaccagttgctgtttcttcccatgtcgtgaccatctccagccttcttcctgccactgcctacaattgtagtgtcaccagctttagccatgacagccccagtgtccctacgttcatagccgtctcaacaatggggagtgtggagctggtacatttgtcaattttgcatccttagagagggatggaaagcttccatacaactggagtaaaaatggtttaaagaagaggaaactgacaaacccggttcaactggatgactttgatgcctatattaaggatatggccaaagactctgactataaattttctcttcagtttgaggagttgaaattgattggactggatatcccacactttgctgcagatcttccactgaatcgatgtaaaaaccgttacacaaacatcctaccatatgacttcagccgtgtgagattagtctccat

SEQ ID NO: 171899 - DNA, 472 bp, Homo sapiens
  Payload ID: 13773
  Gene Symbol: PTPRO
  Gene Name: protein tyrosine phosphatase, receptor type, O
  ENST ID: ENST00000535322
  CDS Start-End: 1-351
tggaagatggtcctgcaacaaaagtctcagattattgtcatgctcactcagtgtaatgagaaaaggagggtgaaatgtgaccattactggccattcacggaagaacctatagcctatggagacatcactgtggagatgatttcagaggaagagcaggacgactgggcctgtagacacttccggatcaactatgctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcaggtaacctcatcaactgcattttctattaaatattaggagttggttttgtaaggggaacagctcaccattccataagcccttatcaggtttagttgaaaattaaataaactctgatgttttttaaa

SEQ ID NO: 171900 - DNA, 2336 bp, Homo sapiens
  Payload ID: 13774
  Gene Symbol: PTPRQ
  Gene Name: protein tyrosine phosphatase, receptor type, Q
  ENST ID: ENST00000551042
  CDS Start-End: 1341-2336
ttttgtattttcgtatctcaggtcaaacaatcaaataataatatggactggtcttaatgatatgaagaaagaaggtcttcttacatgggcagatggatcatcttttggccttaagaaaaatgaaatattttctttttcattgctatccaagaatgaaacacattgctacattttacagcaaaatgcaactggatcaaactatttctttacaagatttttctgttacgttccattgccatatgtttgcgaatatgaattaccttctctgcaggaaagctttttgctttacataaaggatgttggaacaactgaagttgtattatttggaataatttgaatttttggaataatttgaataagtgggtgaaattgggatataagattatcattaaatattctttagattatacagaagaacaatattttgaaagcatgcccccaaatactacagaaaaagcaattacccaactgtttcctggtcatatttatagatttttactcttcgcaataaatgaatgggaggcaaaaactactttaagtccaatattcactgtagaaacacgccctttgtcagcccaaaatttcagagttacacatgttaccataacagaagtatttttacactgggatcctccagatcctgtattttttcatcattaccttatcactattttggatgttgaaaacaatacatcagaagaggtgcttgttgaaaaacgcaacacagcaaccatagttggagacctcaagtcttttcatcattatctggtatatctattcagtgtagcagaaagaggaactttaagttgcttggagaaaccactttcagtcattacagaacccaaaccagtctggattgttatcccctatgaaagtcatagtacctctgtaatcttatttgttcaaatgcccaatgttgaagtgtttgatggactacatattgtaattgaaggaggggcaaatgtgaccatggctttacaccatggtctggaagcaccactgaatatccatgaaggcaaagttacagattcttctatagacattctctggaatcgagttgatgggaatttccagcattatgaaatcacatgcataaactatgctgctgctttcatggttcagaaggtagttcaagaaacagcaatattctctaacctggatcctgccacagtgtacaccttttctattcgggctgaaaaagaaggttttaaagacattactgctaacataaaagaaatacagacaggttaccgcctatgtaggcaccttaggagtttctttcatgttcagatatttccttggtcctttaagggaagattaccccaagtgcagctgaatttatgaaacatagcagagacccaaatgcagtaactgttagctggccttcagctagaagtcttctggatggatatattatttcaatatccagtgaaagcttaatgagagaagaaattctgccctccactaaaaggacattcacatttaatagcctttctccagggactgactttttaattagtattatgactaacaagggactgaaaagaagccatcctactgtcctcatggttagcacttatccagatccatcagatttgctaatctgggggcaagaagaaaacacgatatgtttgtcttggaaactatcagaaggagggtttgaaaagtttcagatatcatactgcatgccatccagacaggaaaagctgattaaagtgattgtttatggcaacaaagccaaagtaaaaaaattgactctgggcatggactacatgtttcaagtgaagaaagttaaaggcaaaggttacagtgtatctgtaatgaaaaaagtgcctataaaaccagaacaacctgagaaacttagagccttcaatatttccacacattccttttctctgcactggagcctaccctctggtcatgtggaaaggtatcaagtggatcttgttcctgacagtggctttgttactatcagagatcttggaggtggagaatatcaggttgatgtttccaatgtcgttcctggtactaggtacgatataaccatctcttcaatttctacaacatacacctcacctgttactagaatagtgacaacaaatgtaacaaaaccagggcctccagtcttcctagccggggaaagagtcggatctgctgggattcttctgtcttggaatacaccacctaatccaaatggaaggattatatcttacattgtcaaatataaggaagtttgtccgtggatgcaaacagtatatacacaagtcagatcaaagccagacagtctggaagttcttcttactaatcttaatcctggaacaacatatgaaattaag

SEQ ID NO: 171901 - DNA, 1700 bp, Homo sapiens
  Payload ID: 13774
  Gene Symbol: PTPRQ
  Gene Name: protein tyrosine phosphatase, receptor type, Q
  ENST ID: ENST00000547376
  CDS Start-End: 640-1700
aacccaaaccagtctggattgttatcccctatgaaagtcatagtacctctgtaatcttatttgttcaaatgcccaatgttgaagtgtttgatggactacatattgtaattgaaggaggggcaaatgtgaccatggctttacaccatggtctggaagcaccactgaatatccatgaaggcaaagttacagattcttctatagacattctctggaatcgagttgatgggaatttccagcattatgaaatcacatgcataaactatgctgctgctttcatggttcagaaggtagttcaagaaacagcaatattctctaacctggatcctgccacagtgtacaccttttctattcgggctgaaaaagaaggttttaaagacattactgctaacataaaagaaatacagacaggttaccgcctatgtaggcaccttaggagtttctttcatgttcagatatttccttggtcctttaagggaagattagaaagaagggaggcatttcatattcagattgcaattaactttcctgctaattagacttggcactccttggtatttaattaggatgagtcctaaaaataattaaatatttctgaagtcagtggttacacaagactaagccccaagtgcagctgaatttatgaaacatagcagagacccaaatgcagtaactgttagctggccttcagctagaagtcttctggatggatatattatttcaatatccagtgaaagcttaatgagagaagaaattctgccctccactaaaaggacattcacatttaatagcctttctccagggactgactttttaattagtattatgactaacaagggactgaaaagaagccatcctactgtcctcatggttagcacttatccagatccatcagatttgctaatctgggggcaagaagaaaacacgatatgtttgtcttggaaactatcagaaggagggtttgaaaagtttcagatatcatactgcatgccatccagacaggaaaagctgattaaagtgattgtttatggcaacaaagccaaagtaaaaaaattgactctgggcatggactacatgtttcaagtgaagaaagttaaaggcaaaggttacagtgtatctgtaatgaaaaaagtgcctataaaaccatctaggatttgtggcttaattttgaaagctgtgaatatttcttcaaatttaatgtggaatacaacagagatcaatttcacccattataagatttatatatcaaatagaacatttgcaaaagactgtcttatttgggaagtggtgactgagcacacagttacagatgtgactcctggtgtaatatataacatcatggtacacagaataagaggcaaccttggaggatgtggcatgtttaccagggttgttgcagaaccagaacaacctgagaaacttagagccttcaatatttccacacattccttttctctgcactggagcctaccctctggtcatgtggaaaggtatcaagtggatcttgttcctgacagtggctttgttactatcagagatcttggaggtggagaatatcaggttgatgtttccaatgtcgttcctggtactaggtacgatataaccatctcttcaatttctacaacatacacctcacctgttactagaatagtgacaacaaatgtaacaaaaccagggcctccagtcttcctagccggggaaag

SEQ ID NO: 171902 - DNA, 1097 bp, Homo sapiens
  Payload ID: 13774
  Gene Symbol: PTPRQ
  Gene Name: protein tyrosine phosphatase, receptor type, Q
  ENST ID: ENST00000551573
  CDS Start-End: 247-1097
caaaccagtctggattgttatcccctatgaaagtcatagtacctctgtaatcttatttgttcaaatgcccaatgttgaagtgtttgatggactacatattgtaattgaaggaggggcaaatgtgaccatggctttacaccatggtctggaagcaccactgaatatccatgaaggcaaagttacagattcttctatagacattctctggaatcgagttgatgggaatttccagcattatgaaatcacatgcataaactatgctgctgctttcatgccccaagtgcagctgaatttatgaaacatagcagagacccaaatgcagtaactgttagctggccttcagctagaagtcttctggatggatatattatttcaatatccagtgaaagcttaatgagagaagaaattctgccctccactaaaaggacattcacatttaatagcctttctccagggactgactttttaattagtattatgactaacaagggactgaaaagaagccatcctactgtcctcatggttagcacttatccagatccatcagatttgctaatctgggggcaagaagaaaacacgatatgtttgtcttggaaactatcagaaggagggtttgaaaagtttcagatatcatactgcatgccatccagacaggaaaagctgattaaagtgattgtttatggcaacaaagccaaagtaaaaaaattgactctgggcatggactacatgtttcaagtgaagaaagttaaaggcaaaggttacagtgtatctgtaatgaaaaaagtgcctataaaaccagaacaacctgagaaacttagagccttcaatatttccacacattccttttctctgcactggagcctaccctctggtcatgtggaaaggtatcaagtggatcttgttcctgacagtggctttgttactatcagagatcttggaggtggagaatatcaggttgatgtttccaatgtcgttcctggtactaggtacgatataaccatctcttcaatttctacaacatacacctcacctgttactagaatagtgacaacaaatgtaacaaaaccagggcctccagtcttcctagccggggaaag

SEQ ID NO: 171903 - DNA, 439 bp, Homo sapiens
  Payload ID: 13774
  Gene Symbol: PTPRQ
  Gene Name: protein tyrosine phosphatase, receptor type, Q
  ENST ID: ENST00000547881
  CDS Start-End: 1-439
tcattctttccgtcactttgtgtatcctttcaataattctccttggaacagctatttttgcatttgcaagaattcgacagaagcagaaagaaggtggcacatactctcctcaggatgcagaaattattgacactaaattgaagctggatcagctcatcacagtggcagacctggaactgaaggacgagagattaacgcggccaataagcaagaaatccttcctgcaacatgttgaagagctttgcacaaacaacaacctaaagtttcaagaagaattttcggaattaccaaaatttcttcaggatctttcttcaactgatgctgatctgccttggaatagagcaaaaaaccgcttcccaaacataaaaccatataataataacagagtaaagctgatagctgacgctagtgttccaggttcggattatattaatgccag

SEQ ID NO: 171904 - DNA, 8289 bp, Homo sapiens
  Payload ID: 13774
  Gene Symbol: PTPRQ
  Gene Name: protein tyrosine phosphatase, receptor type, Q
  ENST ID: ENST00000614701
  CDS Start-End: 179-7078
acagccagtcatccaagggttcatgaatagtttaacaaagaaaaggcagagctattgagtaatatgggctcattaattgtgtacttgccagaaggatctgtctttaaatcattaatgcaggcaacatttctctctagagccatcaatgtgattctactggctgaaaaatgtaataaagatggattttcttatcatttttcttttactttttattgggacttcagagacacaggttgatgtttccaatgtcgttcctggtactaggtacgatataaccatctcttcaatttctacaacatacacctcacctgttactagaatagtgacaacaaatgtaacaaaaccagggcctccagtcttcctagccggggaaagagtcggatctgctgggattcttctgtcttggaatacaccacctaatccaaatggaaggattatatcttacattgtcaaatataaggaagtttgtccgtggatgcaaacagtatatacacaagtcagatcaaagccagacagtctggaagttcttcttactaatcttaatcctggaacaacatatgaaattaaggttgctgctgaaaacagtgctggcattggagtgtttagtgatccatttctcttccaaactgcagaaagtgctccaggaaaagtggtgaatctcacagttgaggcctacaacgcttcagcagttaagctgatttggtatttacctcggcaaccaaatggcaaaattaccagcttcaagattagtgtcaagcatgccagaagtgggatagtagtgaaagatgtctcaatcagagtagaggacattttgactgggaaattgccagaatgcaatgagaatagtgaatcttttttatggagtacagccagcccttctccaacccttggtagagttacacctccatcgcgtaccacacattcatcaagcacgttgacacagaatgagatcagctctgtgtggaaagagcctatcagttttgtagtgacacacttgagaccttatacaacatatctttttgaagtttcagctgctacaactgaagcaggttatattgatagtacgattgtcagaacaccagaatcagtgcctgaaggaccaccacaaaactgcgtaacaggcaacatcacaggaaagtccttttcaattttatgggacccaccaactatagtaacagggaaatttagttatagagttgaattatatggaccatcaggtcgcattttggataacagcacaaaagacctcaagtttgcattcactaacctaacaccatttacaatgtatgatgtctatattgcggctgaaaccagtgcagggactgggcccaagtcaaatatttcagtattcactccaccagatgttccaggggcagtgtttgatttacaacttgcagaggtagaatccacgcaagtaagaattacttggaagaaaccacgacaaccaaatggaattattaaccaataccgagtgaaagtgctagttccagagacaggaataattttggaaaatactttgctcactggaaataatgagtatataaatgaccccatggctccagaaattgtgaacatagtagagccaatggtaggattatatgagggttcagcagagatgtcgtctgaccttcactcacttgctacatttatatataacagccatccagataaaaactttcctgcaaggaatagagctgaagaccagacttcaccagttgtaactacaaggaatcagtatattactgacattgcagctgaacagctgtcttatgttatcaggagacttgtacctttcactgagcacatgattagtgtatctgctttcaccatcatgggagaaggaccaccaacagttctcagtgttaggacacgtcagcaagtgccaagctccattaaaattataaactataaaaatattagttcttcatctattttgttatattgggatcctccagaatatcccaatggaaaaataactcactatacgatttatgcaatggaattggatacaaacagagcattccagataactaccatagataacagctttctcataacagggttaaagaaatacacaaaatacaaaatgagagtggcagcctcaacccacgttggagaaagttctttgtctgaagaaaatgacatctttgtgagaacttcagaagatgaaccggaatcatcacctcaagatgtcgaagtaattgatgttaccgcagatgaaataaggttgaagtggtcaccacccgaaaagcccaatgggatcattattgcttatgaagtgctatataaaaatatagatactttatatatgaagaacacatcaacaacagacataatattaaggaacttaagacctcacaccctctataacatttctgtaaggtcttacaccagatttggtcatggcaatcaggtatcttctttactctctgtaaggacttcggagactgtgcctgatagtgcaccagaaaatatcacttacaaaaatatttcttctggagagattgagctatcattccttcccccaagtagtcccaatggaatcatacaaaaatatacaatttatctcaagagaagtaatggaaatgaggaaagaactataaatacaacctctttaacccaaaacattaaagtactgaagaaatatacccaatatatcattgaggtgtctgctagtacactcaaaggtgaaggagttcggagtgctcccataagtatactgacggaggaagatgctcctgattctccccctcaagacttctctgtaaaacagttgtctggtgtcacggtgaagttgtcatggcaaccacccctggagccaaatggaattatcctttattacacagtttatgtctggaatagatcatcattaaaaactattaatgtcactgaaacatcattggagttatcagatttggattataatgttgaatacagtgcttatgtaacagctagcaccagatttggtgatgggaaaacaagaagcaatatcattagctttcaaacaccagagggagcaccaagcgatcctcccaaagatgtttattatgcaaacctcagttcttcatcaataattcttttctggacacctccttcaaaacctaatgggattatacaatattactctgtttattacagaaatacttcaggtacttttatgcagaattttacactccatgaagtaaccaatgactttgacaatatgactgtatccacaattatagataaactgacaatattcagctactatacattttggttaacagcaagtacttcagttggaaatgggaataaaagcagtgacatcattgaagtatacacagatcaagacatacctgaagggtttgttggaaacctgacttacgaatccatttcgtcaactgcaataaatgtaagctgggtcccaccggctcaaccaaacggtctagtcttctactatgtttcactgatcttacagcagactcctcgccatgtgagaccacctcttgttacatatgagagaagcatatattttgataatctggaaaaatacactgattatatattaaaaattactccatcaacagaaaagggattctctgatacctatactgcccagctatacatcaagactgaagaagatgtcccagaaacttcaccaataatcaacacttttaaaaacctttcctctacctcagttctcttatcatgggatcccccagtaaagccaaatggtgcaataataagttatgatttaactttacaaggaccaaatgaaaattattctttcattacttctgataattacataatattggaagagctttcaccatttacattatatagcttttttgctgccgcaagaactagaaaaggacttggtccttccagtattcttttcttttacacagatgagtcagtgccgttagcacctccacaaaatttgactttaatcaactgtacttcagactttgtatggctgaaatggagcccaagtcctcttccaggtggtattgttaaagtatatagttttaaaattcatgaacatgaaactgacactatatattataagaatatatcaggatttaaaactgaagccaaacttgttggactggaaccagtcagcacctactctatccgtgtatctgcgttcaccaaagttggaaatggcaatcaatttagtaatgtagtaaaattcacaacccaagaatcagttccagatgtcgtgcagaatatgcagtgcatggcaactagctggcagtcagttttagtgaaatgggatccacccaaaaaggcaaatggaataataacgcagtatatggtaacagttgaaaggaattctacaaaagtttctccccaagatcacatgtacactttcataaagcttcttgccaatacctcatatgtctttaaagtaagagcttcaacctcagctggtgaaggtgatgaaagcacatgccatgtcagcacactacctgaaacagttcccagtgttcccacaaatattgctttttctgatgttcagtcaactagtgcaacattgacatggataagacctgacactatccttggctactttcaaaattacaaaattaccactcaacttcgtgctcaaaaatgcaaagaatgggaatccgaagaatgtgttgaatatcaaaaaattcaatacctctatgaagctcacttaactgaagagacagtatatggattaaagaaatttagatggtatagattccaagtggctgccagcaccaatgctggctatggcaatgcttcaaactggatttctacaaaaactctgcctggccctccagatggtcctcctgaaaatgttcatgtagtagcaacatcaccttttagcatcagcataagctggagtgaacctgctgtcattactggaccaacatgttatctgattgatgtcaaatcggtagataatgatgaatttaatatatccttcatcaagtcaaatgaagaaaataaaaccatagaaattaaagatttagaaatattcacaaggtattctgtagtgatcactgcatttactgggaacattagtgctgcatatgtagaagggaagtcaagtgctgaaatgattgttactactttagaatcagccccaaaggacccacctaacaacatgacatttcagaagataccagatgaagttacaaaatttcaattaacgttccttcctccttctcaacctaatggaaatatccaagtatatcaagctctggtttaccgagaagatgatcctactgctgtccagattcacaacctcagtattatacagaaaaccaacacattcgtcattgcaatgctagaaggactaaaaggtggacatacatacaatatcagtgtttacgcagtcaatagtgctggtgcaggtccaaaggttccgatgagaataaccatggatatcaaagctccagcacgaccaaaaaccaaaccaacccctatttatgatgccacaggaaaactgcttgtgacttcaacaacaattacaatcagaatgccaatatgttactacagtgatgatcatggaccaataaaaaatgtacaagtgcttgtgacagaaacaggagctcagcatgatggaaatgtaacaaagtggtatgatgcatattttaataaagcaaggccatattttacaaatgaaggctttcctaaccctccatgtacagaaggaaagacaaagtttagtggcaatgaagaaatctacatcataggtgctgataatgcatgcatgattcctggcaatgaagacaaaatttgcaatggaccactgaaaccaaaaaagcaatacttatttaaatttagagctacaaatattatgggacaatttactgactctgattattctgaccctgttaagactttaggggaaggactttcagaaagaaccgtagagatcattctttccgtcactttgtgtatcctttcaataattctccttggaacagctatttttgcatttgcaagaattcgacagaagcagaaagaaggtggcacatactctcctcaggatgcagaaattattgacactaaattgaagctggatcagctcatcacagtggcagacctggaactgaaggacgagagattaacgcggttacttagttatagaaaatccatcaagccaataagcaagaaatccttcctgcaacatgttgaagagctttgcacaaacaacaacctaaagtttcaagaagaattttcggaattaccaaaatttcttcaggatctttcttcaactgatgctgatctgccttggaatagagcaaaaaaccgcttcccaaacataaaaccatataataataacagagtaaagctgatagctgacgctagtgttccaggttcggattatattaatgccagctatatttctggttatttatgtccaaatgaatttattgctactcaaggtccactaccaggaacagttggagatttttggagaatggtgtgggaaaccagagcaaaaacattagtaatgctaacacagtgttttgaaaaaggacggatcagatgccatcagtattggccagaggacaacaagccagttactgtctttggagatatagtgattacaaagctaatggaggatgttcaaatagattggactatcagggatctgaaaattgaaaggcatggggattgcatgactgttcgacagtgtaactttactgcctggccagagcatggggttcctgagaacagcgcccctctaattcactttgtgaagttggttcgagcaagcagggcacatgacaccacacctatgattgttcactgcagtgctggagttggaagaactggagtttttattgctctggaccatttaacacaacatataaatgaccatgattttgtggatatatatggactagtagctgaactgagaagtgaaagaatgtgcatggtgcagaatctggcacagtatatctttttacaccagtgcattctggatctcttatcaaataagggaagtaatcagcccatctgttttgttaactattcagcacttcagaagatggactctttggacgccatggaaggtgatgttgagcttgaatgggaagaaaccactatgtaaatattcagaccaaaggatacaattggaagagatttttaaatcccaggggccaaagttaccccctcattcttccgaattgaaatgtgcaaccttaaagaaatatctatgcttctctcactgtgcctttccaaacggattgaacattttaagactagttcttgaaaatagctaatacagaataattatttgttttgtacagaataaatattatgcattttaaatgcttaagaaaagacatcccatatgtttttgaagtcctccatattttggaataagccaaatagaaaattattattatattagcattaatgtttcaatgtgaattttccctatgtattggatttaattttgagcaaaagttgtaaatgttgattcagtagtgttgttttggcttacagggtattgatgtttcttgtggataatttccaggactgtcataatgatctgtacttccatgtacacccctgtgttttgaatcctctgttttatgagtgctgagatatcatctcatgatcccgaacagctgaacagtaaccccctgacactgcagggattacttggcctttatacaacacacagtagctcttcagggacacttagggctatttaatttgcattgtgatcttcagtttgagaaccttaaaagaaaaattaaaagtgcaattgcacacatgaaattacagagtaccattctagcaaacctacatttgtaaactttaaaacacaagttttaccccctgtattgtatattcaaatatatagtaaatgtatcagagtatttgcccattagatatagtcaacctaatattaacaattctgaagagtttcttcagcaaaaatgtatcaaaagagtaataaaaacactgtgcgtgtttcaagcttgtaaaccaatgatgtgctgctgtggtgccaacagagacttccaaatggattatgttaaatggccgtcatttcatttcccaaggttgattttgagcagtatacttggtggaactgaaaacaaagaaattaaccatgtatagcaaattcaaggtttctttatagaaaatctttcagcctccatcttattaaatagtgacaatgtggtaagttttgaattacatgaactcattttgtcatagatttcaattaagagtaataaatagtattaattattctcttctatgataagaagtatatcttatgcttatttccgctggaacatatatata

SEQ ID NO: 171905 - DNA, 8165 bp, Homo sapiens
  Payload ID: 13774
  Gene Symbol: PTPRQ
  Gene Name: protein tyrosine phosphatase, receptor type, Q
  ENST ID: ENST00000616559
  CDS Start-End: 1-6999
atgaaaaaagtgcctataaaaccagaacaacctgagaaacttagagccttcaatatttccacacattccttttctctgcactggagcctaccctctggtcatgtggaaaggtatcaagtggatcttgttcctgacagtggctttgttactatcagagatcttggaggtggagaatatcaggttgatgtttccaatgtcgttcctggtactaggtacgatataaccatctcttcaatttctacaacatacacctcacctgttactagaatagtgacaacaaatgtaacaaaaccagggcctccagtcttcctagccggggaaagagtcggatctgctgggattcttctgtcttggaatacaccacctaatccaaatggaaggattatatcttacattgtcaaatataaggaagtttgtccgtggatgcaaacagtatatacacaagtcagatcaaagccagacagtctggaagttcttcttactaatcttaatcctggaacaacatatgaaattaaggttgctgctgaaaacagtgctggcattggagtgtttagtgatccatttctcttccaaactgcagaaagtgctccaggaaaagtggtgaatctcacagttgaggcctacaacgcttcagcagttaagctgatttggtatttacctcggcaaccaaatggcaaaattaccagcttcaagattagtgtcaagcatgccagaagtgggatagtagtgaaagatgtctcaatcagagtagaggacattttgactgggaaattgccagaatgcaatgagaatagtgaatcttttttatggagtacagccagcccttctccaacccttggtagagttacacctccatcgcgtaccacacattcatcaagcacgttgacacagaatgagatcagctctgtgtggaaagagcctatcagttttgtagtgacacacttgagaccttatacaacatatctttttgaagtttcagctgctacaactgaagcaggttatattgatagtacgattgtcagaacaccagaatcagtgcctgaaggaccaccacaaaactgcgtaacaggcaacatcacaggaaagtccttttcaattttatgggacccaccaactatagtaacagggaaatttagttatagagttgaattatatggaccatcaggtcgcattttggataacagcacaaaagacctcaagtttgcattcactaacctaacaccatttacaatgtatgatgtctatattgcggctgaaaccagtgcagggactgggcccaagtcaaatatttcagtattcactccaccagatgttccaggggcagtgtttgatttacaacttgcagaggtagaatccacgcaagtaagaattacttggaagaaaccacgacaaccaaatggaattattaaccaataccgagtgaaagtgctagttccagagacaggaataattttggaaaatactttgctcactggaaataatgagtatataaatgaccccatggctccagaaattgtgaacatagtagagccaatggtaggattatatgagggttcagcagagatgtcgtctgaccttcactcacttgctacatttatatataacagccatccagataaaaactttcctgcaaggaatagagctgaagaccagacttcaccagttgtaactacaaggaatcagtatattactgacattgcagctgaacagctgtcttatgttatcaggagacttgtacctttcactgagcacatgattagtgtatctgctttcaccatcatgggagaaggaccaccaacagttctcagtgttaggacacgtcagcaagtgccaagctccattaaaattataaactataaaaatattagttcttcatctattttgttatattgggatcctccagaatatcccaatggaaaaataactcactatacgatttatgcaatggaattggatacaaacagagcattccagataactaccatagataacagctttctcataacagggttaaagaaatacacaaaatacaaaatgagagtggcagcctcaacccacgttggagaaagttctttgtctgaagaaaatgacatctttgtgagaacttcagaagatgaaccggaatcatcacctcaagatgtcgaagtaattgatgttaccgcagatgaaataaggttgaagtggtcaccacccgaaaagcccaatgggatcattattgcttatgaagtgctatataaaaatatagatactttatatatgaagaacacatcaacaacagacataatattaaggaacttaagacctcacaccctctataacatttctgtaaggtcttacaccagatttggtcatggcaatcaggtatcttctttactctctgtaaggacttcggagactgtgcctgatagtgcaccagaaaatatcacttacaaaaatatttcttctggagagattgagctatcattccttcccccaagtagtcccaatggaatcatacaaaaatatacaatttatctcaagagaagtaatggaaatgaggaaagaactataaatacaacctctttaacccaaaacattaaagtactgaagaaatatacccaatatatcattgaggtgtctgctagtacactcaaaggtgaaggagttcggagtgctcccataagtatactgacggaggaagatgctcctgattctccccctcaagacttctctgtaaaacagttgtctggtgtcacggtgaagttgtcatggcaaccacccctggagccaaatggaattatcctttattacacagtttatgtctggaatagatcatcattaaaaactattaatgtcactgaaacatcattggagttatcagatttggattataatgttgaatacagtgcttatgtaacagctagcaccagatttggtgatgggaaaacaagaagcaatatcattagctttcaaacaccagagggagcaccaagcgatcctcccaaagatgtttattatgcaaacctcagttcttcatcaataattcttttctggacacctccttcaaaacctaatgggattatacaatattactctgtttattacagaaatacttcaggtacttttatgcagaattttacactccatgaagtaaccaatgactttgacaatatgactgtatccacaattatagataaactgacaatattcagctactatacattttggttaacagcaagtacttcagttggaaatgggaataaaagcagtgacatcattgaagtatacacagatcaagacatacctgaagggtttgttggaaacctgacttacgaatccatttcgtcaactgcaataaatgtaagctgggtcccaccggctcaaccaaacggtctagtcttctactatgtttcactgatcttacagcagactcctcgccatgtgagaccacctcttgttacatatgagagaagcatatattttgataatctggaaaaatacactgattatatattaaaaattactccatcaacagaaaagggattctctgatacctatactgcccagctatacatcaagactgaagaagatgtcccagaaacttcaccaataatcaacacttttaaaaacctttcctctacctcagttctcttatcatgggatcccccagtaaagccaaatggtgcaataataagttatgatttaactttacaaggaccaaatgaaaattattctttcattacttctgataattacataatattggaagagctttcaccatttacattatatagcttttttgctgccgcaagaactagaaaaggacttggtccttccagtattcttttcttttacacagatgagtcagtgccgttagcacctccacaaaatttgactttaatcaactgtacttcagactttgtatggctgaaatggagcccaagtcctcttccaggtggtattgttaaagtatatagttttaaaattcatgaacatgaaactgacactatatattataagaatatatcaggatttaaaactgaagccaaacttgttggactggaaccagtcagcacctactctatccgtgtatctgcgttcaccaaagttggaaatggcaatcaatttagtaatgtagtaaaattcacaacccaagaatcagttccagatgtcgtgcagaatatgcagtgcatggcaactagctggcagtcagttttagtgaaatgggatccacccaaaaaggcaaatggaataataacgcagtatatggtaacagttgaaaggaattctacaaaagtttctccccaagatcacatgtacactttcataaagcttcttgccaatacctcatatgtctttaaagtaagagcttcaacctcagctggtgaaggtgatgaaagcacatgccatgtcagcacactacctgaaacagttcccagtgttcccacaaatattgctttttctgatgttcagtcaactagtgcaacattgacatggataagacctgacactatccttggctactttcaaaattacaaaattaccactcaacttcgtgctcaaaaatgcaaagaatgggaatccgaagaatgtgttgaatatcaaaaaattcaatacctctatgaagctcacttaactgaagagacagtatatggattaaagaaatttagatggtatagattccaagtggctgccagcaccaatgctggctatggcaatgcttcaaactggatttctacaaaaactctgcctggccctccagatggtcctcctgaaaatgttcatgtagtagcaacatcaccttttagcatcagcataagctggagtgaacctgctgtcattactggaccaacatgttatctgattgatgtcaaatcggtagataatgatgaatttaatatatccttcatcaagtcaaatgaagaaaataaaaccatagaaattaaagatttagaaatattcacaaggtattctgtagtgatcactgcatttactgggaacattagtgctgcatatgtagaagggaagtcaagtgctgaaatgattgttactactttagaatcagccccaaaggacccacctaacaacatgacatttcagaagataccagatgaagttacaaaatttcaattaacgttccttcctccttctcaacctaatggaaatatccaagtatatcaagctctggtttaccgagaagatgatcctactgctgtccagattcacaacctcagtattatacagaaaaccaacacattcgtcattgcaatgctagaaggactaaaaggtggacatacatacaatatcagtgtttacgcagtcaatagtgctggtgcaggtccaaaggttccgatgagaataaccatggatatcaaagctccagcacgaccaaaaaccaaaccaacccctatttatgatgccacaggaaaactgcttgtgacttcaacaacaattacaatcagaatgccaatatgttactacagtgatgatcatggaccaataaaaaatgtacaagtgcttgtgacagaaacaggagctcagcatgatggaaatgtaacaaagtggtatgatgcatattttaataaagcaaggccatattttacaaatgaaggctttcctaaccctccatgtacagaaggaaagacaaagtttagtggcaatgaagaaatctacatcataggtgctgataatgcatgcatgattcctggcaatgaagacaaaatttgcaatggaccactgaaaccaaaaaagcaatacttatttaaatttagagctacaaatattatgggacaatttactgactctgattattctgaccctgttaagactttaggggaaggactttcagaaagaaccgtagagatcattctttccgtcactttgtgtatcctttcaataattctccttggaacagctatttttgcatttgcaagaattcgacagaagcagaaagaaggtggcacatactctcctcaggatgcagaaattattgacactaaattgaagctggatcagctcatcacagtggcagacctggaactgaaggacgagagattaacgcggccaataagcaagaaatccttcctgcaacatgttgaagagctttgcacaaacaacaacctaaagtttcaagaagaattttcggaattaccaaaatttcttcaggatctttcttcaactgatgctgatctgccttggaatagagcaaaaaaccgcttcccaaacataaaaccatataataataacagagtaaagctgatagctgacgctagtgttccaggttcggattatattaatgccagctatatttctggttatttatgtccaaatgaatttattgctactcaaggtccactaccaggaacagttggagatttttggagaatggtgtgggaaaccagagcaaaaacattagtaatgctaacacagtgttttgaaaaaggacggatcagatgccatcagtattggccagaggacaacaagccagttactgtctttggagatatagtgattacaaagctaatggaggatgttcaaatagattggactatcagggatctgaaaattgaaaggcatggggattgcatgactgttcgacagtgtaactttactgcctggccagagcatggggttcctgagaacagcgcccctctaattcactttgtgaagttggttcgagcaagcagggcacatgacaccacacctatgattgttcactgcagtgctggagttggaagaactggagtttttattgctctggaccatttaacacaacatataaatgaccatgattttgtggatatatatggactagtagctgaactgagaagtgaaagaatgtgcatggtgcagaatctggcacagtatatctttttacaccagtgcattctggatctcttatcaaataagggaagtaatcagcccatctgttttgttaactattcagcacttcagaagatggactctttggacgccatggaaggtgatgttgagcttgaatgggaagaaaccactatgtaaatattcagaccaaaggatacaattggaagagatttttaaatcccaggggccaaagttaccccctcattcttccgaattgaaatgtgcaaccttaaagaaatatctatgcttctctcactgtgcctttccaaacggattgaacattttaagactagttcttgaaaatagctaatacagaataattatttgttttgtacagaataaatattatgcattttaaatgcttaagaaaagacatcccatatgtttttgaagtcctccatattttggaataagccaaatagaaaattattattatattagcattaatgtttcaatgtgaattttccctatgtattggatttaattttgagcaaaagttgtaaatgttgattcagtagtgttgttttggcttacagggtattgatgtttcttgtggataatttccaggactgtcataatgatctgtacttccatgtacacccctgtgttttgaatcctctgttttatgagtgctgagatatcatctcatgatcccgaacagctgaacagtaaccccctgacactgcagggattacttggcctttatacaacacacagtagctcttcagggacacttagggctatttaatttgcattgtgatcttcagtttgagaaccttaaaagaaaaattaaaagtgcaattgcacacatgaaattacagagtaccattctagcaaacctacatttgtaaactttaaaacacaagttttaccccctgtattgtatattcaaatatatagtaaatgtatcagagtatttgcccattagatatagtcaacctaatattaacaattctgaagagtttcttcagcaaaaatgtatcaaaagagtaataaaaacactgtgcgtgtttcaagcttgtaaaccaatgatgtgctgctgtggtgccaacagagacttccaaatggattatgttaaatggccgtcatttcatttcccaaggttgattttgagcagtatacttggtggaactgaaaacaaagaaattaaccatgtatagcaaattcaaggtttctttatagaaaatctttcagcctccatcttattaaatagtgacaatgtggtaagttttgaattacatgaactcattttgtcatagatttcaattaagagtaataaatagtattaattattctcttctatg

SEQ ID NO: 171906 - DNA, 3529 bp, Homo sapiens
  Payload ID: 13775
  Gene Symbol: PTPRR
  Gene Name: protein tyrosine phosphatase, receptor type, R
  Uniprot ID: Q15256
  ENST ID: ENST00000283228
  CDS Start-End: 454-2427
accaccccagcgatggagcctactctgctccaagccgccgctaagacccggagaagcggaatttcactttgaaattcccttgcctcgtgagggccggcgctgggcatgctcagtagccgcggcgctgctgctgggctgctgggctggcgcggagtccaccctgccgtctccgccttggcttctgggcgtccagaaggccaggcatttgccgcctctgagcgcttctgttccccttacccgcaacctcctactgctcttcctctctccctctcttagggaggttgaagctggtgctggtttctgtcggcgccacagactgactgctctgcaaaccccagccgaggacctgaatcccggagactagaagacccttggcggtggctctttctaatagcactttacctgaagtggggtcgtggtggagtttctcctccacctctcaatgcaaacactatgcggagagcagtctgcttccctgcgctgtgcctgctccttaatcttcacgctgcagggtgcttttcaggaaacaatgatcattttttggcaattaatcagaagaagagtgggaagccggtattcatttataagcattcacaagacattgagaagagcctggatatagccccacaaaaaatctacagacatagctaccattcctcttccgaagctcaagtaagcaaacgccaccagattgtcaattcagcatttcctagacccgcatatgacccgtctctcaatctgctggccatggatggtcaagatcttgaagtggaaaatctcccaatcccagcagcaaatgtaattgtggtgacactgcaaatggatgtaaacaagctgaacataaccttgcttcggatcttccgccaaggagtggctgcagctttaggactcttaccccagcaagtgcacatcaatcgcctcattggaaagaagaacagtattgaactgtttgtgtctcccataaaccgaaaaacaggaatttctgatgctctgccctctgaggaagttcttcgttcacttaatatcaatgttttgcatcaaagtttatcccagtttggaattacagaagtctctcctgagaaaaatgttttacaagggcagcatgaagcggacaaaatctggagcaaagaaggattttatgctgttgtcatttttctcagcatctttgttattatagtaacgtgtttgatgattctttacagattaaaagaaagatttcagctttccttaagacaagacaaagagaaaaaccaggagatccacctatcgcccatcacattacagccagcactgtccgaggcaaagacagtccacagcatggtccaacctgagcaggccccaaaggtactgaatgttgtcgtggaccctcaaggccgaggtgctcctgagatcaaagctaccaccgctacctctgtttgcccttctcctttcaaaatgaagcccataggacttcaagagagaagagggtccaacgtatctcttacattggacatgagtagcttggggaacattgaaccctttgtgtctataccaacaccacgggagaaggtagcaatggagtatctgcagtcagccagccgaattctcacaaggtctcagctgagggacgtcgtggcaagttcacatttactccaaagtgaattcatggaaataccaatgaactttgtggatcccaaagaaattgatattccgcgtcatggaactaaaaatcgctataagaccattttaccaaatcccctcagcagagtgtgtttaagaccaaaaaatgtaaccgattcattgagcacctacattaatgctaattatattaggggctacagtggcaaggagaaagccttcattgccacgcagggccccatgatcaacaccgtggatgatttctggcagatggtttggcaggaagacagccctgtgattgttatgatcacaaaactcaaagaaaaaaatgagaaatgtgtgctatactggccggaaaagagagggatatatggaaaagttgaggttctggttatcagtgtaaatgaatgtgataactacaccattcgaaaccttgtcttaaagcaaggaagccacacccaacatgtgaagcattactggtacacctcatggcctgatcacaagactccagacagtgcccagcccctcctacagctcatgctggatgtagaagaagacagacttgcttcccagggccgagggcctgtggttgtccactgcagtgcaggaataggtagaacagggtgttttattgctacatccattggctgtcaacagctgaaagaagaaggagttgtggatgcactaagcattgtctgccagcttcgtatggatagaggtggaatggtgcaaaccagtgagcagtatgaatttgtgcaccatgctctgtgcctgtatgagagcagactttcagcagagactgtccagtgagtcattgaagacttgtcagaccatcaatctcttggggtgattaatcaaattacccacccaaggcttctagaaggagcttcctgcaatggaaggaaggagaagctctgaagcccatgtatggcatggattgtggaagactgggcaacatatttaagatttccagctccttgtgtatatgaatgcatttgtaagcatcccccaaattattctgaaggttttttgatgatggaggtatgataggtttatcacacagcctaaggcagattttgttttgtctgtactgactctatctgccacacagaatgtatgtatgtaatattcagtaataaatgtcatcaggtgatgactggatgagctgctgaagacattcgtattatgtgttagatgctttaatgtttgcaaaatctgtcttgtgaatggactgtcagctgttaaactgttcctgttttgaagtgctattacctttctcagttaccagaatcttgctgctaaagttgcaagtgattgataatggatttttaacagagaagtctttgtttttgaaaaacaaaaatcaaaaacagtaactattttatatggaaatgtgtcttgataatattacctattaaatgtgtatttatagtccctcctatcaaacaattacagagcacaatgattgtcattgggtatatatgtatttactctctattattgggcataaaggtggcttctgctccagaactctatccactgtatttccacatcgtgagtcattttactttaaaagggaaaaacaaatttgtagcaactctgaagtatcaagagttttaactacttgtctctcttttgctaagaagggatttttgaatatgctatctacctggaatctctctctcaacaaaaggtatatgccttcaggaatgatataatctgtcccattttcgaggctccttataaggacatttccatgtatgtccttacatttctgaaagctttcaatcttcaagagacaaaaaaaattaaaataactaccctcagcaaacactagctgttctgctcatatatgaatttttaatgcagcaatgttgactttgtttcatactgccaataaactcttaatact

SEQ ID NO: 171907 - DNA, 2037 bp, Homo sapiens
  Payload ID: 13775
  Gene Symbol: PTPRR
  Gene Name: protein tyrosine phosphatase, receptor type, R
  Uniprot ID: Q15256
  ENST ID: ENST00000342084
  CDS Start-End: 147-1784
aaacagtaccaggcggttacctccaggtgactaaatgaggcttcatctcagcacacaagcttagaaagctttacgattagtcctgcttgctatggtaaggaaataacacaaagaagagtgcaaatggaagtcgacttcatcacaacatgcagtcaatttccaaacagacactgcaaatggatgtaaacaagctgaacataaccttgcttcggatcttccgccaaggagtggctgcagctttaggactcttaccccagcaagtgcacatcaatcgcctcattggaaagaagaacagtattgaactgtttgtgtctcccataaaccgaaaaacaggaatttctgatgctctgccctctgaggaagttcttcgttcacttaatatcaatgttttgcatcaaagtttatcccagtttggaattacagaagtctctcctgagaaaaatgttttacaagggcagcatgaagcggacaaaatctggagcaaagaaggattttatgctgttgtcatttttctcagcatctttgttattatagtaacgtgtttgatgattctttacagattaaaagaaagatttcagctttccttaagacaagacaaagagaaaaaccaggagatccacctatcgcccatcacattacagccagcactgtccgaggcaaagacagtccacagcatggtccaacctgagcaggccccaaaggtactgaatgttgtcgtggaccctcaaggccgaggtgctcctgagatcaaagctaccaccgctacctctgtttgcccttctcctttcaaaatgaagcccataggacttcaagagagaagagggtccaacgtatctcttacattggacatgagtagcttggggaacattgaaccctttgtgtctataccaacaccacgggagaaggtagcaatggagtatctgcagtcagccagccgaattctcacaaggtctcagctgagggacgtcgtggcaagttcacatttactccaaagtgaattcatggaaataccaatgaactttgtggatcccaaagaaattgatattccgcgtcatggaactaaaaatcgctataagaccattttaccaaatcccctcagcagagtgtgtttaagaccaaaaaatgtaaccgattcattgagcacctacattaatgctaattatattaggggctacagtggcaaggagaaagccttcattgccacgcagggccccatgatcaacaccgtggatgatttctggcagatggtttggcaggaagacagccctgtgattgttatgatcacaaaactcaaagaaaaaaatgagaaatgtgtgctatactggccggaaaagagagggatatatggaaaagttgaggttctggttatcagtgtaaatgaatgtgataactacaccattcgaaaccttgtcttaaagcaaggaagccacacccaacatgtgaagcattactggtacacctcatggcctgatcacaagactccagacagtgcccagcccctcctacagctcatgctggatgtagaagaagacagacttgcttcccagggccgagggcctgtggttgtccactgcagtgcaggaataggtagaacagggtgttttattgctacatccattggctgtcaacagctgaaagaagaaggagttgtggatgcactaagcattgtctgccagcttcgtatggatagaggtggaatggtgcaaaccagtgagcagtatgaatttgtgcaccatgctctgtgcctgtatgagagcagactttcagcagagactgtccagtgagtcattgaagacttgtcagaccatcaatctcttggggtgattaatcaaattacccacccaaggcttctagaaggagcttcctgcaatggaaggaaggagaagctctgaagcccatgtatggcatggattgtggaagactgggcaacatatttaagatttccagctccttgtgtatatgaatgcatttgtaagcatcccccaaattattctgaaggttttttgatgatggaggtatgataggtttatcacacag

SEQ ID NO: 171908 - DNA, 2632 bp, Homo sapiens
  Payload ID: 13775
  Gene Symbol: PTPRR
  Gene Name: protein tyrosine phosphatase, receptor type, R
  Uniprot ID: Q15256
  ENST ID: ENST00000378778
  CDS Start-End: 167-1522
aatgcaccacaagcttttgtttgcacttgtttcacttttgtttaaaagtaaagaggtagtacagcacgtaatccagggtgctgatgttgtgggaggggacttaaaacagagtaaggaaatcagaaacaatttcctccacacagaaaagaacagaactctcttacctatgaaccagaaaaatgttttacaagggcagcatgaagcggacaaaatctggagcaaagaaggattttatgctgttgtcatttttctcagcatctttgttattatagtaacgtgtttgatgattctttacagattaaaagaaagatttcagctttccttaagacaagacaaagagaaaaaccaggagatccacctatcgcccatcacattacagccagcactgtccgaggcaaagacagtccacagcatggtccaacctgagcaggccccaaaggtactgaatgttgtcgtggaccctcaaggccgaggtgctcctgagatcaaagctaccaccgctacctctgtttgcccttctcctttcaaaatgaagcccataggacttcaagagagaagagggtccaacgtatctcttacattggacatgagtagcttggggaacattgaaccctttgtgtctataccaacaccacgggagaaggtagcaatggagtatctgcagtcagccagccgaattctcacaaggtctcagctgagggacgtcgtggcaagttcacatttactccaaagtgaattcatggaaataccaatgaactttgtggatcccaaagaaattgatattccgcgtcatggaactaaaaatcgctataagaccattttaccaaatcccctcagcagagtgtgtttaagaccaaaaaatgtaaccgattcattgagcacctacattaatgctaattatattaggggctacagtggcaaggagaaagccttcattgccacgcagggccccatgatcaacaccgtggatgatttctggcagatggtttggcaggaagacagccctgtgattgttatgatcacaaaactcaaagaaaaaaatgagaaatgtgtgctatactggccggaaaagagagggatatatggaaaagttgaggttctggttatcagtgtaaatgaatgtgataactacaccattcgaaaccttgtcttaaagcaaggaagccacacccaacatgtgaagcattactggtacacctcatggcctgatcacaagactccagacagtgcccagcccctcctacagctcatgctggatgtagaagaagacagacttgcttcccagggccgagggcctgtggttgtccactgcagtgcaggaataggtagaacagggtgttttattgctacatccattggctgtcaacagctgaaagaagaaggagttgtggatgcactaagcattgtctgccagcttcgtatggatagaggtggaatggtgcaaaccagtgagcagtatgaatttgtgcaccatgctctgtgcctgtatgagagcagactttcagcagagactgtccagtgagtcattgaagacttgtcagaccatcaatctcttggggtgattaatcaaattacccacccaaggcttctagaaggagcttcctgcaatggaaggaaggagaagctctgaagcccatgtatggcatggattgtggaagactgggcaacatatttaagatttccagctccttgtgtatatgaatgcatttgtaagcatcccccaaattattctgaaggttttttgatgatggaggtatgataggtttatcacacagcctaaggcagattttgttttgtctgtactgactctatctgccacacagaatgtatgtatgtaatattcagtaataaatgtcatcaggtgatgactggatgagctgctgaagacattcgtattatgtgttagatgctttaatgtttgcaaaatctgtcttgtgaatggactgtcagctgttaaactgttcctgttttgaagtgctattacctttctcagttaccagaatcttgctgctaaagttgcaagtgattgataatggatttttaacagagaagtctttgtttttgaaaaacaaaaatcaaaaacagtaactattttatatggaaatgtgtcttgataatattacctattaaatgtgtatttatagtccctcctatcaaacaattacagagcacaatgattgtcattgggtatatatgtatttactctctattattgggcataaaggtggcttctgctccagaactctatccactgtatttccacatcgtgagtcattttactttaaaagggaaaaacaaatttgtagcaactctgaagtatcaagagttttaactacttgtctctcttttgctaagaagggatttttgaatatgctatctacctggaatctctctctcaacaaaaggtatatgccttcaggaatgatataatctgtcccattttcgaggctccttataaggacatttccatgtatgtccttacatttctgaaagctttcaatcttcaagagacaaaaaaaattaaaataactaccctcagcaaacactagctgttctgctcatatatgaatttttaatgcagcaatgttgactttgtttcatactgccaataaactcttaatactaaatactg

SEQ ID NO: 171909 - DNA, 2818 bp, Homo sapiens
  Payload ID: 13775
  Gene Symbol: PTPRR
  Gene Name: protein tyrosine phosphatase, receptor type, R
  Uniprot ID: Q15256
  ENST ID: ENST00000440835
  CDS Start-End: 469-1707
acttaaaacagagtaaggaaatcagaaacaatttcctccacacagaaaagaacagaactctcttacctatgaaccaggtagtttccaagagagacgctgagggatgtttagaaagcctgggacctgcagatgccatgtcaggcacgcttgctcctgcataggagactaaataatctcgatatataaggatggcagtctgttgtcttagatcagtttgagaagcagctctggcagcggggggtgtaggtgtgttgcactacactgaatggaataaggctaaaaatatgtttagtgtctgataagaacgccagttttctcaagctctcatttaacgtcggactttctgttttgcttttaaagaaaaatgttttacaagggcagcatgaagcggacaaaatctggagcaaagaaggattttatgctgttgtcatttttctcagcatctttgttattatagtaacgtgtttgatgattctttacagattaaaagaaagatttcagctttccttaagacaagacaaagagaaaaaccaggagatccacctatcgcccatcacattacagccagcactgtccgaggcaaagacagtccacagcatggtccaacctgagcaggccccaaaggtactgaatgttgtcgtggaccctcaaggccgaggtgctcctgagatcaaagctaccaccgctacctctgtttgcccttctcctttcaaaatgaagcccataggacttcaagagagaagagggtccaacgtatctcttacattggacatgagtagcttggggaacattgaaccctttgtgtctataccaacaccacgggagaaggtagcaatggagtatctgcagtcagccagccgaattctcacaaggtctcagctgagggacgtcgtggcaagttcacatttactccaaagtgaattcatggaaataccaatgaactttgtggatcccaaagaaattgatattccgcgtcatggaactaaaaatcgctataagaccattttaccaaatcccctcagcagagtgtgtttaagaccaaaaaatgtaaccgattcattgagcacctacattaatgctaattatattaggggctacagtggcaaggagaaagccttcattgccacgcagggccccatgatcaacaccgtggatgatttctggcagatggtttggcaggaagacagccctgtgattgttatgatcacaaaactcaaagaaaaaaatgagaaatgtgtgctatactggccggaaaagagagggatatatggaaaagttgaggttctggttatcagtgtaaatgaatgtgataactacaccattcgaaaccttgtcttaaagcaaggaagccacacccaacatgtgaagcattactggtacacctcatggcctgatcacaagactccagacagtgcccagcccctcctacagctcatgctggatgtagaagaagacagacttgcttcccagggccgagggcctgtggttgtccactgcagtgcaggaataggtagaacagggtgttttattgctacatccattggctgtcaacagctgaaagaagaaggagttgtggatgcactaagcattgtctgccagcttcgtatggatagaggtggaatggtgcaaaccagtgagcagtatgaatttgtgcaccatgctctgtgcctgtatgagagcagactttcagcagagactgtccagtgagtcattgaagacttgtcagaccatcaatctcttggggtgattaatcaaattacccacccaaggcttctagaaggagcttcctgcaatggaaggaaggagaagctctgaagcccatgtatggcatggattgtggaagactgggcaacatatttaagatttccagctccttgtgtatatgaatgcatttgtaagcatcccccaaattattctgaaggttttttgatgatggaggtatgataggtttatcacacagcctaaggcagattttgttttgtctgtactgactctatctgccacacagaatgtatgtatgtaatattcagtaataaatgtcatcaggtgatgactggatgagctgctgaagacattcgtattatgtgttagatgctttaatgtttgcaaaatctgtcttgtgaatggactgtcagctgttaaactgttcctgttttgaagtgctattacctttctcagttaccagaatcttgctgctaaagttgcaagtgattgataatggatttttaacagagaagtctttgtttttgaaaaacaaaaatcaaaaacagtaactattttatatggaaatgtgtcttgataatattacctattaaatgtgtatttatagtccctcctatcaaacaattacagagcacaatgattgtcattgggtatatatgtatttactctctattattgggcataaaggtggcttctgctccagaactctatccactgtatttccacatcgtgagtcattttactttaaaagggaaaaacaaatttgtagcaactctgaagtatcaagagttttaactacttgtctctcttttgctaagaagggatttttgaatatgctatctacctggaatctctctctcaacaaaaggtatatgccttcaggaatgatataatctgtcccattttcgaggctccttataaggacatttccatgtatgtccttacatttctgaaagctttcaatcttcaagagacaaaaaaaattaaaataactaccctcagcaaacactagctgttctgctcatatatgaatttttaatgcagcaatgttgactttgtttcatactgccaataaactcttaatactaaatactga

SEQ ID NO: 171910 - DNA, 1603 bp, Homo sapiens
  Payload ID: 13775
  Gene Symbol: PTPRR
  Gene Name: protein tyrosine phosphatase, receptor type, R
  Uniprot ID: Q15256
  ENST ID: ENST00000549308
  CDS Start-End: 241-1479
aaaagtaaagaggtagtacagcacgtaatccagggtgctgatgttgtgggaggggacttaaaacagagtaaggaaatcagaaacaatttcctccacacagaaaagaacagaactctcttacctatgaaccagaaaaatgttttacaagggcagcatgaagcggacaaaatctggagcaaagaaggattttatgctgttgtcatttttctcagcatctttgttattatagtaacgtgtttgatgattctttacagattaaaagaaagatttcagctttccttaagacaagacaaagagaaaaaccaggagatccacctatcgcccatcacattacagccagcactgtccgaggcaaagacagtccacagcatggtccaacctgagcaggccccaaaggtactgaatgttgtcgtggaccctcaaggccgaggtgctcctgagatcaaagctaccaccgctacctctgtttgcccttctcctttcaaaatgaagcccataggacttcaagagagaagagggtccaacgtatctcttacattggacatgagtagcttggggaacattgaaccctttgtgtctataccaacaccacgggagaaggtagcaatggagtatctgcagtcagccagccgaattctcacaaggtctcagctgagggacgtcgtggcaagttcacatttactccaaagtgaattcatggaaataccaatgaactttgtggatcccaaagaaattgatattccgcgtcatggaactaaaaatcgctataagaccattttaccaaatcccctcagcagagtgtgtttaagaccaaaaaatgtaaccgattcattgagcacctacattaatgctaattatattaggggctacagtggcaaggagaaagccttcattgccacgcagggccccatgatcaacaccgtggatgatttctggcagatggtttggcaggaagacagccctgtgattgttatgatcacaaaactcaaagaaaaaaatgagaaatgtgtgctatactggccggaaaagagagggatatatggaaaagttgaggttctggttatcagtgtaaatgaatgtgataactacaccattcgaaaccttgtcttaaagcaaggaagccacacccaacatgtgaagcattactggtacacctcatggcctgatcacaagactccagacagtgcccagcccctcctacagctcatgctggatgtagaagaagacagacttgcttcccagggccgagggcctgtggttgtccactgcagtgcaggaataggtagaacagggtgttttattgctacatccattggctgtcaacagctgaaagaagaaggagttgtggatgcactaagcattgtctgccagcttcgtatggatagaggtggaatggtgcaaaccagtgagcagtatgaatttgtgcaccatgctctgtgcctgtatgagagcagactttcagcagagactgtccagtgagtcattgaagacttgtcagaccatcaatctcttggggtgattaatcaaattacccacccaaggcttctagaaggagcttcctgcaatggaaggaaggagaagctctgaagcccatgtatggcat

SEQ ID NO: 171911 - DNA, 2966 bp, Homo sapiens
  Payload ID: 13775
  Gene Symbol: PTPRR
  Gene Name: protein tyrosine phosphatase, receptor type, R
  ENST ID: ENST00000551219
  CDS Start-End: 680-1105
gaaccaggtagtttccaagagagacgctgagggatgtttagaaagcctgggacctgcagatgccatgtcaggcacgcttgctcctgcataggagactaaataatctcgatatataaggatggcagtctgttgtcttagatcagtttgagaagcagctctggcagcggggggtgtaggtgtgttgcactacactgaatggaataaggctaaaaatatgtttagtgtctgataagaacgccagttttctcaagctctcatttaacgtcggactttctgttttgcttttaaagaaaaatgttttacaagggcagcatgaagcggacaaaatctggagcaaagaaggattttatgctgttgtcatttttctcagcatctttgttattatagtaacgtgtttgatgattctttacagattaaaagaaagatttcagctttccttaagacaagacaaagagaaaaaccaggagatccacctatcgcccatcacattacagccagcactgtccgaggcaaagacagtccacagcatggtccaacctgagcaggccccaaaggtactgaatgttgtcgtggaccctcaaggccgaggtgctcctgagatcaaagctaccaccgctacctctgtttgcccttctcctttcaaaatgaagcccataggacttcaagagaggaaataccaatgaactttgtggatcccaaagaaattgatattccgcgtcatggaactaaaaatcgctataagaccattttaccaaatcccctcagcagagtgtgtttaagaccaaaaaatgtaaccgattcattgagcacctacattaatgctaattatattaggggctacagtggcaaggagaaagccttcattgccacgcagggccccatgatcaacaccgtggatgatttctggcagatggtttggcaggaagacagccctgtgattgttatgatcacaaaactcaaagaaaaaaatgagaagaggaggcttacagggctggcacctgcccacacctggcattcgacatttccctgggctaagctgagtgggagcagatgcccccatcctatgaccagggcctgtgcaggagccatcacaccaccttgctgatgatgacacctagttcttcaatttcacactggacttcatctcccttcttgagaaagacagaaggtttcctgaatacaccaacacctggggaggtcccagtcaggatgacatcccctgggtaaaagaaatgtgtgctatactggccggaaaagagagggatatatggaaaagttgaggttctggttatcagtgtaaatgaatgtgataactacaccattcgaaaccttgtcttaaagcaaggaagccacacccaacatgtgaagcattactggtacacctcatggcctgatcacaagactccagacagtgcccagcccctcctacagctcatgctggatgtagaagaagacagacttgcttcccagggccgagggcctgtggttgtccactgcagtgcaggaataggtagaacagggtgttttattgctacatccattggctgtcaacagctgaaagaagaaggagttgtggatgcactaagcattgtctgccagcttcgtatggatagaggaagaaactaaagtgcaaggggtttcgaggaatttgtccaagatgcatacagctaagaattggcagaggagggatttgaactcaccttggctgatgccaaatccaagtacttgatcattaggctgtaccacctccccagtaatgttacacagaggtggaatggtgcaaaccagtgagcagtatgaatttgtgcaccatgctctgtgcctgtatgagagcagactttcagcagagactgtccagtgagtcattgaagacttgtcagaccatcaatctcttggggtgattaatcaaattacccacccaaggcttctagaaggagcttcctgcaatggaaggaaggagaagctctgaagcccatgtatggcatggattgtggaagactgggcaacatatttaagatttccagctccttgtgtatatgaatgcatttgtaagcatcccccaaattattctgaaggttttttgatgatggaggtatgataggtttatcacacagcctaaggcagattttgttttgtctgtactgactctatctgccacacagaatgtatgtatgtaatattcagtaataaatgtcatcaggtgatgactggatgagctgctgaagacattcgtattatgtgttagatgctttaatgtttgcaaaatctgtcttgtgaatggactgtcagctgttaaactgttcctgttttgaagtgctattacctttctcagttaccagaatcttgctgctaaagttgcaagtgattgataatggatttttaacagagaagtctttgtttttgaaaaacaaaaatcaaaaacagtaactattttatatggaaatgtgtcttgataatattacctattaaatgtgtatttatagtccctcctatcaaacaattacagagcacaatgattgtcattgggtatatatgtatttactctctattattgggcataaaggtggcttctgctccagaactctatccactgtatttccacatcgtgagtcattttactttaaaagggaaaaacaaatttgtagcaactctgaagtatcaagagttttaactacttgtctctcttttgctaagaagggatttttgaatatgctatctacctggaatctctctctcaacaaaaggtatatgccttcaggaatgatataatctgtcccattttcgaggctccttataaggacatttccatgtatgtccttacatttctgaaagctttcaatcttcaagagacaaaaaaaattaaaataactaccctcagcaaacactagctgttctgctcatatatgaatttttaatgcagcaatgttgactttgtttcatactgccaataaactcttaatactaaa

SEQ ID NO: 171912 - DNA, 1024 bp, Homo sapiens
  Payload ID: 13775
  Gene Symbol: PTPRR
  Gene Name: protein tyrosine phosphatase, receptor type, R
  ENST ID: ENST00000550661
  CDS Start-End: 429-1024
acttgtttcacttttgtttaaaagtaaagaggtagtacagcacgtaatccagggtgctgatgttgtgggaggggacttaaaacagagtaaggaaatcagaaacaatttcctccacacagaaaagaacagaactctcttacctatgaaccaggtagtttccaagagagacgctgagggatgtttagaaagcctgggacctgcagatgccatgtcaggcacgcttgctcctgcataggagactaaataatctcgatatataaggatggcagtctgttgtcttagatcagtttgagaagcagctctggcagcggggggtgtagaaaaatgttttacaagggcagcatgaagcggacaaaatctggagcaaagaaggattttatgctgttgtcatttttctcagcatctttgttattatagtaacgtgtttgatgattctttacagattaaaagaaagatttcagctttccttaagacaagacaaagagaaaaaccaggagatccacctatcgcccatcacattacagccagcactgtccgaggcaaagacagtccacagcatggtccaacctgagcaggccccaaaggtactgaatgttgtcgtggaccctcaaggccgaggtgctcctgagatcaaagctaccaccgctacctctgtttgcccttctcctttcaaaatgaagcccataggacttcaagagagaagagggtccaacgtatctcttacattggacatgagtagcttggggaacattgaaccctttgtgtctataccaacaccacgggagaaggtagcaatggagtatctgcagtcagccagccgaattctcacaaggtctcagctgagggacgtcgtggcaagttcacatttactccaaagtgaattcatggaaataccaatgaactttgtggatcccaaagaaattgatattccgcgtcatggaactaaaaatcgctataagaccattttaccaaatcccctcagcagagtgtgtttaagaccaaaaaatgtaaccgattcattgag

SEQ ID NO: 171913 - DNA, 4766 bp, Homo sapiens
  Payload ID: 13776
  Gene Symbol: PTPRS
  Gene Name: protein tyrosine phosphatase, receptor type, S
  ENST ID: ENST00000262963
  CDS Start-End: 24-4529
gagatcggaggtcgctgccaagcatggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgagaggaccagctgccctctggcttccccaacatcgacatgggcccacagttgaaggtggtggagcggacacggacagccaccatgctctgtgcagccagcggcaaccctgaccctgagatcacctggttcaaggacttcctgcctgtggatcctagtgccagcaatggacgcatcaaacagctgcgatcaggagccctgcagattgaaagcagtgaggaaaccgaccagggcaaatatgagtgtgtggccaccaacagcgccggcgtgcgctactcctcacctgccaacctctacgtgcgagtccgccgcgtggccccgcgcttctccatcctgcccatgagccacgagatcatgccagggggcaacgtgaacatcacctgcgtggccgtgggctcgcccatgccatacgtgaagtggatgcagggggccgaggacctgacccccgaggatgacatgcccgtgggtcggaacgtgctggaactcacagatgtcaaggactcggccaactacacctgcgtggccatgtccagcctgggcgtcattgaggcggttgctcagatcacggtgaaatctctccccaaagctcccgggactcccatggtgactgagaacacagccaccagcatcaccatcacgtgggactcgggcaacccagatcctgtgtcctattacgtcatcgaatataaatccaagagccaagacgggccgtatcagattaaagaggacatcaccaccacacgttacagcatcggcggcctgagccccaactcggagtacgagatctgggtgtcggccgtcaactccatcggccaggggccccccagcgagtccgtggtcacccgcacaggcgagcaggccccggccagcgcgccgcggaacgtgcaagcccggatgctcagcgcgaccaccatgattgtgcagtgggaggagccggtggagcccaacggcctgatccgcggctaccgcgtctactacaccatggaaccggagcaccccgtgggcaactggcagaagcacaacgtggacgacagcctgctgaccaccgtgggcagcctgctggaggacgagacctacaccgtgcgggtgctcgccttcacctccgtcggcgacgggcccctctcggaccccatccaggtcaagacgcagcagggagtgccgggccagcccatgaacctgcgggccgaggccaggtcggagaccagcatcacgctgtcctggagccccccgcggcaggagagtatcatcaagtacgagctcctcttccgggaaggcgaccatggccgggaggtgggaaggaccttcgacccgacgacttcctacgtggtggaggacctgaagcccaacacggagtacgccttccgcctggcggcccgctcgccgcagggcctgggcgccttcacccccgtggtgcggcagcgcacgctgcagtccatctcgcccaagaacttcaaggtgaaaatgatcatgaagacatcagttctgctcagctgggagttccctgacaactacaactcacccacaccctacaagatccagtacaatgggctcacactggatgtggatggccgtaccaccaagaagctcatcacgcacctcaagccccacaccttctacaactttgtgctgaccaatcgcggcagcagcctgggcggcctccagcagacggtcaccgcctggactgccttcaacctgctcaacggcaagcccagcgtcgcccccaagcctgatgctgacggcttcatcatggtgtatcttcctgacggccagagccccgtgcctgtccagagctatttcattgtgatggtgccactgcgcaagtctcgtggaggccaattcctgaccccgctgggtagcccagaggacatggatctggaagagctcatccaggacatctcacggctacagaggcgcagcctgcggcactcgcgtcagctggaggtgccccggccctatattgcagctcgcttctctgtgctgccacccacgttccatcccggcgaccagaagcagtatggcggcttcgataaccggggcctggagcccggccaccgctatgtcctcttcgtgcttgccgtgcttcagaagagcgagcctacctttgcagccagtcccttctcagaccccttccagctggataacccggacccccagcccatcgtggatggcgaggaggggcttatctgggtgatcgggcctgtgctggccgtggtcttcataatctgcattgtcattgctatcctgctctacaagaagaagccccatagtaaacgcaaggactcagaaccccgcaccaaatgcctcctgaacaatgccgacctcgcccctcaccaccccaaggaccctgtggaaatgagacgcattaacttccagactccaggcatgcttagccacccgccaattcccatcgcagacatggcggagcacacggagcggctcaaggccaacgacagcctcaagctctcccaggagtatgagtccatcgaccctggacagcagttcacatgggaacattccaacctggaagtgaacaagccgaagaaccgctatgccaacgtcatcgcctatgaccactcccgtgtcatcctccagcccattgaaggcatcatgggcagtgattacatcaatgccaactacgtggacggctaccggtgtcagaacgcgtacattgccacgcaggggccgctgcctgagacctttggggacttctggcgtatggtgtgggagcagcggtcggcgaccatcgtcatgatgacgcggctggaggagaagtcacggatcaagtgtgatcagtattggcccaacagaggcacggagacctacggcttcatccaggtcacgttgctagataccatcgagctggccacattctgcgtcaggacattctctctgcacaagaatggctccagtgagaaacgcgaggtccgccagttccagtttacggcgtggccggaccatggcgtgcccgaatacccaacgcccttcctggctttcctgcggagagtcaagacctgcaacccgccagatgccggccccatcgtggttcactgcagtgccggtgtgggccgcacaggctgctttatcgtcatcgacgccatgcttgagcggatcaagccagagaagacagtcgatgtctatggccacgtgacgctcatgaggtcccagcgcaactacatggtgcagacggaggaccagtacagcttcatccacgaggccctgctggaggccgtgggctgtggcaacacagaagtgcccgcacgcagcctctatgcctacatccagaagctggcccaggtggagcctggcgaacacgtcactggcatggaactcgagttcaagcggctggctaactccaaggcccacacgtcacgcttcatcagtgccaatctgccttgtaacaagttcaagaaccgcctggtgaacatcatgccctatgagagcacacgggtctgtctgcaacccatccggggtgtggagggctctgactacatcaacgccagcttcattgatggctacaggcagcagaaggcctacatcgcgacacaggggccgctggcggagaccacggaagacttctggcgcatgctgtgggagaacaattcgacgatcgtggtgatgctgaccaagctgcgggagatgggccgggagaagtgtcaccagtactggccggccgagcgctctgcccgctaccagtactttgtggtagatccgatggcagaatacaacatgcctcagtatatcctgcgagagttcaaggtcacagatgcccgggatggccagtcccggactgtccggcagttccagttcacagactggccggaacagggtgtgccaaagtcgggggagggcttcatcgacttcattggccaagtgcataagactaaggagcagtttggccaggacggccccatctctgtccactgcagtgccggcgtgggcaggacgggcgtcttcatcacgcttagcatcgtgctggagcggatgcggtatgaaggcgtggtggacatctttcagacggtgaagatgctacgaacccagcggccggccatggtgcagacagaggatgagtaccagttctgttaccaggcggcactggagtacctcggaagctttgaccactatgcaacctaaagccatggttccccccaggcccgacaccactggccccggatgcctctgcccctcccgggcggacctcctgaggcctggacccccagtgggcagggcaggaggtggcagcggcagcagctgtgtttctgcaccatttccgaggacgacgcagcccctcgagcccccccaccggccccggccgccccagcgacctccctggcaccggccgccgccttcaaatacttggcacattcctcc

SEQ ID NO: 171914 - DNA, 7233 bp, Homo sapiens
  Payload ID: 13776
  Gene Symbol: PTPRS
  Gene Name: protein tyrosine phosphatase, receptor type, S
  Uniprot ID: Q13332
  ENST ID: ENST00000348075
  CDS Start-End: 235-5967
cctcgcgccgcccgcccggcagcccggccggcgcgcgcacgccgcgagccgctggcgctcgggctccgctcggatcccatgcaacagccacgatgtgaagcggggcagagccgggggagcccagcccagccagcctccagacgttgccccatctgacgctcggctcgaggcctctctgtgagggaccggggggccatccccctccagggcggagatcggaggtcgctgccaagcatggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgagaggaccagctgccctctggcttccccaacatcgacatgggcccacagttgaaggtggtggagcggacacggacagccaccatgctctgtgcagccagcggcaaccctgaccctgagatcacctggttcaaggacttcctgcctgtggatcctagtgccagcaatggacgcatcaaacagctgcgatcaggagccctgcagattgaaagcagtgaggaaaccgaccagggcaaatatgagtgtgtggccaccaacagcgccggcgtgcgctactcctcacctgccaacctctacgtgcgagtccgccgcgtggccccgcgcttctccatcctgcccatgagccacgagatcatgccagggggcaacgtgaacatcacctgcgtggccgtgggctcgcccatgccatacgtgaagtggatgcagggggccgaggacctgacccccgaggatgacatgcccgtgggtcggaacgtgctggaactcacagatgtcaaggactcggccaactacacctgcgtggccatgtccagcctgggcgtcattgaggcggttgctcagatcacggtgaaatctctccccaaagctcccgggactcccatggtgactgagaacacagccaccagcatcaccatcacgtgggactcgggcaacccagatcctgtgtcctattacgtcatcgaatataaatccaagagccaagacgggccgtatcagattaaagaggacatcaccaccacacgttacagcatcggcggcctgagccccaactcggagtacgagatctgggtgtcggccgtcaactccatcggccaggggccccccagcgagtccgtggtcacccgcacaggcgagcaggccccggccagcgcgccgcggaacgtgcaagcccggatgctcagcgcgaccaccatgattgtgcagtgggaggagccggtggagcccaacggcctgatccgcggctaccgcgtctactacaccatggaaccggagcaccccgtgggcaactggcagaagcacaacgtggacgacagcctgctgaccaccgtgggcagcctgctggaggacgagacctacaccgtgcgggtgctcgccttcacctccgtcggcgacgggcccctctcggaccccatccaggtcaagacgcagcagggagtgccgggccagcccatgaacctgcgggccgaggccaggtcggagaccagcatcacgctgtcctggagccccccgcggcaggagagtatcatcaagtacgagctcctcttccgggaaggcgaccatggccgggaggtgggaaggaccttcgacccgacgacttcctacgtggtggaggacctgaagcccaacacggagtacgccttccgcctggcggcccgctcgccgcagggcctgggcgccttcacccccgtggtgcggcagcgcacgctgcagtccaaaccgtcagccccccctcaagacgttaaatgtgtcagcgtgcgctccacggccattttggtaagttggcgcccgccgccgccggaaacgcacaacggggccctggtgggctacagcgtccgctaccgaccgctgggctcagaggacccggaacccaaggaggtgaacggcatccccccgaccaccactcagatcctgctggaggccttggagaagtggacccagtaccgcatcacgactgtcgctcacacagaggtgggaccagggcccgagagctcgcccgtggtcgtccgcaccgacgaggatgtgcccagcgcgccgccgcggaaggtggaggcggaggcgctcaacgccacggccatccgcgtgctgtggcgctcgcccgcgcccggccggcagcacggccagatccgcggctaccaggtccactacgtgcgcatggagggcgccgaggcccgcgggccgccgcgcatcaaggacgtcatgctggccgatgcccaggagatggtcatcacaaacttgcagcctgagaccgcgtactccatcacggtagccgcctacaccatgaagggcgatggcgctcgcagcaaacccaaggtggttgtgaccaagggagcagtgctgggccgcccaaccctgtcggtgcagcagacccccgagggcagcctgctggcacgctgggagcccccggctggcaccgcggaggaccaggtgctgggctaccgcctgcagtttggccgtgaggactcgacgcccctggccaccctggagttcccgccctccgaggaccgctacacggcatcaggcgtgcacaagggggccacgtatgtgttccggcttgcggcccggagccgcggcggcctgggcgaggaggcagccgaggtcctgagcatcccggaggacacgccccgtggccacccgcagattctggaggcggccggcaacgcctcggccgggaccgtccttctccgctggctgccacccgtgcccgccgagcgcaacggggccatcgtcaaatacacggtggccgtgcgggaggccggtgccctgggccctgcccgagagactgagctgccggcagcggctgagccgggcgcggagaacgcgctcacgctgcagggcctgaagcccgacacggcctatgacctccaagtgcgagcccacacgcgccggggccctggccccttcagcccccccgtccgctaccggacgttcctgcgggaccaagtctcgcccaagaacttcaaggtgaaaatgatcatgaagacatcagttctgctcagctgggagttccctgacaactacaactcacccacaccctacaagatccagtacaatgggctcacactggatgtggatggccgtaccaccaagaagctcatcacgcacctcaagccccacaccttctacaactttgtgctgaccaatcgcggcagcagcctgggcggcctccagcagacggtcaccgcctggactgccttcaacctgctcaacggcaagcccagcgtcgcccccaagcctgatgctgacggcttcatcatggtgtatcttcctgacggccagagccccgtgcctgtccagagctatttcattgtgatggtgccactgcgcaagtctcgtggaggccaattcctgaccccgctgggtagcccagaggacatggatctggaagagctcatccaggacatctcacggctacagaggcgcagcctgcggcactcgcgtcagctggaggtgccccggccctatattgcagctcgcttctctgtgctgccacccacgttccatcccggcgaccagaagcagtatggcggcttcgataaccggggcctggagcccggccaccgctatgtcctcttcgtgcttgccgtgcttcagaagagcgagcctacctttgcagccagtcccttctcagaccccttccagctggataacccggacccccagcccatcgtggatggcgaggaggggcttatctgggtgatcgggcctgtgctggccgtggtcttcataatctgcattgtcattgctatcctgctctacaagaacaaacccgacagtaaacgcaaggactcagaaccccgcaccaaatgcctcctgaacaatgccgacctcgcccctcaccaccccaaggaccctgtggaaatgagacgcattaacttccagactccaggcatgcttagccacccgccaattcccatcgcagacatggcggagcacacggagcggctcaaggccaacgacagcctcaagctctcccaggagtatgagtccatcgaccctggacagcagttcacatgggaacattccaacctggaagtgaacaagccgaagaaccgctatgccaacgtcatcgcctatgaccactcccgtgtcatcctccagcccattgaaggcatcatgggcagtgattacatcaatgccaactacgtggacggctaccggtgtcagaacgcgtacattgccacgcaggggccgctgcctgagacctttggggacttctggcgtatggtgtgggagcagcggtcggcgaccatcgtcatgatgacgcggctggaggagaagtcacggatcaagtgtgatcagtattggcccaacagaggcacggagacctacggcttcatccaggtcacgttgctagataccatcgagctggccacattctgcgtcaggacattctctctgcacaagaatggctccagtgagaaacgcgaggtccgccagttccagtttacggcgtggccggaccatggcgtgcccgaatacccaacgcccttcctggctttcctgcggagagtcaagacctgcaacccgccagatgccggccccatcgtggttcactgcagtgccggtgtgggccgcacaggctgctttatcgtcatcgacgccatgcttgagcggatcaagccagagaagacagtcgatgtctatggccacgtgacgctcatgaggtcccagcgcaactacatggtgcagacggaggaccagtacagcttcatccacgaggccctgctggaggccgtgggctgtggcaacacagaagtgcccgcacgcagcctctatgcctacatccagaagctggcccaggtggagcctggcgaacacgtcactggcatggaactcgagttcaagcggctggctaactccaaggcccacacgtcacgcttcatcagtgccaatctgccttgtaacaagttcaagaaccgcctggtgaacatcatgccctatgagagcacacgggtctgtctgcaacccatccggggtgtggagggctctgactacatcaacgccagcttcattgatggctacaggcagcagaaggcctacatcgcgacacaggggccgctggcggagaccacggaagacttctggcgcatgctgtgggagaacaattcgacgatcgtggtgatgctgaccaagctgcgggagatgggccgggagaagtgtcaccagtactggccggccgagcgctctgcccgctaccagtactttgtggtagatccgatggcagaatacaacatgcctcagtatatcctgcgagagttcaaggtcacagatgcccgggatggccagtcccggactgtccggcagttccagttcacagactggccggaacagggtgtgccaaagtcgggggagggcttcatcgacttcattggccaagtgcataagactaaggagcagtttggccaggacggccccatctctgtccactgcagtgccggcgtgggcaggacgggcgtcttcatcacgcttagcatcgtgctggagcggatgcggtatgaaggcgtggtggacatctttcagacggtgaagatgctacgaacccagcggccggccatggtgcagacagaggatgagtaccagttctgttaccaggcggcactggagtacctcggaagctttgaccactatgcaacctaaagccatggttccccccaggcccgacaccactggccccggatgcctctgcccctcccgggcggacctcctgaggcctggacccccagtgggcagggcaggaggtggcagcggcagcagctgtgtttctgcaccatttccgaggacgacgcagcccctcgagcccccccaccggccccggccgccccagcgacctccctggcaccggccgccgccttcaaatacttggcacattcctcctttccttccaattccaaaaccagattccggggtggggggtggggggatggtgagcaaataggagtgctccccagaaccagaggagggtggggcacagaccatagacggacccctcgtcctcccccagcggtggtagggggacccggggggctcctccccgctctgcagcctggggacactgggctgggaccagaatccagctttcttttaaaactctcagtgtaactgtatcccgtgacatttcattttttttaaatagtgtatttttttttccatttttttttttaagagaaacaaacaaaagactcgccagtcaatgactttcaaagagaactaactttggcttattcatattctgttcaaagacagtctattttttcactgtagaaagcgtccttgtgtgatagttacgttcgcaaacgcgcacgccaggcccatggctgtaccttggcttttttttttttttttttttttttaatttttcctaccatcagaaagtgtgctttgctcacagaagaatgggatgtccttttttctttcttggctttttttttccccctttttgtttcatttttataaattaaattttcagacatatcaaatacagttctgagggtaaggtcatgggggagctcggacccagtggcgttgggtgcggttgagggggacgctgctgtaagaggagagagatgacagtggtcctcctctgagagcctgagctgtctccccgtctcccgcccccaaggagacagagaggatcctacttcttcggggacagtggctgtatggctgtgctgccccacatcagggaccctttccccctgggactgtggggcagtttgggagcaaaaccagaaggacaggcccccctctacccgcctaccctgagcaagcgagttgttcctctttgtacaagggcaggtctgcggttactttcaacactgtttattccagcggaagcagccgggtggttttcccacccccgtgtatgtagatatatcgactttgtattaaaggaagatcgtctga

SEQ ID NO: 171915 - DNA, 6018 bp, Homo sapiens
  Payload ID: 13776
  Gene Symbol: PTPRS
  Gene Name: protein tyrosine phosphatase, receptor type, S
  ENST ID: ENST00000353284
  CDS Start-End: 235-4752
cctcgcgccgcccgcccggcagcccggccggcgcgcgcacgccgcgagccgctggcgctcgggctccgctcggatcccatgcaacagccacgatgtgaagcggggcagagccgggggagcccagcccagccagcctccagacgttgccccatctgacgctcggctcgaggcctctctgtgagggaccggggggccatccccctccagggcggagatcggaggtcgctgccaagcatggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgagaggaccagctgccctctggcttccccaacatcgacatgggcccacagttgaaggtggtggagcggacacggacagccaccatgctctgtgcagccagcggcaaccctgaccctgagatcacctggttcaaggacttcctgcctgtggatcctagtgccagcaatggacgcatcaaacagctgcgatcaggagccctgcagattgaaagcagtgaggaaaccgaccagggcaaatatgagtgtgtggccaccaacagcgccggcgtgcgctactcctcacctgccaacctctacgtgcgagagcttcgagaagtccgccgcgtggccccgcgcttctccatcctgcccatgagccacgagatcatgccagggggcaacgtgaacatcacctgcgtggccgtgggctcgcccatgccatacgtgaagtggatgcagggggccgaggacctgacccccgaggatgacatgcccgtgggtcggaacgtgctggaactcacagatgtcaaggactcggccaactacacctgcgtggccatgtccagcctgggcgtcattgaggcggttgctcagatcacggtgaaatctctccccaaagctcccgggactcccatggtgactgagaacacagccaccagcatcaccatcacgtgggactcgggcaacccagatcctgtgtcctattacgtcatcgaatataaatccaagagccaagacgggccgtatcagattaaagaggacatcaccaccacacgttacagcatcggcggcctgagccccaactcggagtacgagatctgggtgtcggccgtcaactccatcggccaggggccccccagcgagtccgtggtcacccgcacaggcgagcaggccccggccagcgcgccgcggaacgtgcaagcccggatgctcagcgcgaccaccatgattgtgcagtgggaggagccggtggagcccaacggcctgatccgcggctaccgcgtctactacaccatggaaccggagcaccccgtgggcaactggcagaagcacaacgtggacgacagcctgctgaccaccgtgggcagcctgctggaggacgagacctacaccgtgcgggtgctcgccttcacctccgtcggcgacgggcccctctcggaccccatccaggtcaagacgcagcagggagtgccgggccagcccatgaacctgcgggccgaggccaggtcggagaccagcatcacgctgtcctggagccccccgcggcaggagagtatcatcaagtacgagctcctcttccgggaaggcgaccatggccgggaggtgggaaggaccttcgacccgacgacttcctacgtggtggaggacctgaagcccaacacggagtacgccttccgcctggcggcccgctcgccgcagggcctgggcgccttcacccccgtggtgcggcagcgcacgctgcagtccatctcgcccaagaacttcaaggtgaaaatgatcatgaagacatcagttctgctcagctgggagttccctgacaactacaactcacccacaccctacaagatccagtacaatgggctcacactggatgtggatggccgtaccaccaagaagctcatcacgcacctcaagccccacaccttctacaactttgtgctgaccaatcgcggcagcagcctgggcggcctccagcagacggtcaccgcctggactgccttcaacctgctcaacggcaagcccagcgtcgcccccaagcctgatgctgacggcttcatcatggtgtatcttcctgacggccagagccccgtgcctgtccagagctatttcattgtgatggtgccactgcgcaagtctcgtggaggccaattcctgaccccgctgggtagcccagaggacatggatctggaagagctcatccaggacatctcacggctacagaggcgcagcctgcggcactcgcgtcagctggaggtgccccggccctatattgcagctcgcttctctgtgctgccacccacgttccatcccggcgaccagaagcagtatggcggcttcgataaccggggcctggagcccggccaccgctatgtcctcttcgtgcttgccgtgcttcagaagagcgagcctacctttgcagccagtcccttctcagaccccttccagctggataacccggacccccagcccatcgtggatggcgaggaggggcttatctgggtgatcgggcctgtgctggccgtggtcttcataatctgcattgtcattgctatcctgctctacaagaacaaacccgacagtaaacgcaaggactcagaaccccgcaccaaatgcctcctgaacaatgccgacctcgcccctcaccaccccaaggaccctgtggaaatgagacgcattaacttccagactccaggcatgcttagccacccgccaattcccatcgcagacatggcggagcacacggagcggctcaaggccaacgacagcctcaagctctcccaggagtatgagtccatcgaccctggacagcagttcacatgggaacattccaacctggaagtgaacaagccgaagaaccgctatgccaacgtcatcgcctatgaccactcccgtgtcatcctccagcccattgaaggcatcatgggcagtgattacatcaatgccaactacgtggacggctaccggtgtcagaacgcgtacattgccacgcaggggccgctgcctgagacctttggggacttctggcgtatggtgtgggagcagcggtcggcgaccatcgtcatgatgacgcggctggaggagaagtcacggatcaagtgtgatcagtattggcccaacagaggcacggagacctacggcttcatccaggtcacgttgctagataccatcgagctggccacattctgcgtcaggacattctctctgcacaagaatggctccagtgagaaacgcgaggtccgccagttccagtttacggcgtggccggaccatggcgtgcccgaatacccaacgcccttcctggctttcctgcggagagtcaagacctgcaacccgccagatgccggccccatcgtggttcactgcagtgccggtgtgggccgcacaggctgctttatcgtcatcgacgccatgcttgagcggatcaagccagagaagacagtcgatgtctatggccacgtgacgctcatgaggtcccagcgcaactacatggtgcagacggaggaccagtacagcttcatccacgaggccctgctggaggccgtgggctgtggcaacacagaagtgcccgcacgcagcctctatgcctacatccagaagctggcccaggtggagcctggcgaacacgtcactggcatggaactcgagttcaagcggctggctaactccaaggcccacacgtcacgcttcatcagtgccaatctgccttgtaacaagttcaagaaccgcctggtgaacatcatgccctatgagagcacacgggtctgtctgcaacccatccggggtgtggagggctctgactacatcaacgccagcttcattgatggctacaggcagcagaaggcctacatcgcgacacaggggccgctggcggagaccacggaagacttctggcgcatgctgtgggagaacaattcgacgatcgtggtgatgctgaccaagctgcgggagatgggccgggagaagtgtcaccagtactggccggccgagcgctctgcccgctaccagtactttgtggtagatccgatggcagaatacaacatgcctcagtatatcctgcgagagttcaaggtcacagatgcccgggatggccagtcccggactgtccggcagttccagttcacagactggccggaacagggtgtgccaaagtcgggggagggcttcatcgacttcattggccaagtgcataagactaaggagcagtttggccaggacggccccatctctgtccactgcagtgccggcgtgggcaggacgggcgtcttcatcacgcttagcatcgtgctggagcggatgcggtatgaaggcgtggtggacatctttcagacggtgaagatgctacgaacccagcggccggccatggtgcagacagaggatgagtaccagttctgttaccaggcggcactggagtacctcggaagctttgaccactatgcaacctaaagccatggttccccccaggcccgacaccactggccccggatgcctctgcccctcccgggcggacctcctgaggcctggacccccagtgggcagggcaggaggtggcagcggcagcagctgtgtttctgcaccatttccgaggacgacgcagcccctcgagcccccccaccggccccggccgccccagcgacctccctggcaccggccgccgccttcaaatacttggcacattcctcctttccttccaattccaaaaccagattccggggtggggggtggggggatggtgagcaaataggagtgctccccagaaccagaggagggtggggcacagaccatagacggacccctcgtcctcccccagcggtggtagggggacccggggggctcctccccgctctgcagcctggggacactgggctgggaccagaatccagctttcttttaaaactctcagtgtaactgtatcccgtgacatttcattttttttaaatagtgtatttttttttccatttttttttttaagagaaacaaacaaaagactcgccagtcaatgactttcaaagagaactaactttggcttattcatattctgttcaaagacagtctattttttcactgtagaaagcgtccttgtgtgatagttacgttcgcaaacgcgcacgccaggcccatggctgtaccttggcttttttttttttttttttttttttaatttttcctaccatcagaaagtgtgctttgctcacagaagaatgggatgtccttttttctttcttggctttttttttccccctttttgtttcatttttataaattaaattttcagacatatcaaatacagttctgagggtaaggtcatgggggagctcggacccagtggcgttgggtgcggttgagggggacgctgctgtaagaggagagagatgacagtggtcctcctctgagagcctgagctgtctccccgtctcccgcccccaaggagacagagaggatcctacttcttcggggacagtggctgtatggctgtgctgccccacatcagggaccctttccccctgggactgtggggcagtttgggagcaaaaccagaaggacaggcccccctctacccgcctaccctgagcaagcgagttgttcctctttgtacaagggcaggtctgcggttactttcaacactgtttattccagcggaagcagccgggtggttttcccacccccgtgtatgtagatatatcgactttgtattaaaggaagatcgtctga

SEQ ID NO: 171916 - DNA, 7347 bp, Homo sapiens
  Payload ID: 13776
  Gene Symbol: PTPRS
  Gene Name: protein tyrosine phosphatase, receptor type, S
  Uniprot ID: Q13332
  ENST ID: ENST00000357368
  CDS Start-End: 235-6081
cctcgcgccgcccgcccggcagcccggccggcgcgcgcacgccgcgagccgctggcgctcgggctccgctcggatcccatgcaacagccacgatgtgaagcggggcagagccgggggagcccagcccagccagcctccagacgttgccccatctgacgctcggctcgaggcctctctgtgagggaccggggggccatccccctccagggcggagatcggaggtcgctgccaagcatggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgagaggaccagctgccctctggcttccccaacatcgacatgggcccacagttgaaggtggtggagcggacacggacagccaccatgctctgtgcagccagcggcaaccctgaccctgagatcacctggttcaaggacttcctgcctgtggatcctagtgccagcaatggacgcatcaaacagctgcgatcagaaacctttgaaagcactccgattcgaggagccctgcagattgaaagcagtgaggaaaccgaccagggcaaatatgagtgtgtggccaccaacagcgccggcgtgcgctactcctcacctgccaacctctacgtgcgagagcttcgagaagtccgccgcgtggccccgcgcttctccatcctgcccatgagccacgagatcatgccagggggcaacgtgaacatcacctgcgtggccgtgggctcgcccatgccatacgtgaagtggatgcagggggccgaggacctgacccccgaggatgacatgcccgtgggtcggaacgtgctggaactcacagatgtcaaggactcggccaactacacctgcgtggccatgtccagcctgggcgtcattgaggcggttgctcagatcacggtgaaatctctccccaaagctcccgggactcccatggtgactgagaacacagccaccagcatcaccatcacgtgggactcgggcaacccagatcctgtgtcctattacgtcatcgaatataaatccaagagccaagacgggccgtatcagattaaagaggacatcaccaccacacgttacagcatcggcggcctgagccccaactcggagtacgagatctgggtgtcggccgtcaactccatcggccaggggccccccagcgagtccgtggtcacccgcacaggcgagcaggccccggccagcgcgccgcggaacgtgcaagcccggatgctcagcgcgaccaccatgattgtgcagtgggaggagccggtggagcccaacggcctgatccgcggctaccgcgtctactacaccatggaaccggagcaccccgtgggcaactggcagaagcacaacgtggacgacagcctgctgaccaccgtgggcagcctgctggaggacgagacctacaccgtgcgggtgctcgccttcacctccgtcggcgacgggcccctctcggaccccatccaggtcaagacgcagcagggagtgccgggccagcccatgaacctgcgggccgaggccaggtcggagaccagcatcacgctgtcctggagccccccgcggcaggagagtatcatcaagtacgagctcctcttccgggaaggcgaccatggccgggaggtgggaaggaccttcgacccgacgacttcctacgtggtggaggacctgaagcccaacacggagtacgccttccgcctggcggcccgctcgccgcagggcctgggcgccttcacccccgtggtgcggcagcgcacgctgcagtccaaaccgtcagccccccctcaagacgttaaatgtgtcagcgtgcgctccacggccattttggtaagttggcgcccgccgccgccggaaacgcacaacggggccctggtgggctacagcgtccgctaccgaccgctgggctcagaggacccggaacccaaggaggtgaacggcatccccccgaccaccactcagatcctgctggaggccttggagaagtggacccagtaccgcatcacgactgtcgctcacacagaggtgggaccagggcccgagagctcgcccgtggtcgtccgcaccgacgaggatgtgcccagcgcgccgccgcggaaggtggaggcggaggcgctcaacgccacggccatccgcgtgctgtggcgctcgcccgcgcccggccggcagcacggccagatccgcggctaccaggtccactacgtgcgcatggagggcgccgaggcccgcgggccgccgcgcatcaaggacgtcatgctggccgatgcccagtgggagacggatgacacggccgaatatgagatggtcatcacaaacttgcagcctgagaccgcgtactccatcacggtagccgcctacaccatgaagggcgatggcgctcgcagcaaacccaaggtggttgtgaccaagggagcagtgctgggccgcccaaccctgtcggtgcagcagacccccgagggcagcctgctggcacgctgggagcccccggctggcaccgcggaggaccaggtgctgggctaccgcctgcagtttggccgtgaggactcgacgcccctggccaccctggagttcccgccctccgaggaccgctacacggcatcaggcgtgcacaagggggccacgtatgtgttccggcttgcggcccggagccgcggcggcctgggcgaggaggcagccgaggtcctgagcatcccggaggacacgccccgtggccacccgcagattctggaggcggccggcaacgcctcggccgggaccgtccttctccgctggctgccacccgtgcccgccgagcgcaacggggccatcgtcaaatacacggtggccgtgcgggaggccggtgccctgggccctgcccgagagactgagctgccggcagcggctgagccgggcgcggagaacgcgctcacgctgcagggcctgaagcccgacacggcctatgacctccaagtgcgagcccacacgcgccggggccctggccccttcagcccccccgtccgctaccggacgttcctgcgggaccaagtctcgcccaagaacttcaaggtgaaaatgatcatgaagacatcagttctgctcagctgggagttccctgacaactacaactcacccacaccctacaagatccagtacaatgggctcacactggatgtggatggccgtaccaccaagaagctcatcacgcacctcaagccccacaccttctacaactttgtgctgaccaatcgcggcagcagcctgggcggcctccagcagacggtcaccgcctggactgccttcaacctgctcaacggcaagcccagcgtcgcccccaagcctgatgctgacggcttcatcatggtgtatcttcctgacggccagagccccgtgcctgtccagagctatttcattgtgatggtgccactgcgcaagtctcgtggaggccaattcctgaccccgctgggtagcccagaggacatggatctggaagagctcatccaggacatctcacggctacagaggcgcagcctgcggcactcgcgtcagctggaggtgccccggccctatattgcagctcgcttctctgtgctgccacccacgttccatcccggcgaccagaagcagtatggcggcttcgataaccggggcctggagcccggccaccgctatgtcctcttcgtgcttgccgtgcttcagaagagcgagcctacctttgcagccagtcccttctcagaccccttccagctggataacccggacccccagcccatcgtggatggcgaggaggggcttatctgggtgatcgggcctgtgctggccgtggtcttcataatctgcattgtcattgctatcctgctctacaagaacaaacccgacagtaaacgcaaggactcagaaccccgcaccaaatgcctcctgaacaatgccgacctcgcccctcaccaccccaaggaccctgtggaaatgagacgcattaacttccagactccagattcaggcctcaggagccccctcagggagccggggtttcactttgaaagcatgcttagccacccgccaattcccatcgcagacatggcggagcacacggagcggctcaaggccaacgacagcctcaagctctcccaggagtatgagtccatcgaccctggacagcagttcacatgggaacattccaacctggaagtgaacaagccgaagaaccgctatgccaacgtcatcgcctatgaccactcccgtgtcatcctccagcccattgaaggcatcatgggcagtgattacatcaatgccaactacgtggacggctaccggtgtcagaacgcgtacattgccacgcaggggccgctgcctgagacctttggggacttctggcgtatggtgtgggagcagcggtcggcgaccatcgtcatgatgacgcggctggaggagaagtcacggatcaagtgtgatcagtattggcccaacagaggcacggagacctacggcttcatccaggtcacgttgctagataccatcgagctggccacattctgcgtcaggacattctctctgcacaagaatggctccagtgagaaacgcgaggtccgccagttccagtttacggcgtggccggaccatggcgtgcccgaatacccaacgcccttcctggctttcctgcggagagtcaagacctgcaacccgccagatgccggccccatcgtggttcactgcagtgccggtgtgggccgcacaggctgctttatcgtcatcgacgccatgcttgagcggatcaagccagagaagacagtcgatgtctatggccacgtgacgctcatgaggtcccagcgcaactacatggtgcagacggaggaccagtacagcttcatccacgaggccctgctggaggccgtgggctgtggcaacacagaagtgcccgcacgcagcctctatgcctacatccagaagctggcccaggtggagcctggcgaacacgtcactggcatggaactcgagttcaagcggctggctaactccaaggcccacacgtcacgcttcatcagtgccaatctgccttgtaacaagttcaagaaccgcctggtgaacatcatgccctatgagagcacacgggtctgtctgcaacccatccggggtgtggagggctctgactacatcaacgccagcttcattgatggctacaggcagcagaaggcctacatcgcgacacaggggccgctggcggagaccacggaagacttctggcgcatgctgtgggagaacaattcgacgatcgtggtgatgctgaccaagctgcgggagatgggccgggagaagtgtcaccagtactggccggccgagcgctctgcccgctaccagtactttgtggtagatccgatggcagaatacaacatgcctcagtatatcctgcgagagttcaaggtcacagatgcccgggatggccagtcccggactgtccggcagttccagttcacagactggccggaacagggtgtgccaaagtcgggggagggcttcatcgacttcattggccaagtgcataagactaaggagcagtttggccaggacggccccatctctgtccactgcagtgccggcgtgggcaggacgggcgtcttcatcacgcttagcatcgtgctggagcggatgcggtatgaaggcgtggtggacatctttcagacggtgaagatgctacgaacccagcggccggccatggtgcagacagaggatgagtaccagttctgttaccaggcggcactggagtacctcggaagctttgaccactatgcaacctaaagccatggttccccccaggcccgacaccactggccccggatgcctctgcccctcccgggcggacctcctgaggcctggacccccagtgggcagggcaggaggtggcagcggcagcagctgtgtttctgcaccatttccgaggacgacgcagcccctcgagcccccccaccggccccggccgccccagcgacctccctggcaccggccgccgccttcaaatacttggcacattcctcctttccttccaattccaaaaccagattccggggtggggggtggggggatggtgagcaaataggagtgctccccagaaccagaggagggtggggcacagaccatagacggacccctcgtcctcccccagcggtggtagggggacccggggggctcctccccgctctgcagcctggggacactgggctgggaccagaatccagctttcttttaaaactctcagtgtaactgtatcccgtgacatttcattttttttaaatagtgtatttttttttccatttttttttttaagagaaacaaacaaaagactcgccagtcaatgactttcaaagagaactaactttggcttattcatattctgttcaaagacagtctattttttcactgtagaaagcgtccttgtgtgatagttacgttcgcaaacgcgcacgccaggcccatggctgtaccttggcttttttttttttttttttttttttaatttttcctaccatcagaaagtgtgctttgctcacagaagaatgggatgtccttttttctttcttggctttttttttccccctttttgtttcatttttataaattaaattttcagacatatcaaatacagttctgagggtaaggtcatgggggagctcggacccagtggcgttgggtgcggttgagggggacgctgctgtaagaggagagagatgacagtggtcctcctctgagagcctgagctgtctccccgtctcccgcccccaaggagacagagaggatcctacttcttcggggacagtggctgtatggctgtgctgccccacatcagggaccctttccccctgggactgtggggcagtttgggagcaaaaccagaaggacaggcccccctctacccgcctaccctgagcaagcgagttgttcctctttgtacaagggcaggtctgcggttactttcaacactgtttattccagcggaagcagccgggtggttttcccacccccgtgtatgtagatatatcgactttgtattaaaggaagatcgtctga

SEQ ID NO: 171917 - DNA, 893 bp, Homo sapiens
  Payload ID: 13776
  Gene Symbol: PTPRS
  Gene Name: protein tyrosine phosphatase, receptor type, S
  ENST ID: ENST00000590509
  CDS Start-End: 249-635
attccatcccatcaccccatgatccttccccattgtcccatgaccagcccccgcaggaccctcccctgctccatgtgaccctccctctgcctcctccatgaaggtctcctggatttccccactcgcctctcacagccctccattgtctctgcagacgttgccccatctgacgctcggctcgaggcctctctgtgagggaccggggggccatccccctccagggcggagatcggaggtcgctgccaagcatggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgaggaccttgatctcccttatccaaccagtaacagtctcagggcccagcgcctactggtggggatttattgtgcctttgcaagaaagaaaggaattgagagactagaatcatcctaatttataatcttcatcatgtgcttctgatgacaaaaggctgatccaactcagatgggttcaagcgagaaaggtaattgatgtgcagaattaaaattccatggagtggctggcttcaggttcagctggatccaggggctcattgaattttctca

SEQ ID NO: 171918 - DNA, 5993 bp, Homo sapiens
  Payload ID: 13776
  Gene Symbol: PTPRS
  Gene Name: protein tyrosine phosphatase, receptor type, S
  Uniprot ID: Q13332
  ENST ID: ENST00000588012
  CDS Start-End: 24-5756
gagatcggaggtcgctgccaagcatggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgagaggaccagctgccctctggcttccccaacatcgacatgggcccacagttgaaggtggtggagcggacacggacagccaccatgctctgtgcagccagcggcaaccctgaccctgagatcacctggttcaaggacttcctgcctgtggatcctagtgccagcaatggacgcatcaaacagctgcgatcaggagccctgcagattgaaagcagtgaggaaaccgaccagggcaaatatgagtgtgtggccaccaacagcgccggcgtgcgctactcctcacctgccaacctctacgtgcgagtccgccgcgtggccccgcgcttctccatcctgcccatgagccacgagatcatgccagggggcaacgtgaacatcacctgcgtggccgtgggctcgcccatgccatacgtgaagtggatgcagggggccgaggacctgacccccgaggatgacatgcccgtgggtcggaacgtgctggaactcacagatgtcaaggactcggccaactacacctgcgtggccatgtccagcctgggcgtcattgaggcggttgctcagatcacggtgaaatctctccccaaagctcccgggactcccatggtgactgagaacacagccaccagcatcaccatcacgtgggactcgggcaacccagatcctgtgtcctattacgtcatcgaatataaatccaagagccaagacgggccgtatcagattaaagaggacatcaccaccacacgttacagcatcggcggcctgagccccaactcggagtacgagatctgggtgtcggccgtcaactccatcggccaggggccccccagcgagtccgtggtcacccgcacaggcgagcaggccccggccagcgcgccgcggaacgtgcaagcccggatgctcagcgcgaccaccatgattgtgcagtgggaggagccggtggagcccaacggcctgatccgcggctaccgcgtctactacaccatggaaccggagcaccccgtgggcaactggcagaagcacaacgtggacgacagcctgctgaccaccgtgggcagcctgctggaggacgagacctacaccgtgcgggtgctcgccttcacctccgtcggcgacgggcccctctcggaccccatccaggtcaagacgcagcagggagtgccgggccagcccatgaacctgcgggccgaggccaggtcggagaccagcatcacgctgtcctggagccccccgcggcaggagagtatcatcaagtacgagctcctcttccgggaaggcgaccatggccgggaggtgggaaggaccttcgacccgacgacttcctacgtggtggaggacctgaagcccaacacggagtacgccttccgcctggcggcccgctcgccgcagggcctgggcgccttcacccccgtggtgcggcagcgcacgctgcagtccaaaccgtcagccccccctcaagacgttaaatgtgtcagcgtgcgctccacggccattttggtaagttggcgcccgccgccgccggaaacgcacaacggggccctggtgggctacagcgtccgctaccgaccgctgggctcagaggacccggaacccaaggaggtgaacggcatccccccgaccaccactcagatcctgctggaggccttggagaagtggacccagtaccgcatcacgactgtcgctcacacagaggtgggaccagggcccgagagctcgcccgtggtcgtccgcaccgacgaggatgtgcccagcgcgccgccgcggaaggtggaggcggaggcgctcaacgccacggccatccgcgtgctgtggcgctcgcccgcgcccggccggcagcacggccagatccgcggctaccaggtccactacgtgcgcatggagggcgccgaggcccgcgggccgccgcgcatcaaggacgtcatgctggccgatgcccaggagatggtcatcacaaacttgcagcctgagaccgcgtactccatcacggtagccgcctacaccatgaagggcgatggcgctcgcagcaaacccaaggtggttgtgaccaagggagcagtgctgggccgcccaaccctgtcggtgcagcagacccccgagggcagcctgctggcacgctgggagcccccggctggcaccgcggaggaccaggtgctgggctaccgcctgcagtttggccgtgaggactcgacgcccctggccaccctggagttcccgccctccgaggaccgctacacggcatcaggcgtgcacaagggggccacgtatgtgttccggcttgcggcccggagccgcggcggcctgggcgaggaggcagccgaggtcctgagcatcccggaggacacgccccgtggccacccgcagattctggaggcggccggcaacgcctcggccgggaccgtccttctccgctggctgccacccgtgcccgccgagcgcaacggggccatcgtcaaatacacggtggccgtgcgggaggccggtgccctgggccctgcccgagagactgagctgccggcagcggctgagccgggcgcggagaacgcgctcacgctgcagggcctgaagcccgacacggcctatgacctccaagtgcgagcccacacgcgccggggccctggccccttcagcccccccgtccgctaccggacgttcctgcgggaccaagtctcgcccaagaacttcaaggtgaaaatgatcatgaagacatcagttctgctcagctgggagttccctgacaactacaactcacccacaccctacaagatccagtacaatgggctcacactggatgtggatggccgtaccaccaagaagctcatcacgcacctcaagccccacaccttctacaactttgtgctgaccaatcgcggcagcagcctgggcggcctccagcagacggtcaccgcctggactgccttcaacctgctcaacggcaagcccagcgtcgcccccaagcctgatgctgacggcttcatcatggtgtatcttcctgacggccagagccccgtgcctgtccagagctatttcattgtgatggtgccactgcgcaagtctcgtggaggccaattcctgaccccgctgggtagcccagaggacatggatctggaagagctcatccaggacatctcacggctacagaggcgcagcctgcggcactcgcgtcagctggaggtgccccggccctatattgcagctcgcttctctgtgctgccacccacgttccatcccggcgaccagaagcagtatggcggcttcgataaccggggcctggagcccggccaccgctatgtcctcttcgtgcttgccgtgcttcagaagagcgagcctacctttgcagccagtcccttctcagaccccttccagctggataacccggacccccagcccatcgtggatggcgaggaggggcttatctgggtgatcgggcctgtgctggccgtggtcttcataatctgcattgtcattgctatcctgctctacaagaacaaacccgacagtaaacgcaaggactcagaaccccgcaccaaatgcctcctgaacaatgccgacctcgcccctcaccaccccaaggaccctgtggaaatgagacgcattaacttccagactccaggcatgcttagccacccgccaattcccatcgcagacatggcggagcacacggagcggctcaaggccaacgacagcctcaagctctcccaggagtatgagtccatcgaccctggacagcagttcacatgggaacattccaacctggaagtgaacaagccgaagaaccgctatgccaacgtcatcgcctatgaccactcccgtgtcatcctccagcccattgaaggcatcatgggcagtgattacatcaatgccaactacgtggacggctaccggtgtcagaacgcgtacattgccacgcaggggccgctgcctgagacctttggggacttctggcgtatggtgtgggagcagcggtcggcgaccatcgtcatgatgacgcggctggaggagaagtcacggatcaagtgtgatcagtattggcccaacagaggcacggagacctacggcttcatccaggtcacgttgctagataccatcgagctggccacattctgcgtcaggacattctctctgcacaagaatggctccagtgagaaacgcgaggtccgccagttccagtttacggcgtggccggaccatggcgtgcccgaatacccaacgcccttcctggctttcctgcggagagtcaagacctgcaacccgccagatgccggccccatcgtggttcactgcagtgccggtgtgggccgcacaggctgctttatcgtcatcgacgccatgcttgagcggatcaagccagagaagacagtcgatgtctatggccacgtgacgctcatgaggtcccagcgcaactacatggtgcagacggaggaccagtacagcttcatccacgaggccctgctggaggccgtgggctgtggcaacacagaagtgcccgcacgcagcctctatgcctacatccagaagctggcccaggtggagcctggcgaacacgtcactggcatggaactcgagttcaagcggctggctaactccaaggcccacacgtcacgcttcatcagtgccaatctgccttgtaacaagttcaagaaccgcctggtgaacatcatgccctatgagagcacacgggtctgtctgcaacccatccggggtgtggagggctctgactacatcaacgccagcttcattgatggctacaggcagcagaaggcctacatcgcgacacaggggccgctggcggagaccacggaagacttctggcgcatgctgtgggagaacaattcgacgatcgtggtgatgctgaccaagctgcgggagatgggccgggagaagtgtcaccagtactggccggccgagcgctctgcccgctaccagtactttgtggtagatccgatggcagaatacaacatgcctcagtatatcctgcgagagttcaaggtcacagatgcccgggatggccagtcccggactgtccggcagttccagttcacagactggccggaacagggtgtgccaaagtcgggggagggcttcatcgacttcattggccaagtgcataagactaaggagcagtttggccaggacggccccatctctgtccactgcagtgccggcgtgggcaggacgggcgtcttcatcacgcttagcatcgtgctggagcggatgcggtatgaaggcgtggtggacatctttcagacggtgaagatgctacgaacccagcggccggccatggtgcagacagaggatgagtaccagttctgttaccaggcggcactggagtacctcggaagctttgaccactatgcaacctaaagccatggttccccccaggcccgacaccactggccccggatgcctctgcccctcccgggcggacctcctgaggcctggacccccagtgggcagggcaggaggtggcagcggcagcagctgtgtttctgcaccatttccgaggacgacgcagcccctcgagcccccccaccggccccggccgccccagcgacctccctggcaccggccgccgccttcaaatacttggcacattcctcc

SEQ ID NO: 171919 - DNA, 4766 bp, Homo sapiens
  Payload ID: 13776
  Gene Symbol: PTPRS
  Gene Name: protein tyrosine phosphatase, receptor type, S
  Uniprot ID: Q13332
  ENST ID: ENST00000592099
  CDS Start-End: 24-4529
gagatcggaggtcgctgccaagcatggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgagaggaccagctgccctctggcttccccaacatcgacatgggcccacagttgaaggtggtggagcggacacggacagccaccatgctctgtgcagccagcggcaaccctgaccctgagatcacctggttcaaggacttcctgcctgtggatcctagtgccagcaatggacgcatcaaacagctgcgatcaggagccctgcagattgaaagcagtgaggaaaccgaccagggcaaatatgagtgtgtggccaccaacagcgccggcgtgcgctactcctcacctgccaacctctacgtgcgagtccgccgcgtggccccgcgcttctccatcctgcccatgagccacgagatcatgccagggggcaacgtgaacatcacctgcgtggccgtgggctcgcccatgccatacgtgaagtggatgcagggggccgaggacctgacccccgaggatgacatgcccgtgggtcggaacgtgctggaactcacagatgtcaaggactcggccaactacacctgcgtggccatgtccagcctgggcgtcattgaggcggttgctcagatcacggtgaaatctctccccaaagctcccgggactcccatggtgactgagaacacagccaccagcatcaccatcacgtgggactcgggcaacccagatcctgtgtcctattacgtcatcgaatataaatccaagagccaagacgggccgtatcagattaaagaggacatcaccaccacacgttacagcatcggcggcctgagccccaactcggagtacgagatctgggtgtcggccgtcaactccatcggccaggggccccccagcgagtccgtggtcacccgcacaggcgagcaggccccggccagcgcgccgcggaacgtgcaagcccggatgctcagcgcgaccaccatgattgtgcagtgggaggagccggtggagcccaacggcctgatccgcggctaccgcgtctactacaccatggaaccggagcaccccgtgggcaactggcagaagcacaacgtggacgacagcctgctgaccaccgtgggcagcctgctggaggacgagacctacaccgtgcgggtgctcgccttcacctccgtcggcgacgggcccctctcggaccccatccaggtcaagacgcagcagggagtgccgggccagcccatgaacctgcgggccgaggccaggtcggagaccagcatcacgctgtcctggagccccccgcggcaggagagtatcatcaagtacgagctcctcttccgggaaggcgaccatggccgggaggtgggaaggaccttcgacccgacgacttcctacgtggtggaggacctgaagcccaacacggagtacgccttccgcctggcggcccgctcgccgcagggcctgggcgccttcacccccgtggtgcggcagcgcacgctgcagtccatctcgcccaagaacttcaaggtgaaaatgatcatgaagacatcagttctgctcagctgggagttccctgacaactacaactcacccacaccctacaagatccagtacaatgggctcacactggatgtggatggccgtaccaccaagaagctcatcacgcacctcaagccccacaccttctacaactttgtgctgaccaatcgcggcagcagcctgggcggcctccagcagacggtcaccgcctggactgccttcaacctgctcaacggcaagcccagcgtcgcccccaagcctgatgctgacggcttcatcatggtgtatcttcctgacggccagagccccgtgcctgtccagagctatttcattgtgatggtgccactgcgcaagtctcgtggaggccaattcctgaccccgctgggtagcccagaggacatggatctggaagagctcatccaggacatctcacggctacagaggcgcagcctgcggcactcgcgtcagctggaggtgccccggccctatattgcagctcgcttctctgtgctgccacccacgttccatcccggcgaccagaagcagtatggcggcttcgataaccggggcctggagcccggccaccgctatgtcctcttcgtgcttgccgtgcttcagaagagcgagcctacctttgcagccagtcccttctcagaccccttccagctggataacccggacccccagcccatcgtggatggcgaggaggggcttatctgggtgatcgggcctgtgctggccgtggtcttcataatctgcattgtcattgctatcctgctctacaagaacaaacccgacagtaaacgcaaggactcagaaccccgcaccaaatgcctcctgaacaatgccgacctcgcccctcaccaccccaaggaccctgtggaaatgagacgcattaacttccagactccaggcatgcttagccacccgccaattcccatcgcagacatggcggagcacacggagcggctcaaggccaacgacagcctcaagctctcccaggagtatgagtccatcgaccctggacagcagttcacatgggaacattccaacctggaagtgaacaagccgaagaaccgctatgccaacgtcatcgcctatgaccactcccgtgtcatcctccagcccattgaaggcatcatgggcagtgattacatcaatgccaactacgtggacggctaccggtgtcagaacgcgtacattgccacgcaggggccgctgcctgagacctttggggacttctggcgtatggtgtgggagcagcggtcggcgaccatcgtcatgatgacgcggctggaggagaagtcacggatcaagtgtgatcagtattggcccaacagaggcacggagacctacggcttcatccaggtcacgttgctagataccatcgagctggccacattctgcgtcaggacattctctctgcacaagaatggctccagtgagaaacgcgaggtccgccagttccagtttacggcgtggccggaccatggcgtgcccgaatacccaacgcccttcctggctttcctgcggagagtcaagacctgcaacccgccagatgccggccccatcgtggttcactgcagtgccggtgtgggccgcacaggctgctttatcgtcatcgacgccatgcttgagcggatcaagccagagaagacagtcgatgtctatggccacgtgacgctcatgaggtcccagcgcaactacatggtgcagacggaggaccagtacagcttcatccacgaggccctgctggaggccgtgggctgtggcaacacagaagtgcccgcacgcagcctctatgcctacatccagaagctggcccaggtggagcctggcgaacacgtcactggcatggaactcgagttcaagcggctggctaactccaaggcccacacgtcacgcttcatcagtgccaatctgccttgtaacaagttcaagaaccgcctggtgaacatcatgccctatgagagcacacgggtctgtctgcaacccatccggggtgtggagggctctgactacatcaacgccagcttcattgatggctacaggcagcagaaggcctacatcgcgacacaggggccgctggcggagaccacggaagacttctggcgcatgctgtgggagaacaattcgacgatcgtggtgatgctgaccaagctgcgggagatgggccgggagaagtgtcaccagtactggccggccgagcgctctgcccgctaccagtactttgtggtagatccgatggcagaatacaacatgcctcagtatatcctgcgagagttcaaggtcacagatgcccgggatggccagtcccggactgtccggcagttccagttcacagactggccggaacagggtgtgccaaagtcgggggagggcttcatcgacttcattggccaagtgcataagactaaggagcagtttggccaggacggccccatctctgtccactgcagtgccggcgtgggcaggacgggcgtcttcatcacgcttagcatcgtgctggagcggatgcggtatgaaggcgtggtggacatctttcagacggtgaagatgctacgaacccagcggccggccatggtgcagacagaggatgagtaccagttctgttaccaggcggcactggagtacctcggaagctttgaccactatgcaacctaaagccatggttccccccaggcccgacaccactggccccggatgcctctgcccctcccgggcggacctcctgaggcctggacccccagtgggcagggcaggaggtggcagcggcagcagctgtgtttctgcaccatttccgaggacgacgcagcccctcgagcccccccaccggccccggccgccccagcgacctccctggcaccggccgccgccttcaaatacttggcacattcctcc

SEQ ID NO: 171920 - DNA, 6353 bp, Homo sapiens
  Payload ID: 13776
  Gene Symbol: PTPRS
  Gene Name: protein tyrosine phosphatase, receptor type, S
  Uniprot ID: Q13332
  ENST ID: ENST00000587303
  CDS Start-End: 101-5947
ctgcagacgttgccccatctgacgctcggctcgaggcctctctgtgagggaccggggggccatccccctccagggcggagatcggaggtcgctgccaagcatggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgagaggaccagctgccctctggcttccccaacatcgacatgggcccacagttgaaggtggtggagcggacacggacagccaccatgctctgtgcagccagcggcaaccctgaccctgagatcacctggttcaaggacttcctgcctgtggatcctagtgccagcaatggacgcatcaaacagctgcgatcagaaacctttgaaagcactccgattcgaggagccctgcagattgaaagcagtgaggaaaccgaccagggcaaatatgagtgtgtggccaccaacagcgccggcgtgcgctactcctcacctgccaacctctacgtgcgagagcttcgagaagtccgccgcgtggccccgcgcttctccatcctgcccatgagccacgagatcatgccagggggcaacgtgaacatcacctgcgtggccgtgggctcgcccatgccatacgtgaagtggatgcagggggccgaggacctgacccccgaggatgacatgcccgtgggtcggaacgtgctggaactcacagatgtcaaggactcggccaactacacctgcgtggccatgtccagcctgggcgtcattgaggcggttgctcagatcacggtgaaatctctccccaaagctcccgggactcccatggtgactgagaacacagccaccagcatcaccatcacgtgggactcgggcaacccagatcctgtgtcctattacgtcatcgaatataaatccaagagccaagacgggccgtatcagattaaagaggacatcaccaccacacgttacagcatcggcggcctgagccccaactcggagtacgagatctgggtgtcggccgtcaactccatcggccaggggccccccagcgagtccgtggtcacccgcacaggcgagcaggccccggccagcgcgccgcggaacgtgcaagcccggatgctcagcgcgaccaccatgattgtgcagtgggaggagccggtggagcccaacggcctgatccgcggctaccgcgtctactacaccatggaaccggagcaccccgtgggcaactggcagaagcacaacgtggacgacagcctgctgaccaccgtgggcagcctgctggaggacgagacctacaccgtgcgggtgctcgccttcacctccgtcggcgacgggcccctctcggaccccatccaggtcaagacgcagcagggagtgccgggccagcccatgaacctgcgggccgaggccaggtcggagaccagcatcacgctgtcctggagccccccgcggcaggagagtatcatcaagtacgagctcctcttccgggaaggcgaccatggccgggaggtgggaaggaccttcgacccgacgacttcctacgtggtggaggacctgaagcccaacacggagtacgccttccgcctggcggcccgctcgccgcagggcctgggcgccttcacccccgtggtgcggcagcgcacgctgcagtccaaaccgtcagccccccctcaagacgttaaatgtgtcagcgtgcgctccacggccattttggtaagttggcgcccgccgccgccggaaacgcacaacggggccctggtgggctacagcgtccgctaccgaccgctgggctcagaggacccggaacccaaggaggtgaacggcatccccccgaccaccactcagatcctgctggaggccttggagaagtggacccagtaccgcatcacgactgtcgctcacacagaggtgggaccagggcccgagagctcgcccgtggtcgtccgcaccgacgaggatgtgcccagcgcgccgccgcggaaggtggaggcggaggcgctcaacgccacggccatccgcgtgctgtggcgctcgcccgcgcccggccggcagcacggccagatccgcggctaccaggtccactacgtgcgcatggagggcgccgaggcccgcgggccgccgcgcatcaaggacgtcatgctggccgatgcccagtgggagacggatgacacggccgaatatgagatggtcatcacaaacttgcagcctgagaccgcgtactccatcacggtagccgcctacaccatgaagggcgatggcgctcgcagcaaacccaaggtggttgtgaccaagggagcagtgctgggccgcccaaccctgtcggtgcagcagacccccgagggcagcctgctggcacgctgggagcccccggctggcaccgcggaggaccaggtgctgggctaccgcctgcagtttggccgtgaggactcgacgcccctggccaccctggagttcccgccctccgaggaccgctacacggcatcaggcgtgcacaagggggccacgtatgtgttccggcttgcggcccggagccgcggcggcctgggcgaggaggcagccgaggtcctgagcatcccggaggacacgccccgtggccacccgcagattctggaggcggccggcaacgcctcggccgggaccgtccttctccgctggctgccacccgtgcccgccgagcgcaacggggccatcgtcaaatacacggtggccgtgcgggaggccggtgccctgggccctgcccgagagactgagctgccggcagcggctgagccgggcgcggagaacgcgctcacgctgcagggcctgaagcccgacacggcctatgacctccaagtgcgagcccacacgcgccggggccctggccccttcagcccccccgtccgctaccggacgttcctgcgggaccaagtctcgcccaagaacttcaaggtgaaaatgatcatgaagacatcagttctgctcagctgggagttccctgacaactacaactcacccacaccctacaagatccagtacaatgggctcacactggatgtggatggccgtaccaccaagaagctcatcacgcacctcaagccccacaccttctacaactttgtgctgaccaatcgcggcagcagcctgggcggcctccagcagacggtcaccgcctggactgccttcaacctgctcaacggcaagcccagcgtcgcccccaagcctgatgctgacggcttcatcatggtgtatcttcctgacggccagagccccgtgcctgtccagagctatttcattgtgatggtgccactgcgcaagtctcgtggaggccaattcctgaccccgctgggtagcccagaggacatggatctggaagagctcatccaggacatctcacggctacagaggcgcagcctgcggcactcgcgtcagctggaggtgccccggccctatattgcagctcgcttctctgtgctgccacccacgttccatcccggcgaccagaagcagtatggcggcttcgataaccggggcctggagcccggccaccgctatgtcctcttcgtgcttgccgtgcttcagaagagcgagcctacctttgcagccagtcccttctcagaccccttccagctggataacccggacccccagcccatcgtggatggcgaggaggggcttatctgggtgatcgggcctgtgctggccgtggtcttcataatctgcattgtcattgctatcctgctctacaagaacaaacccgacagtaaacgcaaggactcagaaccccgcaccaaatgcctcctgaacaatgccgacctcgcccctcaccaccccaaggaccctgtggaaatgagacgcattaacttccagactccagattcaggcctcaggagccccctcagggagccggggtttcactttgaaagcatgcttagccacccgccaattcccatcgcagacatggcggagcacacggagcggctcaaggccaacgacagcctcaagctctcccaggagtatgagtccatcgaccctggacagcagttcacatgggaacattccaacctggaagtgaacaagccgaagaaccgctatgccaacgtcatcgcctatgaccactcccgtgtcatcctccagcccattgaaggcatcatgggcagtgattacatcaatgccaactacgtggacggctaccggtgtcagaacgcgtacattgccacgcaggggccgctgcctgagacctttggggacttctggcgtatggtgtgggagcagcggtcggcgaccatcgtcatgatgacgcggctggaggagaagtcacggatcaagtgtgatcagtattggcccaacagaggcacggagacctacggcttcatccaggtcacgttgctagataccatcgagctggccacattctgcgtcaggacattctctctgcacaagaatggctccagtgagaaacgcgaggtccgccagttccagtttacggcgtggccggaccatggcgtgcccgaatacccaacgcccttcctggctttcctgcggagagtcaagacctgcaacccgccagatgccggccccatcgtggttcactgcagtgccggtgtgggccgcacaggctgctttatcgtcatcgacgccatgcttgagcggatcaagccagagaagacagtcgatgtctatggccacgtgacgctcatgaggtcccagcgcaactacatggtgcagacggaggaccagtacagcttcatccacgaggccctgctggaggccgtgggctgtggcaacacagaagtgcccgcacgcagcctctatgcctacatccagaagctggcccaggtggagcctggcgaacacgtcactggcatggaactcgagttcaagcggctggctaactccaaggcccacacgtcacgcttcatcagtgccaatctgccttgtaacaagttcaagaaccgcctggtgaacatcatgccctatgagagcacacgggtctgtctgcaacccatccggggtgtggagggctctgactacatcaacgccagcttcattgatggctacaggcagcagaaggcctacatcgcgacacaggggccgctggcggagaccacggaagacttctggcgcatgctgtgggagaacaattcgacgatcgtggtgatgctgaccaagctgcgggagatgggccgggagaagtgtcaccagtactggccggccgagcgctctgcccgctaccagtactttgtggtagatccgatggcagaatacaacatgcctcagtatatcctgcgagagttcaaggtcacagatgcccgggatggccagtcccggactgtccggcagttccagttcacagactggccggaacagggtgtgccaaagtcgggggagggcttcatcgacttcattggccaagtgcataagactaaggagcagtttggccaggacggccccatctctgtccactgcagtgccggcgtgggcaggacgggcgtcttcatcacgcttagcatcgtgctggagcggatgcggtatgaaggcgtggtggacatctttcagacggtgaagatgctacgaacccagcggccggccatggtgcagacagaggatgagtaccagttctgttaccaggcggcactggagtacctcggaagctttgaccactatgcaacctaaagccatggttccccccaggcccgacaccactggccccggatgcctctgcccctcccgggcggacctcctgaggcctggacccccagtgggcagggcaggaggtggcagcggcagcagctgtgtttctgcaccatttccgaggacgacgcagcccctcgagcccccccaccggccccggccgccccagcgacctccctggcaccggccgccgccttcaaatacttggcacattcctcctttccttccaattccaaaaccagattccggggtggggggtggggggatggtgagcaaataggagtgctccccagaaccagaggagggtggggcacagaccatagacggacccctcgtcctcccccagcggtggtagggggacccggggggctcctccccgctctgcagc

SEQ ID NO: 171921 - DNA, 388 bp, Homo sapiens
  Payload ID: 13776
  Gene Symbol: PTPRS
  Gene Name: protein tyrosine phosphatase, receptor type, S
  ENST ID: ENST00000586065
  CDS Start-End: 152-388
ctgtgactggggacttcgcagaaggcggaggaggcaacaggaccgcagagggggcagacgttgccccatctgacgctcggctcgaggcctctctgtgagggaccggggggccatccccctccagggcggagatcggaggtcgctgccaagcatggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgag

SEQ ID NO: 171922 - DNA, 478 bp, Homo sapiens
  Payload ID: 13776
  Gene Symbol: PTPRS
  Gene Name: protein tyrosine phosphatase, receptor type, S
  ENST ID: ENST00000591760
  CDS Start-End: 207-478
cccgagtcttcgctgcgcgccgcgctccgggcggaccgagggacgcggggagcggctgcggcgggccctgtggaggcctcgcggggcctgggcccgatctccgagccgcgggacgttgccccatctgacgctcggctcgaggcctctctgtgagggaccggggggccatccccctccagggcggagatcggaggtcgctgccaagcatggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgagacgattgagtttgatgagagtgcaggggcagtgct

SEQ ID NO: 171923 - DNA, 12480 bp, Homo sapiens
  Payload ID: 13777
  Gene Symbol: PTPRT
  Gene Name: protein tyrosine phosphatase, receptor type, T
  ENST ID: ENST00000356100
  CDS Start-End: 1-4353
atggcgagcctcgccgcgctcgccctcagcctgctcctgaggctgcagctgccgccactgcccggcgcccgggctcagagcgccgcaggtggctgttcctttgatgagcactacagcaactgtggttatagtgtggctctagggaccaatgggttcacctgggagcagattaacacatgggagaaaccaatgctggaccaggcagtgcccacaggatctttcatgatggtgaacagctctgggagagcctctggccagaaggcccaccttctcctgccaaccctgaaggagaatgacacccactgcatcgacttccattactacttctccagccgtgacaggtccagcccaggggccttgaacgtctacgtgaaggtgaatggtggcccccaagggaaccctgtgtggaatgtgtccggggtcgtcactgagggctgggtgaaggcagagctcgccatcagcactttctggccacatttctatcaggtgatatttgaatccgtctcattgaagggtcatcctggctacatcgccgtggacgaggtccgggtccttgctcatccatgcagaaaagcacctcattttctgcgactccaaaacgtggaggtgaatgtggggcagaatgccacatttcagtgcattgctggtgggaagtggtctcagcatgacaagctttggctccagcaatggaatggcagggacacggccctgatggtcacccgtgtggtcaaccacaggcgcttctcagccacagtcagtgtggcagacactgcccagcggagcgtcagcaagtaccgctgtgtgatccgctctgatggtgggtctggtgtgtccaactacgcggagctgatcgtgaaagagcctcccacgcccattgctcccccagagctgctggctgtgggggccacatacctgtggatcaagccaaatgccaactccatcatcggggatggccccatcatcctgaaggaagtggaatatcgcaccaccacaggcacgtgggcagagacccacatagtcgactctcccaactataagctgtggcatctggaccccgatgttgagtatgagatccgagtgctcctcacacgaccaggtgaggggggtacgggaccgccagggcctcccctcaccaccaggaccaagtgtgcagatccggtacatggcccacagaacgtggaaatcgtagacatcagagcccggcagctgaccctgcagtgggagcccttcggctacgcggtgacccgctgccatagctacaacctcaccgtgcagtaccagtatgtgttcaaccagcagcagtacgaggccgaggaggtcatccagacctcctcccactacaccctgcgaggcctgcgccccttcatgaccatccggctgcgactcttgctgtctaaccccgagggccgaatggagagcgaggagctggtggtgcagactgaggaagacgttccaggagctgttcctctagaatccatccaaggggggccctttgaggagaagatctacatccagtggaaacctcccaatgagaccaatggggtcatcacgctctacgagatcaactacaaggctgtcggctcgctggacccaagtgctgacctctcgagccagagggggaaagtgttcaagctccggaatgaaacccaccacctctttgtgggtctgtacccagggaccacctattccttcaccatcaaggccagcacagcaaagggctttgggccccctgtcaccactcggattgccaccaaaatttcagctccatccatgcctgagtacgacacagacaccccattgaatgagacagacacgaccatcacagtgatgctgaaacccgctcagtcccggggagctcctgtcagtgtttatcagctggttgtcaaggaggagcgacttcagaagtcacggagggcagctgacattattgagtgcttttcggtgcccgtgagctatcggaatgcctccagcctcgattctctacactactttgctgctgagttgaagcctgccaacctgcctgtcacccagccatttacagtgggtgacaataagacatacaatggctactggaaccctcctctctctcccctgaaaagctacagcatctacttccaggcactcagcaaagccaatggagagaccaaaatcaactgtgttcgtctggctacaaaagcaccaatgggcagcgcccaggtgaccccggggactccactctgcctcctcaccacaggtgcctccacccagaattctaacactgtggagccagagaagcaggtggacaacaccgtgaagatggctggcgtgatcgctggcctcctcatgttcatcatcattctcctgggcgtgatgctcaccatcaaaaggaggaagctggccaagaagcagaaggagacccagagtggagcccagagggagatggggcctgtggcctctgccgacaaacccaccaccaagctcagcgccagccgcaatgatgaaggcttctcttctagttctcaggacgtcaacggattcacagatggcagccgcggggagctttcccagcccaccctcacgatccagactcatccctaccgcacctgtgaccctgtggagatgagctacccccgggaccagttccaacccgccatccgggtggctgacttgctgcagcacatcacgcagatgaagagaggccagggctacgggttcaaggaggaatacgaggccttaccagaggggcagacagcttcgtgggacacagccaaggaggatgaaaaccgcaataagaatcgatatgggaacatcatatcctacgaccattcccgggtgaggctgctggtgctggatggagacccgcactctgactacatcaatgccaactacattgacggataccatcgacctcggcactacattgcgactcaaggtccgatgcaggagactgtaaaggacttttggagaatgatctggcaggagaactccgccagcatcgtcatggtcacaaacctggtggaagtgggcagggtgaaatgtgtgcgatactggccagatgacacggaggtctacggagacattaaagtcaccctgattgaaacagagcccctggcagaatacgtcatacgcaccttcacagtccagaagaaaggctaccatgagatccgggagctccgcctcttccacttcaccagctggcctgaccacggcgttccctgctatgccactggccttctgggcttcgtccgccaggtcaagttcctcaaccccccggaagctgggcccatagtggtccactgcagtgctggggctgggcggactggctgcttcattgccattgacaccatgcttgacatggccgagaatgaaggggtggtggacatcttcaactgcgtgcgtgagctccgggcccaaagggtcaacctggtacagacagaggagcaatatgtgtttgtgcacgatgccatcctggaagcgtgcctctgtggcaacactgccatccctgtgtgtgagttccgttctctctactacaatatcagcaggctggacccccagacaaactccagccaaatcaaagatgaatttcagaccctcaacattgtgacaccccgtgtgcggcccgaggactgcagcattgggctcctgccccggaaccatgataagaatcgaagtatggacgtgctgcctctggaccgctgcctgcccttccttatctcagtggacggagaatccagcaattacatcaacgcagcactgatggatagccacaagcagcctgccgccttcgtggtcacccagcaccctctacccaacaccgtggcagacttctggaggctggtgttcgattacaactgctcctctgtggtgatgctgaatgagatggacactgcccagttctgtatgcagtactggcctgagaagacctccgggtgctatgggcccatccaggtggagttcgtctccgcagacatcgacgaggacatcatccacagaatattccgcatctgtaacatggcccggccacaggatggttatcgtatagtccagcacctccagtacattggctggcctgcctaccgggacacgcccccctccaagcgctctctgctcaaagtggtccgacgactggagaagtggcaggagcagtatgacgggagggagggacgtactgtggtccactgcctaaatgggggaggccgtagtggaaccttctgtgccatctgcagtgtgtgtgagatgatccagcagcaaaacatcattgacgtgttccacatcgtgaaaacactgcgtaacaacaaatccaacatggtggagaccctggaacagtataaatttgtatacgaggtggcactggaatatttaagctccttttagctcaatgggatggggaacctgccggagtccagaggctgctgtgaccaagcccccttttgtgtgaatggcagtaactgggctcaggagctctgaggtggcaccctgcctgactccaaggagaagactggtggccctgtgttccacggggggctctgcaccttctgaggggtctcctgttgccgtgggagatgctgctccaaaaggcccaggcttccttttcaacctaaccagccacagccaagggcccaagcagaagtacacccacaagcaaggccttggatttctggctcccagaccacctgcttttgttctgagtttgtggatctcttggcaagccaactgtgcaggtgctggggagtgggaggctcccctgccctccttctccttaggagtggaggagatgtgtgttctgctcctctacgtcatggaaaagattgaggctcttgggggtcactgctctgctgccccctgcaacctccttcaggggcctctggcaccagacatttgcagtctggaccagtgtgaccttacgatgttccctaggccacaagagaggccccccatcctcacacctaacctgcatggggcttcgcccacaaccattctgtaccccttccccagcctgggccttgaccgtccagcattcactggccggccagctgtgtccacagcagtttttgataaaggtgttctttgcttttttgtgtggtcagtgggagggggtggaactgcagggaacttctctgctcctccttgtctttgtaaaaagggaccacctccctggggcagggcttgggctgacctgtaggatgtaacccctgtgtttctttggtggtagctttctttggaagagacaaacaagataagatttgattattttccaaagtgtatgtgaaaagaaactttcttttggagggtgtaaaatcttagtctcttatgtcaaaaagaagggggcgggggagtttgagtatgtacctctaagacaaatctctcgggccttttattttttcctggcaatgtccttaaaagctcccaccctgggacagcatgccactgagcaaggagagatgggtgagcctgaagatggtccctttggtttctggggcaaatagagcaccagctttgtgcataatttggatgtccaaatttgaactccttcctaaagaaacccagcagccaccttgaaaaaggccattgtggagcccattatactttgatttaaaataggccaagagaatcaggcctggagatctagggtcttgtccaaagtgtgagtgagtcaatgagagggaaccaacatttgctaagtctctactgtatgccagggatcatgcttggcactttccataggacatttcacacagtccttagaacccccaggagagagctactgacttgttatcatctccatttgatcatctcctccaatgaggaaacccacgcaccttccttagtaatgaaatcctgggttccaaaggggcaggtaatggcaatgagacttctccgtgctgttttcttcatcttctctaagccaagcaattattttatggagggaaaataaggccagaaacttctgagcagataactccacaaatggaaatttagtactttcttcctgatgccagttcttctgggaagcgcagaatttcagatatattttagtaacacattcccagctccccaggaaagccagtctcatctaatttcttagtcagtaaaaacaattccctgttccttcaggctatgaatggaccagccagggaaactctcgaccttgatctctagccagtgcttaggcccaatatctgacagcctcaggtgggctgggacctaggaagctccatcttgaaggctggtctagccccagacagggcatgaggggcagagaattcaagaaggtacagctttggccctcaagagcccactgtatgctggggaaatggaaccatggtgcagtagtgtggagtggatgagtgttccatgagcctaggagcaagaaagtctcttcggcctcgggcttcctggagaaggggacgtccattcctgctgggtcttaacaagcataaaaaggaaaaaaaggaaactcaggcaaagggatccatatgtgcaatggcaaagaaatgtgaaaaggcattgggagaagcagtctgggggaggccagcccagtgcgggcacagcacaacacggggagcagcaagagatgagccagggtccaggagacagatgcccatcgcgagtacagactttgtcctattggcaacaaggagtccatggagctttagagagatgcactcagcttcgtgttggccaagactccttctgggccaatggggctgcctcttttcctttcatcagacactgtgaaaacattcccttaagcgtgcactttttaatatcacatctatttgtctgtctgctcattgttttgttgctggaactaaatatgcaatggatcatgagactcagattctatgagaaacccagggtctctgctttaccacggagcagggtcaccaacccagatctccaggcccatgaggatggaacatgaaaggagccgacaaaagttgcttccattggcatgggctctggagctgtccagaagtccagggacaccagacttgatcaaggaagggctgtcactttagaggttcaaaaggaagtgcctcaaagcaaaggcaagcaaaggaaccccacgatgaacttgctcttttcctttgatgagcctctccccaggtgtatttcagcagaccccggggacccacccccactgggcctgctggcctccctcggctccagcccaatgccccagctggccttccccagcctgcaaggagcctgtagcatggcaaatctgcctgctgtatgctattttcttagatcttggtacatccagacaggatgagggtggagggagagctatttaacacaaatcctaagatttttttctgctcaggaaggggtgaaatagctggcagatacaaaagacagtggcttttatcattttaaatggtaggaatttaaggtgtgacttcagggagaaacaaacttgcaaaaaaaaaaaatctcaggccatgttggggtaacccagcaagggccagtgatgatttcccccagctcatccccttattttcccacaacccaaccattctctaaagcaggacagtgaataggtcttaggccagtgcacacaggaagaaattgaggcttatggatggggatgacttccctaagatcccatgggacaaggatgtggcaaggcttggatgagatggggcaccagtgcccaggaatttgaacattttcctttacccaggaaatctccggagccaacaccaccacccccagggggtctccccaccccaccccatttacagggtgagctcagcctgtcatgagcagaggaaaatattattaatgctctctgagtctttacaacaggagctcttacctcatagatgtgggctctgtttggggaagatgcaaggaagtaatgagaagcccaggaaatttctccacctgtgtttatggcctaaatagcttcaggatgtatcttagctgcactccaacattgcatcctttctggggtgaagaatctgggccaaccaggggtccttgggcctctagaaggccacagtaggcctctctttgtgggaatggaaggggacagtttgcttttagtgctggccctctctgtgggtgtggcctgcaaaggaaccaacagaccctatgctggggactctaacatgtgagctcattaaattcttccagcattctaaaggagggtttgtgattgtcaccatttactgatgaggaaactaaggctcctaggggagaaatcacttgcccacagttccacagctagtgagtgaatgaaccaggatttaaaccggttttttctcactacagagacaatatttttccaccattgtatctcacatttttcccaggaggttacccataacagaagagactagagtggaacagatacgtcagtggataaagctcaaagcaaacaacagtaagcttaaaattccttcatagtctcatgttttacgttcacaattcatgcaaaatttgcattccactttctgatttagccttgttggttttaatatgactctatgaatatttcaaaaaaaaatgtgctctgttcctcatgttgttctgttctgttcaccccgctatgacggaccctaggtcagctggtcttcagcttgaccctagaattgactctaggagcagtgaccctgctgcctcccagagccagttataggctcaagatcaagaccaactgaccttctcctaggcagctcctttggtgtgtgggtgctctgacctcactgttcatgaggggacctcaactaaggcatcttccagttgggtgctggaaggaacccattaactcacactagaatgatgaggatttgctcatctggcgtggagaaggatgagcccacaaaaccctaaagggaaaagagaagctggacacagctgtactcagcagattcctgaatgctaggctggaaagtggtgcctgttgtccaagtggagtcacatggttgctaatgtgggcaagtctgaggacacacttcatgagcagctggggtctggaaggctcctcactttaccctagccacacataattactgggtgcctacagcacctagcaccttggagggggcactattaggaaatcgagattactatggcacaattaattcctgggtaaggcatggggttgtggtggacagagctcagtctttagtttgaacgaaaacatacatacatgaaaaacatacatgaaaaaaggaccctcatcaacattagaaggggtagatttggagcactttaggcaggaaaacaggaacgcaaggccaggaaactggaacccagtgaatactcagaaccgaggatgcagatgacttatttagcaaaatggtcacttctgtgacatagctggagaaaggatgggtaacagcttgccagagccacttggaacaagggcaaatctcagtgtctggggcaaaagatgatgcatttccctctgacccatcatgtttattcatcctccactccccattgccacactagctcttgctgtaagtcctcaccaggatctacatttcctcgtcgctggtgggaaccccttagagtacatagaggtatcagtccagtaagactgctctacacaacagaagtgaggcccagggagtagcagccaggcccttatcctgttacctctgcaggagtgactgcccaacccagatccagagacattgaaggaaatgataattccttggtacctcactgccttgggacaaaatgaagaaagccacccttccttaggctgcagcttgccactcctgggctgggtaaacaggtcatcagcaccaagctcaaccaggagtaacactctggaagacatgggtgagcccaagaggaagcatgaacaggacgctgttcctaagtcatgtcaacaggttgtgctgggccaggatccccagggaaaaaaatggtcaacccaactggagggtaggttagaagaaaaaaaacataaacgtggatagtcatgtcatctcaaatccctgacttggcttccccattacttaacagtctgagctccttcttagcctgtgaccagcttcaaatcacagccaagtaaaacaaggaaataggaaaagtaaatccaactagaagagacaagctgagattcagatttgtttactcctcccatgcaaagtttccctgttggaggttttccatgtatacatgtctagaagtgatagaatgcaaggccttggctttgtcttgcagggatctgcctttgaggtcatagactgaacagcagggagagaggttagtggtggagtgtggggggagctgttctagctccagtttcttctgacacatttttcaggatcatggatctgatcctccgaagcacagcagagatatctaagccatatttgtgcacatgagcagactcttctagttttttagtaaccagggatgggcttttgcatggcactgactatagagatgtcttgtagagatcaagccagtcttttgcatcccacctgcccacctccagaagagatgggaaaaggtcatcaaagggcattcaccaactgaaatccactcatgaatgttaggtctctaaaaggaggcatcaacactcacaatggtagcctccaaacctagcatcccacctatctaagagctcaggggtggtccactggggcagatacaagggaagtgcaagggctcaggatgaaagaaaatctattgggaagagttttaggggcttgatcattatggggcttccttctatatctgagaactgctctgggtggtgagatgtggactctgatccttaattggaatgttcggagaatgagtgtctggtggccttgaagtgttggacagaaaagtatcagtataaaagcctggagctcagggtaattaatgtagttcatggttccttagtgagcaggactcttggatgtggaggagaaagggtcataggaagtaaaccaccaaaattacaaaattgagtctctgtacaattacttcagtgcctttgggcttatgaatacaaatcagtgggccttctctatgatggtccaacaaactctcagtgtccaccctgtccctgtatctcccatggaagatgaataatgtcaggtgttctttgggtcaaaggccccagggcagtctggaggcttagagggcagagtggtgtcattccatgtaaagttaggcttctgaggggtcaggcagaatatggtgtccatatcttccatagctctgcagattcttggatgaagtcaagcacagtttgctagacccaggtcactcctctgagtataactaggacccatgagtgaaacttaatagctgtaaggaagaacctgctgtctgccagagaggataagctgcccatctcagcagctgtctaaaagaaggcaggtgtctctttaaagggaagagaagcattggtgaaatggatttcaggtcacttccattccagatgggtgagatcttgtggagctgggatcatgtttgaactcattcatacctgtagagcacgaatccaagtagattgtgtttggtctgtacaggctgaagccccctgctctcccacccaagtgcccccactgagcaggccaacatgctgttgtggccacatatactgggctgatccaggctggttatcaccaaacagcaaaccatagggaacagctgctttgccatagacccaatacccatgtagatctctcatgagagcagccataactcagacccactgaccaacagggccatgagtgacagccagaaccagtgaaggtccaagtaggacacagagcagggcttttcttaccatacacattatctccagaggttatttctaccccactccctattcaaggcctgttggagcacactgcaaaagcaaaagcacagtaactcaatttacacatgattataatcatttccagtgcacacatttcatcaccaggtggatcctgagctagcccatgtaaatccgggttaacccatattggtaatcatactcaaaagcacttttcaccctacattctactagccaatcaaagacaaagagttgtggcctctaccattgccttggcttctggacaccctcacaagctatcccaaggttcccgctcaactccagggaggctgacatcttcacatccactgggcatataatattgcatgagaccaaagtctccacactctttgcagcctcctccatgaatcccaatggcctgcacttgtacagtttgggtgtttgatagataaagcacgtatgagaagagaaaacaaaataaatcaactttttaaaaaagccagcactgtgctgtcaatgttttttttttcttttcaattctagctcagaaaagcagaaggtaaataatgtcaggtcaatgaatatcagatatattttttgactgtacattacagtgaagtgtaatctttttacacctgcaagtccatcttatttattcttgtaaatgttccctgacaatgtttgtaacatggctgtgttaaaaaatctatacaataaagctgtgaccctgagattcatgttttcctaagata

SEQ ID NO: 171924 - DNA, 12483 bp, Homo sapiens
  Payload ID: 13777
  Gene Symbol: PTPRT
  Gene Name: protein tyrosine phosphatase, receptor type, T
  ENST ID: ENST00000373184
  CDS Start-End: 1-4356
atggcgagcctcgccgcgctcgccctcagcctgctcctgaggctgcagctgccgccactgcccggcgcccgggctcagagcgccgcaggtggctgttcctttgatgagcactacagcaactgtggttatagtgtggctctagggaccaatgggttcacctgggagcagattaacacatgggagaaaccaatgctggaccaggcagtgcccacaggatctttcatgatggtgaacagctctgggagagcctctggccagaaggcccaccttctcctgccaaccctgaaggagaatgacacccactgcatcgacttccattactacttctccagccgtgacaggtccagcccaggggccttgaacgtctacgtgaaggtgaatggtggcccccaagggaaccctgtgtggaatgtgtccggggtcgtcactgagggctgggtgaaggcagagctcgccatcagcactttctggccacatttctatcaggtgatatttgaatccgtctcattgaagggtcatcctggctacatcgccgtggacgaggtccgggtccttgctcatccatgcagaaaagcacctcattttctgcgactccaaaacgtggaggtgaatgtggggcagaatgccacatttcagtgcattgctggtgggaagtggtctcagcatgacaagctttggctccagcaatggaatggcagggacacggccctgatggtcacccgtgtggtcaaccacaggcgcttctcagccacagtcagtgtggcagacactgcccagcggagcgtcagcaagtaccgctgtgtgatccgctctgatggtgggtctggtgtgtccaactacgcggagctgatcgtgaaagagcctcccacgcccattgctcccccagagctgctggctgtgggggccacatacctgtggatcaagccaaatgccaactccatcatcggggatggccccatcatcctgaaggaagtggaatatcgcaccaccacaggcacgtgggcagagacccacatagtcgactctcccaactataagctgtggcatctggaccccgatgttgagtatgagatccgagtgctcctcacacgaccaggtgaggggggtacgggaccgccagggcctcccctcaccaccaggaccaagtgtgcagatccggtacatggcccacagaacgtggaaatcgtagacatcagagcccggcagctgaccctgcagtgggagcccttcggctacgcggtgacccgctgccatagctacaacctcaccgtgcagtaccagtatgtgttcaaccagcagcagtacgaggccgaggaggtcatccagacctcctcccactacaccctgcgaggcctgcgccccttcatgaccatccggctgcgactcttgctgtctaaccccgagggccgaatggagagcgaggagctggtggtgcagactgaggaagacgttccaggagctgttcctctagaatccatccaaggggggccctttgaggagaagatctacatccagtggaaacctcccaatgagaccaatggggtcatcacgctctacgagatcaactacaaggctgtcggctcgctggacccaagtgctgacctctcgagccagagggggaaagtgttcaagctccggaatgaaacccaccacctctttgtgggtctgtacccagggaccacctattccttcaccatcaaggccagcacagcaaagggctttgggccccctgtcaccactcggattgccaccaaaatttcagctccatccatgcctgagtacgacacagacaccccattgaatgagacagacacgaccatcacagtgatgctgaaacccgctcagtcccggggagctcctgtcagtgtttatcagctggttgtcaaggaggagcgacttcagaagtcacggagggcagctgacattattgagtgcttttcggtgcccgtgagctatcggaatgcctccagcctcgattctctacactactttgctgctgagttgaagcctgccaacctgcctgtcacccagccatttacagtgggtgacaataagacatacaatggctactggaaccctcctctctctcccctgaaaagctacagcatctacttccaggcactcagcaaagccaatggagagaccaaaatcaactgtgttcgtctggctacaaaaggtgcctccacccagaattctaacactgtggagccagagaagcaggtggacaacaccgtgaagatggctggcgtgatcgctggcctcctcatgttcatcatcattctcctgggcgtgatgctcaccatcaaaaggaggaagctggccaagaagcagaaggagacccagagtggagcccagagggagatggggcctgtggcctctgccgacaaacccaccaccaagctcagcgccagccgcaatgatgaaggcttctcttctagttctcaggacgtcaacggattcacagatggcagccgcggggagctttcccagcccaccctcacgatccagactcatccctaccgcacctgtgaccctgtggagatgagctacccccgggaccagttccaacccgccatccgggtggctgacttgctgcagcacatcacgcagatgaagagaggccagggctacgggttcaaggaggaatacgaggccttaccagaggggcagacagcttcgtgggacacagccaaggaggatgaaaaccgcaataagaatcgatatgggaacatcatatcctacgaccattcccgggtgaggctgctggtgctggatggagacccgcactctgactacatcaatgccaactacattgacggataccatcgacctcggcactacattgcgactcaaggtccgatgcaggagactgtaaaggacttttggagaatgatctggcaggagaactccgccagcatcgtcatggtcacaaacctggtggaagtgggcaggcacccagcggaacacactgtgggaaatgccactctaggccgtgcggcgtcccccggaatggtgaaatgtgtgcgatactggccagatgacacggaggtctacggagacattaaagtcaccctgattgaaacagagcccctggcagaatacgtcatacgcaccttcacagtccagaagaaaggctaccatgagatccgggagctccgcctcttccacttcaccagctggcctgaccacggcgttccctgctatgccactggccttctgggcttcgtccgccaggtcaagttcctcaaccccccggaagctgggcccatagtggtccactgcagtgctggggctgggcggactggctgcttcattgccattgacaccatgcttgacatggccgagaatgaaggggtggtggacatcttcaactgcgtgcgtgagctccgggcccaaagggtcaacctggtacagacagaggagcaatatgtgtttgtgcacgatgccatcctggaagcgtgcctctgtggcaacactgccatccctgtgtgtgagttccgttctctctactacaatatcagcaggctggacccccagacaaactccagccaaatcaaagatgaatttcagaccctcaacattgtgacaccccgtgtgcggcccgaggactgcagcattgggctcctgccccggaaccatgataagaatcgaagtatggacgtgctgcctctggaccgctgcctgcccttccttatctcagtggacggagaatccagcaattacatcaacgcagcactgatggatagccacaagcagcctgccgccttcgtggtcacccagcaccctctacccaacaccgtggcagacttctggaggctggtgttcgattacaactgctcctctgtggtgatgctgaatgagatggacactgcccagttctgtatgcagtactggcctgagaagacctccgggtgctatgggcccatccaggtggagttcgtctccgcagacatcgacgaggacatcatccacagaatattccgcatctgtaacatggcccggccacaggatggttatcgtatagtccagcacctccagtacattggctggcctgcctaccgggacacgcccccctccaagcgctctctgctcaaagtggtccgacgactggagaagtggcaggagcagtatgacgggagggagggacgtactgtggtccactgcctaaatgggggaggccgtagtggaaccttctgtgccatctgcagtgtgtgtgagatgatccagcagcaaaacatcattgacgtgttccacatcgtgaaaacactgcgtaacaacaaatccaacatggtggagaccctggaacagtataaatttgtatacgaggtggcactggaatatttaagctccttttagctcaatgggatggggaacctgccggagtccagaggctgctgtgaccaagcccccttttgtgtgaatggcagtaactgggctcaggagctctgaggtggcaccctgcctgactccaaggagaagactggtggccctgtgttccacggggggctctgcaccttctgaggggtctcctgttgccgtgggagatgctgctccaaaaggcccaggcttccttttcaacctaaccagccacagccaagggcccaagcagaagtacacccacaagcaaggccttggatttctggctcccagaccacctgcttttgttctgagtttgtggatctcttggcaagccaactgtgcaggtgctggggagtgggaggctcccctgccctccttctccttaggagtggaggagatgtgtgttctgctcctctacgtcatggaaaagattgaggctcttgggggtcactgctctgctgccccctgcaacctccttcaggggcctctggcaccagacatttgcagtctggaccagtgtgaccttacgatgttccctaggccacaagagaggccccccatcctcacacctaacctgcatggggcttcgcccacaaccattctgtaccccttccccagcctgggccttgaccgtccagcattcactggccggccagctgtgtccacagcagtttttgataaaggtgttctttgcttttttgtgtggtcagtgggagggggtggaactgcagggaacttctctgctcctccttgtctttgtaaaaagggaccacctccctggggcagggcttgggctgacctgtaggatgtaacccctgtgtttctttggtggtagctttctttggaagagacaaacaagataagatttgattattttccaaagtgtatgtgaaaagaaactttcttttggagggtgtaaaatcttagtctcttatgtcaaaaagaagggggcgggggagtttgagtatgtacctctaagacaaatctctcgggccttttattttttcctggcaatgtccttaaaagctcccaccctgggacagcatgccactgagcaaggagagatgggtgagcctgaagatggtccctttggtttctggggcaaatagagcaccagctttgtgcataatttggatgtccaaatttgaactccttcctaaagaaacccagcagccaccttgaaaaaggccattgtggagcccattatactttgatttaaaataggccaagagaatcaggcctggagatctagggtcttgtccaaagtgtgagtgagtcaatgagagggaaccaacatttgctaagtctctactgtatgccagggatcatgcttggcactttccataggacatttcacacagtccttagaacccccaggagagagctactgacttgttatcatctccatttgatcatctcctccaatgaggaaacccacgcaccttccttagtaatgaaatcctgggttccaaaggggcaggtaatggcaatgagacttctccgtgctgttttcttcatcttctctaagccaagcaattattttatggagggaaaataaggccagaaacttctgagcagataactccacaaatggaaatttagtactttcttcctgatgccagttcttctgggaagcgcagaatttcagatatattttagtaacacattcccagctccccaggaaagccagtctcatctaatttcttagtcagtaaaaacaattccctgttccttcaggctatgaatggaccagccagggaaactctcgaccttgatctctagccagtgcttaggcccaatatctgacagcctcaggtgggctgggacctaggaagctccatcttgaaggctggtctagccccagacagggcatgaggggcagagaattcaagaaggtacagctttggccctcaagagcccactgtatgctggggaaatggaaccatggtgcagtagtgtggagtggatgagtgttccatgagcctaggagcaagaaagtctcttcggcctcgggcttcctggagaaggggacgtccattcctgctgggtcttaacaagcataaaaaggaaaaaaaggaaactcaggcaaagggatccatatgtgcaatggcaaagaaatgtgaaaaggcattgggagaagcagtctgggggaggccagcccagtgcgggcacagcacaacacggggagcagcaagagatgagccagggtccaggagacagatgcccatcgcgagtacagactttgtcctattggcaacaaggagtccatggagctttagagagatgcactcagcttcgtgttggccaagactccttctgggccaatggggctgcctcttttcctttcatcagacactgtgaaaacattcccttaagcgtgcactttttaatatcacatctatttgtctgtctgctcattgttttgttgctggaactaaatatgcaatggatcatgagactcagattctatgagaaacccagggtctctgctttaccacggagcagggtcaccaacccagatctccaggcccatgaggatggaacatgaaaggagccgacaaaagttgcttccattggcatgggctctggagctgtccagaagtccagggacaccagacttgatcaaggaagggctgtcactttagaggttcaaaaggaagtgcctcaaagcaaaggcaagcaaaggaaccccacgatgaacttgctcttttcctttgatgagcctctccccaggtgtatttcagcagaccccggggacccacccccactgggcctgctggcctccctcggctccagcccaatgccccagctggccttccccagcctgcaaggagcctgtagcatggcaaatctgcctgctgtatgctattttcttagatcttggtacatccagacaggatgagggtggagggagagctatttaacacaaatcctaagatttttttctgctcaggaaggggtgaaatagctggcagatacaaaagacagtggcttttatcattttaaatggtaggaatttaaggtgtgacttcagggagaaacaaacttgcaaaaaaaaaaaatctcaggccatgttggggtaacccagcaagggccagtgatgatttcccccagctcatccccttattttcccacaacccaaccattctctaaagcaggacagtgaataggtcttaggccagtgcacacaggaagaaattgaggcttatggatggggatgacttccctaagatcccatgggacaaggatgtggcaaggcttggatgagatggggcaccagtgcccaggaatttgaacattttcctttacccaggaaatctccggagccaacaccaccacccccagggggtctccccaccccaccccatttacagggtgagctcagcctgtcatgagcagaggaaaatattattaatgctctctgagtctttacaacaggagctcttacctcatagatgtgggctctgtttggggaagatgcaaggaagtaatgagaagcccaggaaatttctccacctgtgtttatggcctaaatagcttcaggatgtatcttagctgcactccaacattgcatcctttctggggtgaagaatctgggccaaccaggggtccttgggcctctagaaggccacagtaggcctctctttgtgggaatggaaggggacagtttgcttttagtgctggccctctctgtgggtgtggcctgcaaaggaaccaacagaccctatgctggggactctaacatgtgagctcattaaattcttccagcattctaaaggagggtttgtgattgtcaccatttactgatgaggaaactaaggctcctaggggagaaatcacttgcccacagttccacagctagtgagtgaatgaaccaggatttaaaccggttttttctcactacagagacaatatttttccaccattgtatctcacatttttcccaggaggttacccataacagaagagactagagtggaacagatacgtcagtggataaagctcaaagcaaacaacagtaagcttaaaattccttcatagtctcatgttttacgttcacaattcatgcaaaatttgcattccactttctgatttagccttgttggttttaatatgactctatgaatatttcaaaaaaaaatgtgctctgttcctcatgttgttctgttctgttcaccccgctatgacggaccctaggtcagctggtcttcagcttgaccctagaattgactctaggagcagtgaccctgctgcctcccagagccagttataggctcaagatcaagaccaactgaccttctcctaggcagctcctttggtgtgtgggtgctctgacctcactgttcatgaggggacctcaactaaggcatcttccagttgggtgctggaaggaacccattaactcacactagaatgatgaggatttgctcatctggcgtggagaaggatgagcccacaaaaccctaaagggaaaagagaagctggacacagctgtactcagcagattcctgaatgctaggctggaaagtggtgcctgttgtccaagtggagtcacatggttgctaatgtgggcaagtctgaggacacacttcatgagcagctggggtctggaaggctcctcactttaccctagccacacataattactgggtgcctacagcacctagcaccttggagggggcactattaggaaatcgagattactatggcacaattaattcctgggtaaggcatggggttgtggtggacagagctcagtctttagtttgaacgaaaacatacatacatgaaaaacatacatgaaaaaaggaccctcatcaacattagaaggggtagatttggagcactttaggcaggaaaacaggaacgcaaggccaggaaactggaacccagtgaatactcagaaccgaggatgcagatgacttatttagcaaaatggtcacttctgtgacatagctggagaaaggatgggtaacagcttgccagagccacttggaacaagggcaaatctcagtgtctggggcaaaagatgatgcatttccctctgacccatcatgtttattcatcctccactccccattgccacactagctcttgctgtaagtcctcaccaggatctacatttcctcgtcgctggtgggaaccccttagagtacatagaggtatcagtccagtaagactgctctacacaacagaagtgaggcccagggagtagcagccaggcccttatcctgttacctctgcaggagtgactgcccaacccagatccagagacattgaaggaaatgataattccttggtacctcactgccttgggacaaaatgaagaaagccacccttccttaggctgcagcttgccactcctgggctgggtaaacaggtcatcagcaccaagctcaaccaggagtaacactctggaagacatgggtgagcccaagaggaagcatgaacaggacgctgttcctaagtcatgtcaacaggttgtgctgggccaggatccccagggaaaaaaatggtcaacccaactggagggtaggttagaagaaaaaaaacataaacgtggatagtcatgtcatctcaaatccctgacttggcttccccattacttaacagtctgagctccttcttagcctgtgaccagcttcaaatcacagccaagtaaaacaaggaaataggaaaagtaaatccaactagaagagacaagctgagattcagatttgtttactcctcccatgcaaagtttccctgttggaggttttccatgtatacatgtctagaagtgatagaatgcaaggccttggctttgtcttgcagggatctgcctttgaggtcatagactgaacagcagggagagaggttagtggtggagtgtggggggagctgttctagctccagtttcttctgacacatttttcaggatcatggatctgatcctccgaagcacagcagagatatctaagccatatttgtgcacatgagcagactcttctagttttttagtaaccagggatgggcttttgcatggcactgactatagagatgtcttgtagagatcaagccagtcttttgcatcccacctgcccacctccagaagagatgggaaaaggtcatcaaagggcattcaccaactgaaatccactcatgaatgttaggtctctaaaaggaggcatcaacactcacaatggtagcctccaaacctagcatcccacctatctaagagctcaggggtggtccactggggcagatacaagggaagtgcaagggctcaggatgaaagaaaatctattgggaagagttttaggggcttgatcattatggggcttccttctatatctgagaactgctctgggtggtgagatgtggactctgatccttaattggaatgttcggagaatgagtgtctggtggccttgaagtgttggacagaaaagtatcagtataaaagcctggagctcagggtaattaatgtagttcatggttccttagtgagcaggactcttggatgtggaggagaaagggtcataggaagtaaaccaccaaaattacaaaattgagtctctgtacaattacttcagtgcctttgggcttatgaatacaaatcagtgggccttctctatgatggtccaacaaactctcagtgtccaccctgtccctgtatctcccatggaagatgaataatgtcaggtgttctttgggtcaaaggccccagggcagtctggaggcttagagggcagagtggtgtcattccatgtaaagttaggcttctgaggggtcaggcagaatatggtgtccatatcttccatagctctgcagattcttggatgaagtcaagcacagtttgctagacccaggtcactcctctgagtataactaggacccatgagtgaaacttaatagctgtaaggaagaacctgctgtctgccagagaggataagctgcccatctcagcagctgtctaaaagaaggcaggtgtctctttaaagggaagagaagcattggtgaaatggatttcaggtcacttccattccagatgggtgagatcttgtggagctgggatcatgtttgaactcattcatacctgtagagcacgaatccaagtagattgtgtttggtctgtacaggctgaagccccctgctctcccacccaagtgcccccactgagcaggccaacatgctgttgtggccacatatactgggctgatccaggctggttatcaccaaacagcaaaccatagggaacagctgctttgccatagacccaatacccatgtagatctctcatgagagcagccataactcagacccactgaccaacagggccatgagtgacagccagaaccagtgaaggtccaagtaggacacagagcagggcttttcttaccatacacattatctccagaggttatttctaccccactccctattcaaggcctgttggagcacactgcaaaagcaaaagcacagtaactcaatttacacatgattataatcatttccagtgcacacatttcatcaccaggtggatcctgagctagcccatgtaaatccgggttaacccatattggtaatcatactcaaaagcacttttcaccctacattctactagccaatcaaagacaaagagttgtggcctctaccattgccttggcttctggacaccctcacaagctatcccaaggttcccgctcaactccagggaggctgacatcttcacatccactgggcatataatattgcatgagaccaaagtctccacactctttgcagcctcctccatgaatcccaatggcctgcacttgtacagtttgggtgtttgatagataaagcacgtatgagaagagaaaacaaaataaatcaactttttaaaaaagccagcactgtgctgtcaatgttttttttttcttttcaattctagctcagaaaagcagaaggtaaataatgtcaggtcaatgaatatcagatatattttttgactgtacattacagtgaagtgtaatctttttacacctgcaagtccatcttatttattcttgtaaatgttccctgacaatgtttgtaacatggctgtgttaaaaaatctatacaataaagctgtgaccctgagattcatgttttcctaagata

SEQ ID NO: 171925 - DNA, 12453 bp, Homo sapiens
  Payload ID: 13777
  Gene Symbol: PTPRT
  Gene Name: protein tyrosine phosphatase, receptor type, T
  Uniprot ID: O14522
  ENST ID: ENST00000373187
  CDS Start-End: 1-4326
atggcgagcctcgccgcgctcgccctcagcctgctcctgaggctgcagctgccgccactgcccggcgcccgggctcagagcgccgcaggtggctgttcctttgatgagcactacagcaactgtggttatagtgtggctctagggaccaatgggttcacctgggagcagattaacacatgggagaaaccaatgctggaccaggcagtgcccacaggatctttcatgatggtgaacagctctgggagagcctctggccagaaggcccaccttctcctgccaaccctgaaggagaatgacacccactgcatcgacttccattactacttctccagccgtgacaggtccagcccaggggccttgaacgtctacgtgaaggtgaatggtggcccccaagggaaccctgtgtggaatgtgtccggggtcgtcactgagggctgggtgaaggcagagctcgccatcagcactttctggccacatttctatcaggtgatatttgaatccgtctcattgaagggtcatcctggctacatcgccgtggacgaggtccgggtccttgctcatccatgcagaaaagcacctcattttctgcgactccaaaacgtggaggtgaatgtggggcagaatgccacatttcagtgcattgctggtgggaagtggtctcagcatgacaagctttggctccagcaatggaatggcagggacacggccctgatggtcacccgtgtggtcaaccacaggcgcttctcagccacagtcagtgtggcagacactgcccagcggagcgtcagcaagtaccgctgtgtgatccgctctgatggtgggtctggtgtgtccaactacgcggagctgatcgtgaaagagcctcccacgcccattgctcccccagagctgctggctgtgggggccacatacctgtggatcaagccaaatgccaactccatcatcggggatggccccatcatcctgaaggaagtggaatatcgcaccaccacaggcacgtgggcagagacccacatagtcgactctcccaactataagctgtggcatctggaccccgatgttgagtatgagatccgagtgctcctcacacgaccaggtgaggggggtacgggaccgccagggcctcccctcaccaccaggaccaagtgtgcagatccggtacatggcccacagaacgtggaaatcgtagacatcagagcccggcagctgaccctgcagtgggagcccttcggctacgcggtgacccgctgccatagctacaacctcaccgtgcagtaccagtatgtgttcaaccagcagcagtacgaggccgaggaggtcatccagacctcctcccactacaccctgcgaggcctgcgccccttcatgaccatccggctgcgactcttgctgtctaaccccgagggccgaatggagagcgaggagctggtggtgcagactgaggaagacgttccaggagctgttcctctagaatccatccaaggggggccctttgaggagaagatctacatccagtggaaacctcccaatgagaccaatggggtcatcacgctctacgagatcaactacaaggctgtcggctcgctggacccaagtgctgacctctcgagccagagggggaaagtgttcaagctccggaatgaaacccaccacctctttgtgggtctgtacccagggaccacctattccttcaccatcaaggccagcacagcaaagggctttgggccccctgtcaccactcggattgccaccaaaatttcagctccatccatgcctgagtacgacacagacaccccattgaatgagacagacacgaccatcacagtgatgctgaaacccgctcagtcccggggagctcctgtcagtgtttatcagctggttgtcaaggaggagcgacttcagaagtcacggagggcagctgacattattgagtgcttttcggtgcccgtgagctatcggaatgcctccagcctcgattctctacactactttgctgctgagttgaagcctgccaacctgcctgtcacccagccatttacagtgggtgacaataagacatacaatggctactggaaccctcctctctctcccctgaaaagctacagcatctacttccaggcactcagcaaagccaatggagagaccaaaatcaactgtgttcgtctggctacaaaaggtgcctccacccagaattctaacactgtggagccagagaagcaggtggacaacaccgtgaagatggctggcgtgatcgctggcctcctcatgttcatcatcattctcctgggcgtgatgctcaccatcaaaaggagaagaaatgcttattcctactcctattacttgaagctggccaagaagcagaaggagacccagagtggagcccagagggagatggggcctgtggcctctgccgacaaacccaccaccaagctcagcgccagccgcaatgatgaaggcttctcttctagttctcaggacgtcaacggattcacagatggcagccgcggggagctttcccagcccaccctcacgatccagactcatccctaccgcacctgtgaccctgtggagatgagctacccccgggaccagttccaacccgccatccgggtggctgacttgctgcagcacatcacgcagatgaagagaggccagggctacgggttcaaggaggaatacgaggccttaccagaggggcagacagcttcgtgggacacagccaaggaggatgaaaaccgcaataagaatcgatatgggaacatcatatcctacgaccattcccgggtgaggctgctggtgctggatggagacccgcactctgactacatcaatgccaactacattgacggataccatcgacctcggcactacattgcgactcaaggtccgatgcaggagactgtaaaggacttttggagaatgatctggcaggagaactccgccagcatcgtcatggtcacaaacctggtggaagtgggcagggtgaaatgtgtgcgatactggccagatgacacggaggtctacggagacattaaagtcaccctgattgaaacagagcccctggcagaatacgtcatacgcaccttcacagtccagaagaaaggctaccatgagatccgggagctccgcctcttccacttcaccagctggcctgaccacggcgttccctgctatgccactggccttctgggcttcgtccgccaggtcaagttcctcaaccccccggaagctgggcccatagtggtccactgcagtgctggggctgggcggactggctgcttcattgccattgacaccatgcttgacatggccgagaatgaaggggtggtggacatcttcaactgcgtgcgtgagctccgggcccaaagggtcaacctggtacagacagaggagcaatatgtgtttgtgcacgatgccatcctggaagcgtgcctctgtggcaacactgccatccctgtgtgtgagttccgttctctctactacaatatcagcaggctggacccccagacaaactccagccaaatcaaagatgaatttcagaccctcaacattgtgacaccccgtgtgcggcccgaggactgcagcattgggctcctgccccggaaccatgataagaatcgaagtatggacgtgctgcctctggaccgctgcctgcccttccttatctcagtggacggagaatccagcaattacatcaacgcagcactgatggatagccacaagcagcctgccgccttcgtggtcacccagcaccctctacccaacaccgtggcagacttctggaggctggtgttcgattacaactgctcctctgtggtgatgctgaatgagatggacactgcccagttctgtatgcagtactggcctgagaagacctccgggtgctatgggcccatccaggtggagttcgtctccgcagacatcgacgaggacatcatccacagaatattccgcatctgtaacatggcccggccacaggatggttatcgtatagtccagcacctccagtacattggctggcctgcctaccgggacacgcccccctccaagcgctctctgctcaaagtggtccgacgactggagaagtggcaggagcagtatgacgggagggagggacgtactgtggtccactgcctaaatgggggaggccgtagtggaaccttctgtgccatctgcagtgtgtgtgagatgatccagcagcaaaacatcattgacgtgttccacatcgtgaaaacactgcgtaacaacaaatccaacatggtggagaccctggaacagtataaatttgtatacgaggtggcactggaatatttaagctccttttagctcaatgggatggggaacctgccggagtccagaggctgctgtgaccaagcccccttttgtgtgaatggcagtaactgggctcaggagctctgaggtggcaccctgcctgactccaaggagaagactggtggccctgtgttccacggggggctctgcaccttctgaggggtctcctgttgccgtgggagatgctgctccaaaaggcccaggcttccttttcaacctaaccagccacagccaagggcccaagcagaagtacacccacaagcaaggccttggatttctggctcccagaccacctgcttttgttctgagtttgtggatctcttggcaagccaactgtgcaggtgctggggagtgggaggctcccctgccctccttctccttaggagtggaggagatgtgtgttctgctcctctacgtcatggaaaagattgaggctcttgggggtcactgctctgctgccccctgcaacctccttcaggggcctctggcaccagacatttgcagtctggaccagtgtgaccttacgatgttccctaggccacaagagaggccccccatcctcacacctaacctgcatggggcttcgcccacaaccattctgtaccccttccccagcctgggccttgaccgtccagcattcactggccggccagctgtgtccacagcagtttttgataaaggtgttctttgcttttttgtgtggtcagtgggagggggtggaactgcagggaacttctctgctcctccttgtctttgtaaaaagggaccacctccctggggcagggcttgggctgacctgtaggatgtaacccctgtgtttctttggtggtagctttctttggaagagacaaacaagataagatttgattattttccaaagtgtatgtgaaaagaaactttcttttggagggtgtaaaatcttagtctcttatgtcaaaaagaagggggcgggggagtttgagtatgtacctctaagacaaatctctcgggccttttattttttcctggcaatgtccttaaaagctcccaccctgggacagcatgccactgagcaaggagagatgggtgagcctgaagatggtccctttggtttctggggcaaatagagcaccagctttgtgcataatttggatgtccaaatttgaactccttcctaaagaaacccagcagccaccttgaaaaaggccattgtggagcccattatactttgatttaaaataggccaagagaatcaggcctggagatctagggtcttgtccaaagtgtgagtgagtcaatgagagggaaccaacatttgctaagtctctactgtatgccagggatcatgcttggcactttccataggacatttcacacagtccttagaacccccaggagagagctactgacttgttatcatctccatttgatcatctcctccaatgaggaaacccacgcaccttccttagtaatgaaatcctgggttccaaaggggcaggtaatggcaatgagacttctccgtgctgttttcttcatcttctctaagccaagcaattattttatggagggaaaataaggccagaaacttctgagcagataactccacaaatggaaatttagtactttcttcctgatgccagttcttctgggaagcgcagaatttcagatatattttagtaacacattcccagctccccaggaaagccagtctcatctaatttcttagtcagtaaaaacaattccctgttccttcaggctatgaatggaccagccagggaaactctcgaccttgatctctagccagtgcttaggcccaatatctgacagcctcaggtgggctgggacctaggaagctccatcttgaaggctggtctagccccagacagggcatgaggggcagagaattcaagaaggtacagctttggccctcaagagcccactgtatgctggggaaatggaaccatggtgcagtagtgtggagtggatgagtgttccatgagcctaggagcaagaaagtctcttcggcctcgggcttcctggagaaggggacgtccattcctgctgggtcttaacaagcataaaaaggaaaaaaaggaaactcaggcaaagggatccatatgtgcaatggcaaagaaatgtgaaaaggcattgggagaagcagtctgggggaggccagcccagtgcgggcacagcacaacacggggagcagcaagagatgagccagggtccaggagacagatgcccatcgcgagtacagactttgtcctattggcaacaaggagtccatggagctttagagagatgcactcagcttcgtgttggccaagactccttctgggccaatggggctgcctcttttcctttcatcagacactgtgaaaacattcccttaagcgtgcactttttaatatcacatctatttgtctgtctgctcattgttttgttgctggaactaaatatgcaatggatcatgagactcagattctatgagaaacccagggtctctgctttaccacggagcagggtcaccaacccagatctccaggcccatgaggatggaacatgaaaggagccgacaaaagttgcttccattggcatgggctctggagctgtccagaagtccagggacaccagacttgatcaaggaagggctgtcactttagaggttcaaaaggaagtgcctcaaagcaaaggcaagcaaaggaaccccacgatgaacttgctcttttcctttgatgagcctctccccaggtgtatttcagcagaccccggggacccacccccactgggcctgctggcctccctcggctccagcccaatgccccagctggccttccccagcctgcaaggagcctgtagcatggcaaatctgcctgctgtatgctattttcttagatcttggtacatccagacaggatgagggtggagggagagctatttaacacaaatcctaagatttttttctgctcaggaaggggtgaaatagctggcagatacaaaagacagtggcttttatcattttaaatggtaggaatttaaggtgtgacttcagggagaaacaaacttgcaaaaaaaaaaaatctcaggccatgttggggtaacccagcaagggccagtgatgatttcccccagctcatccccttattttcccacaacccaaccattctctaaagcaggacagtgaataggtcttaggccagtgcacacaggaagaaattgaggcttatggatggggatgacttccctaagatcccatgggacaaggatgtggcaaggcttggatgagatggggcaccagtgcccaggaatttgaacattttcctttacccaggaaatctccggagccaacaccaccacccccagggggtctccccaccccaccccatttacagggtgagctcagcctgtcatgagcagaggaaaatattattaatgctctctgagtctttacaacaggagctcttacctcatagatgtgggctctgtttggggaagatgcaaggaagtaatgagaagcccaggaaatttctccacctgtgtttatggcctaaatagcttcaggatgtatcttagctgcactccaacattgcatcctttctggggtgaagaatctgggccaaccaggggtccttgggcctctagaaggccacagtaggcctctctttgtgggaatggaaggggacagtttgcttttagtgctggccctctctgtgggtgtggcctgcaaaggaaccaacagaccctatgctggggactctaacatgtgagctcattaaattcttccagcattctaaaggagggtttgtgattgtcaccatttactgatgaggaaactaaggctcctaggggagaaatcacttgcccacagttccacagctagtgagtgaatgaaccaggatttaaaccggttttttctcactacagagacaatatttttccaccattgtatctcacatttttcccaggaggttacccataacagaagagactagagtggaacagatacgtcagtggataaagctcaaagcaaacaacagtaagcttaaaattccttcatagtctcatgttttacgttcacaattcatgcaaaatttgcattccactttctgatttagccttgttggttttaatatgactctatgaatatttcaaaaaaaaatgtgctctgttcctcatgttgttctgttctgttcaccccgctatgacggaccctaggtcagctggtcttcagcttgaccctagaattgactctaggagcagtgaccctgctgcctcccagagccagttataggctcaagatcaagaccaactgaccttctcctaggcagctcctttggtgtgtgggtgctctgacctcactgttcatgaggggacctcaactaaggcatcttccagttgggtgctggaaggaacccattaactcacactagaatgatgaggatttgctcatctggcgtggagaaggatgagcccacaaaaccctaaagggaaaagagaagctggacacagctgtactcagcagattcctgaatgctaggctggaaagtggtgcctgttgtccaagtggagtcacatggttgctaatgtgggcaagtctgaggacacacttcatgagcagctggggtctggaaggctcctcactttaccctagccacacataattactgggtgcctacagcacctagcaccttggagggggcactattaggaaatcgagattactatggcacaattaattcctgggtaaggcatggggttgtggtggacagagctcagtctttagtttgaacgaaaacatacatacatgaaaaacatacatgaaaaaaggaccctcatcaacattagaaggggtagatttggagcactttaggcaggaaaacaggaacgcaaggccaggaaactggaacccagtgaatactcagaaccgaggatgcagatgacttatttagcaaaatggtcacttctgtgacatagctggagaaaggatgggtaacagcttgccagagccacttggaacaagggcaaatctcagtgtctggggcaaaagatgatgcatttccctctgacccatcatgtttattcatcctccactccccattgccacactagctcttgctgtaagtcctcaccaggatctacatttcctcgtcgctggtgggaaccccttagagtacatagaggtatcagtccagtaagactgctctacacaacagaagtgaggcccagggagtagcagccaggcccttatcctgttacctctgcaggagtgactgcccaacccagatccagagacattgaaggaaatgataattccttggtacctcactgccttgggacaaaatgaagaaagccacccttccttaggctgcagcttgccactcctgggctgggtaaacaggtcatcagcaccaagctcaaccaggagtaacactctggaagacatgggtgagcccaagaggaagcatgaacaggacgctgttcctaagtcatgtcaacaggttgtgctgggccaggatccccagggaaaaaaatggtcaacccaactggagggtaggttagaagaaaaaaaacataaacgtggatagtcatgtcatctcaaatccctgacttggcttccccattacttaacagtctgagctccttcttagcctgtgaccagcttcaaatcacagccaagtaaaacaaggaaataggaaaagtaaatccaactagaagagacaagctgagattcagatttgtttactcctcccatgcaaagtttccctgttggaggttttccatgtatacatgtctagaagtgatagaatgcaaggccttggctttgtcttgcagggatctgcctttgaggtcatagactgaacagcagggagagaggttagtggtggagtgtggggggagctgttctagctccagtttcttctgacacatttttcaggatcatggatctgatcctccgaagcacagcagagatatctaagccatatttgtgcacatgagcagactcttctagttttttagtaaccagggatgggcttttgcatggcactgactatagagatgtcttgtagagatcaagccagtcttttgcatcccacctgcccacctccagaagagatgggaaaaggtcatcaaagggcattcaccaactgaaatccactcatgaatgttaggtctctaaaaggaggcatcaacactcacaatggtagcctccaaacctagcatcccacctatctaagagctcaggggtggtccactggggcagatacaagggaagtgcaagggctcaggatgaaagaaaatctattgggaagagttttaggggcttgatcattatggggcttccttctatatctgagaactgctctgggtggtgagatgtggactctgatccttaattggaatgttcggagaatgagtgtctggtggccttgaagtgttggacagaaaagtatcagtataaaagcctggagctcagggtaattaatgtagttcatggttccttagtgagcaggactcttggatgtggaggagaaagggtcataggaagtaaaccaccaaaattacaaaattgagtctctgtacaattacttcagtgcctttgggcttatgaatacaaatcagtgggccttctctatgatggtccaacaaactctcagtgtccaccctgtccctgtatctcccatggaagatgaataatgtcaggtgttctttgggtcaaaggccccagggcagtctggaggcttagagggcagagtggtgtcattccatgtaaagttaggcttctgaggggtcaggcagaatatggtgtccatatcttccatagctctgcagattcttggatgaagtcaagcacagtttgctagacccaggtcactcctctgagtataactaggacccatgagtgaaacttaatagctgtaaggaagaacctgctgtctgccagagaggataagctgcccatctcagcagctgtctaaaagaaggcaggtgtctctttaaagggaagagaagcattggtgaaatggatttcaggtcacttccattccagatgggtgagatcttgtggagctgggatcatgtttgaactcattcatacctgtagagcacgaatccaagtagattgtgtttggtctgtacaggctgaagccccctgctctcccacccaagtgcccccactgagcaggccaacatgctgttgtggccacatatactgggctgatccaggctggttatcaccaaacagcaaaccatagggaacagctgctttgccatagacccaatacccatgtagatctctcatgagagcagccataactcagacccactgaccaacagggccatgagtgacagccagaaccagtgaaggtccaagtaggacacagagcagggcttttcttaccatacacattatctccagaggttatttctaccccactccctattcaaggcctgttggagcacactgcaaaagcaaaagcacagtaactcaatttacacatgattataatcatttccagtgcacacatttcatcaccaggtggatcctgagctagcccatgtaaatccgggttaacccatattggtaatcatactcaaaagcacttttcaccctacattctactagccaatcaaagacaaagagttgtggcctctaccattgccttggcttctggacaccctcacaagctatcccaaggttcccgctcaactccagggaggctgacatcttcacatccactgggcatataatattgcatgagaccaaagtctccacactctttgcagcctcctccatgaatcccaatggcctgcacttgtacagtttgggtgtttgatagataaagcacgtatgagaagagaaaacaaaataaatcaactttttaaaaaagccagcactgtgctgtcaatgttttttttttcttttcaattctagctcagaaaagcagaaggtaaataatgtcaggtcaatgaatatcagatatattttttgactgtacattacagtgaagtgtaatctttttacacctgcaagtccatcttatttattcttgtaaatgttccctgacaatgtttgtaacatggctgtgttaaaaaatctatacaataaagctgtgaccctgagattcatgttttcctaagata

SEQ ID NO: 171926 - DNA, 12559 bp, Homo sapiens
  Payload ID: 13777
  Gene Symbol: PTPRT
  Gene Name: protein tyrosine phosphatase, receptor type, T
  ENST ID: ENST00000373190
  CDS Start-End: 110-4432
ccgcgcgcacagccagcggccgcgccggcgatgcggggccaccccgcgcccgccccagtcccggccccggcccccgcgggaaggggctgagctgcccgccgccgcccggatggcgagcctcgccgcgctcgccctcagcctgctcctgaggctgcagctgccgccactgcccggcgcccgggctcagagcgccgcaggtggctgttcctttgatgagcactacagcaactgtggttatagtgtggctctagggaccaatgggttcacctgggagcagattaacacatgggagaaaccaatgctggaccaggcagtgcccacaggatctttcatgatggtgaacagctctgggagagcctctggccagaaggcccaccttctcctgccaaccctgaaggagaatgacacccactgcatcgacttccattactacttctccagccgtgacaggtccagcccaggggccttgaacgtctacgtgaaggtgaatggtggcccccaagggaaccctgtgtggaatgtgtccggggtcgtcactgagggctgggtgaaggcagagctcgccatcagcactttctggccacatttctatcaggtgatatttgaatccgtctcattgaagggtcatcctggctacatcgccgtggacgaggtccgggtccttgctcatccatgcagaaaagcacctcattttctgcgactccaaaacgtggaggtgaatgtggggcagaatgccacatttcagtgcattgctggtgggaagtggtctcagcatgacaagctttggctccagcaatggaatggcagggacacggccctgatggtcacccgtgtggtcaaccacaggcgcttctcagccacagtcagtgtggcagacactgcccagcggagcgtcagcaagtaccgctgtgtgatccgctctgatggtgggtctggtgtgtccaactacgcggagctgatcgtgaaagagcctcccacgcccattgctcccccagagctgctggctgtgggggccacatacctgtggatcaagccaaatgccaactccatcatcggggatggccccatcatcctgaaggaagtggaatatcgcaccaccacaggcacgtgggcagagacccacatagtcgactctcccaactataagctgtggcatctggaccccgatgttgagtatgagatccgagtgctcctcacacgaccaggtgaggggggtacgggaccgccagggcctcccctcaccaccaggaccaagtgtgcagatccggtacatggcccacagaacgtggaaatcgtagacatcagagcccggcagctgaccctgcagtgggagcccttcggctacgcggtgacccgctgccatagctacaacctcaccgtgcagtaccagtatgtgttcaaccagcagcagtacgaggccgaggaggtcatccagacctcctcccactacaccctgcgaggcctgcgccccttcatgaccatccggctgcgactcttgctgtctaaccccgagggccgaatggagagcgaggagctggtggtgcagactgaggaagacgttccaggagctgttcctctagaatccatccaaggggggccctttgaggagaagatctacatccagtggaaacctcccaatgagaccaatggggtcatcacgctctacgagatcaactacaaggctgtcggctcgctggacccaagtgctgacctctcgagccagagggggaaagtgttcaagctccggaatgaaacccaccacctctttgtgggtctgtacccagggaccacctattccttcaccatcaaggccagcacagcaaagggctttgggccccctgtcaccactcggattgccaccaaaatttcagctccatccatgcctgagtacgacacagacaccccattgaatgagacagacacgaccatcacagtgatgctgaaacccgctcagtcccggggagctcctgtcagtgtttatcagctggttgtcaaggaggagcgacttcagaagtcacggagggcagctgacattattgagtgcttttcggtgcccgtgagctatcggaatgcctccagcctcgattctctacactactttgctgctgagttgaagcctgccaacctgcctgtcacccagccatttacagtgggtgacaataagacatacaatggctactggaaccctcctctctctcccctgaaaagctacagcatctacttccaggcactcagcaaagccaatggagagaccaaaatcaactgtgttcgtctggctacaaaaggtgcctccacccagaattctaacactgtggagccagagaagcaggtggacaacaccgtgaagatggctggcgtgatcgctggcctcctcatgttcatcatcattctcctgggcgtgatgctcaccatcaaaaggagaagaaatgcttattcctactcctattacttgaagctggccaagaagcagaaggagacccagagtggagcccagagggagatggggcctgtggcctctgccgacaaacccaccaccaagctcagcgccagccgcaatgatgaaggcttctcttctagttctcaggacgtcaacggattcaatggcagccgcggggagctttcccagcccaccctcacgatccagactcatccctaccgcacctgtgaccctgtggagatgagctacccccgggaccagttccaacccgccatccgggtggctgacttgctgcagcacatcacgcagatgaagagaggccagggctacgggttcaaggaggaatacgaggccttaccagaggggcagacagcttcgtgggacacagccaaggaggatgaaaaccgcaataagaatcgatatgggaacatcatatcctacgaccattcccgggtgaggctgctggtgctggatggagacccgcactctgactacatcaatgccaactacattgacggataccatcgacctcggcactacattgcgactcaaggtccgatgcaggagactgtaaaggacttttggagaatgatctggcaggagaactccgccagcatcgtcatggtcacaaacctggtggaagtgggcagggtgaaatgtgtgcgatactggccagatgacacggaggtctacggagacattaaagtcaccctgattgaaacagagcccctggcagaatacgtcatacgcaccttcacagtccagaagaaaggctaccatgagatccgggagctccgcctcttccacttcaccagctggcctgaccacggcgttccctgctatgccactggccttctgggcttcgtccgccaggtcaagttcctcaaccccccggaagctgggcccatagtggtccactgcagtgctggggctgggcggactggctgcttcattgccattgacaccatgcttgacatggccgagaatgaaggggtggtggacatcttcaactgcgtgcgtgagctccgggcccaaagggtcaacctggtacagacagaggagcaatatgtgtttgtgcacgatgccatcctggaagcgtgcctctgtggcaacactgccatccctgtgtgtgagttccgttctctctactacaatatcagcaggctggacccccagacaaactccagccaaatcaaagatgaatttcagaccctcaacattgtgacaccccgtgtgcggcccgaggactgcagcattgggctcctgccccggaaccatgataagaatcgaagtatggacgtgctgcctctggaccgctgcctgcccttccttatctcagtggacggagaatccagcaattacatcaacgcagcactgatggatagccacaagcagcctgccgccttcgtggtcacccagcaccctctacccaacaccgtggcagacttctggaggctggtgttcgattacaactgctcctctgtggtgatgctgaatgagatggacactgcccagttctgtatgcagtactggcctgagaagacctccgggtgctatgggcccatccaggtggagttcgtctccgcagacatcgacgaggacatcatccacagaatattccgcatctgtaacatggcccggccacaggatggttatcgtatagtccagcacctccagtacattggctggcctgcctaccgggacacgcccccctccaagcgctctctgctcaaagtggtccgacgactggagaagtggcaggagcagtatgacgggagggagggacgtactgtggtccactgcctaaatgggggaggccgtagtggaaccttctgtgccatctgcagtgtgtgtgagatgatccagcagcaaaacatcattgacgtgttccacatcgtgaaaacactgcgtaacaacaaatccaacatggtggagaccctggaacagtataaatttgtatacgaggtggcactggaatatttaagctccttttagctcaatgggatggggaacctgccggagtccagaggctgctgtgaccaagcccccttttgtgtgaatggcagtaactgggctcaggagctctgaggtggcaccctgcctgactccaaggagaagactggtggccctgtgttccacggggggctctgcaccttctgaggggtctcctgttgccgtgggagatgctgctccaaaaggcccaggcttccttttcaacctaaccagccacagccaagggcccaagcagaagtacacccacaagcaaggccttggatttctggctcccagaccacctgcttttgttctgagtttgtggatctcttggcaagccaactgtgcaggtgctggggagtgggaggctcccctgccctccttctccttaggagtggaggagatgtgtgttctgctcctctacgtcatggaaaagattgaggctcttgggggtcactgctctgctgccccctgcaacctccttcaggggcctctggcaccagacatttgcagtctggaccagtgtgaccttacgatgttccctaggccacaagagaggccccccatcctcacacctaacctgcatggggcttcgcccacaaccattctgtaccccttccccagcctgggccttgaccgtccagcattcactggccggccagctgtgtccacagcagtttttgataaaggtgttctttgcttttttgtgtggtcagtgggagggggtggaactgcagggaacttctctgctcctccttgtctttgtaaaaagggaccacctccctggggcagggcttgggctgacctgtaggatgtaacccctgtgtttctttggtggtagctttctttggaagagacaaacaagataagatttgattattttccaaagtgtatgtgaaaagaaactttcttttggagggtgtaaaatcttagtctcttatgtcaaaaagaagggggcgggggagtttgagtatgtacctctaagacaaatctctcgggccttttattttttcctggcaatgtccttaaaagctcccaccctgggacagcatgccactgagcaaggagagatgggtgagcctgaagatggtccctttggtttctggggcaaatagagcaccagctttgtgcataatttggatgtccaaatttgaactccttcctaaagaaacccagcagccaccttgaaaaaggccattgtggagcccattatactttgatttaaaataggccaagagaatcaggcctggagatctagggtcttgtccaaagtgtgagtgagtcaatgagagggaaccaacatttgctaagtctctactgtatgccagggatcatgcttggcactttccataggacatttcacacagtccttagaacccccaggagagagctactgacttgttatcatctccatttgatcatctcctccaatgaggaaacccacgcaccttccttagtaatgaaatcctgggttccaaaggggcaggtaatggcaatgagacttctccgtgctgttttcttcatcttctctaagccaagcaattattttatggagggaaaataaggccagaaacttctgagcagataactccacaaatggaaatttagtactttcttcctgatgccagttcttctgggaagcgcagaatttcagatatattttagtaacacattcccagctccccaggaaagccagtctcatctaatttcttagtcagtaaaaacaattccctgttccttcaggctatgaatggaccagccagggaaactctcgaccttgatctctagccagtgcttaggcccaatatctgacagcctcaggtgggctgggacctaggaagctccatcttgaaggctggtctagccccagacagggcatgaggggcagagaattcaagaaggtacagctttggccctcaagagcccactgtatgctggggaaatggaaccatggtgcagtagtgtggagtggatgagtgttccatgagcctaggagcaagaaagtctcttcggcctcgggcttcctggagaaggggacgtccattcctgctgggtcttaacaagcataaaaaggaaaaaaaggaaactcaggcaaagggatccatatgtgcaatggcaaagaaatgtgaaaaggcattgggagaagcagtctgggggaggccagcccagtgcgggcacagcacaacacggggagcagcaagagatgagccagggtccaggagacagatgcccatcgcgagtacagactttgtcctattggcaacaaggagtccatggagctttagagagatgcactcagcttcgtgttggccaagactccttctgggccaatggggctgcctcttttcctttcatcagacactgtgaaaacattcccttaagcgtgcactttttaatatcacatctatttgtctgtctgctcattgttttgttgctggaactaaatatgcaatggatcatgagactcagattctatgagaaacccagggtctctgctttaccacggagcagggtcaccaacccagatctccaggcccatgaggatggaacatgaaaggagccgacaaaagttgcttccattggcatgggctctggagctgtccagaagtccagggacaccagacttgatcaaggaagggctgtcactttagaggttcaaaaggaagtgcctcaaagcaaaggcaagcaaaggaaccccacgatgaacttgctcttttcctttgatgagcctctccccaggtgtatttcagcagaccccggggacccacccccactgggcctgctggcctccctcggctccagcccaatgccccagctggccttccccagcctgcaaggagcctgtagcatggcaaatctgcctgctgtatgctattttcttagatcttggtacatccagacaggatgagggtggagggagagctatttaacacaaatcctaagatttttttctgctcaggaaggggtgaaatagctggcagatacaaaagacagtggcttttatcattttaaatggtaggaatttaaggtgtgacttcagggagaaacaaacttgcaaaaaaaaaaaatctcaggccatgttggggtaacccagcaagggccagtgatgatttcccccagctcatccccttattttcccacaacccaaccattctctaaagcaggacagtgaataggtcttaggccagtgcacacaggaagaaattgaggcttatggatggggatgacttccctaagatcccatgggacaaggatgtggcaaggcttggatgagatggggcaccagtgcccaggaatttgaacattttcctttacccaggaaatctccggagccaacaccaccacccccagggggtctccccaccccaccccatttacagggtgagctcagcctgtcatgagcagaggaaaatattattaatgctctctgagtctttacaacaggagctcttacctcatagatgtgggctctgtttggggaagatgcaaggaagtaatgagaagcccaggaaatttctccacctgtgtttatggcctaaatagcttcaggatgtatcttagctgcactccaacattgcatcctttctggggtgaagaatctgggccaaccaggggtccttgggcctctagaaggccacagtaggcctctctttgtgggaatggaaggggacagtttgcttttagtgctggccctctctgtgggtgtggcctgcaaaggaaccaacagaccctatgctggggactctaacatgtgagctcattaaattcttccagcattctaaaggagggtttgtgattgtcaccatttactgatgaggaaactaaggctcctaggggagaaatcacttgcccacagttccacagctagtgagtgaatgaaccaggatttaaaccggttttttctcactacagagacaatatttttccaccattgtatctcacatttttcccaggaggttacccataacagaagagactagagtggaacagatacgtcagtggataaagctcaaagcaaacaacagtaagcttaaaattccttcatagtctcatgttttacgttcacaattcatgcaaaatttgcattccactttctgatttagccttgttggttttaatatgactctatgaatatttcaaaaaaaaatgtgctctgttcctcatgttgttctgttctgttcaccccgctatgacggaccctaggtcagctggtcttcagcttgaccctagaattgactctaggagcagtgaccctgctgcctcccagagccagttataggctcaagatcaagaccaactgaccttctcctaggcagctcctttggtgtgtgggtgctctgacctcactgttcatgaggggacctcaactaaggcatcttccagttgggtgctggaaggaacccattaactcacactagaatgatgaggatttgctcatctggcgtggagaaggatgagcccacaaaaccctaaagggaaaagagaagctggacacagctgtactcagcagattcctgaatgctaggctggaaagtggtgcctgttgtccaagtggagtcacatggttgctaatgtgggcaagtctgaggacacacttcatgagcagctggggtctggaaggctcctcactttaccctagccacacataattactgggtgcctacagcacctagcaccttggagggggcactattaggaaatcgagattactatggcacaattaattcctgggtaaggcatggggttgtggtggacagagctcagtctttagtttgaacgaaaacatacatacatgaaaaacatacatgaaaaaaggaccctcatcaacattagaaggggtagatttggagcactttaggcaggaaaacaggaacgcaaggccaggaaactggaacccagtgaatactcagaaccgaggatgcagatgacttatttagcaaaatggtcacttctgtgacatagctggagaaaggatgggtaacagcttgccagagccacttggaacaagggcaaatctcagtgtctggggcaaaagatgatgcatttccctctgacccatcatgtttattcatcctccactccccattgccacactagctcttgctgtaagtcctcaccaggatctacatttcctcgtcgctggtgggaaccccttagagtacatagaggtatcagtccagtaagactgctctacacaacagaagtgaggcccagggagtagcagccaggcccttatcctgttacctctgcaggagtgactgcccaacccagatccagagacattgaaggaaatgataattccttggtacctcactgccttgggacaaaatgaagaaagccacccttccttaggctgcagcttgccactcctgggctgggtaaacaggtcatcagcaccaagctcaaccaggagtaacactctggaagacatgggtgagcccaagaggaagcatgaacaggacgctgttcctaagtcatgtcaacaggttgtgctgggccaggatccccagggaaaaaaatggtcaacccaactggagggtaggttagaagaaaaaaaacataaacgtggatagtcatgtcatctcaaatccctgacttggcttccccattacttaacagtctgagctccttcttagcctgtgaccagcttcaaatcacagccaagtaaaacaaggaaataggaaaagtaaatccaactagaagagacaagctgagattcagatttgtttactcctcccatgcaaagtttccctgttggaggttttccatgtatacatgtctagaagtgatagaatgcaaggccttggctttgtcttgcagggatctgcctttgaggtcatagactgaacagcagggagagaggttagtggtggagtgtggggggagctgttctagctccagtttcttctgacacatttttcaggatcatggatctgatcctccgaagcacagcagagatatctaagccatatttgtgcacatgagcagactcttctagttttttagtaaccagggatgggcttttgcatggcactgactatagagatgtcttgtagagatcaagccagtcttttgcatcccacctgcccacctccagaagagatgggaaaaggtcatcaaagggcattcaccaactgaaatccactcatgaatgttaggtctctaaaaggaggcatcaacactcacaatggtagcctccaaacctagcatcccacctatctaagagctcaggggtggtccactggggcagatacaagggaagtgcaagggctcaggatgaaagaaaatctattgggaagagttttaggggcttgatcattatggggcttccttctatatctgagaactgctctgggtggtgagatgtggactctgatccttaattggaatgttcggagaatgagtgtctggtggccttgaagtgttggacagaaaagtatcagtataaaagcctggagctcagggtaattaatgtagttcatggttccttagtgagcaggactcttggatgtggaggagaaagggtcataggaagtaaaccaccaaaattacaaaattgagtctctgtacaattacttcagtgcctttgggcttatgaatacaaatcagtgggccttctctatgatggtccaacaaactctcagtgtccaccctgtccctgtatctcccatggaagatgaataatgtcaggtgttctttgggtcaaaggccccagggcagtctggaggcttagagggcagagtggtgtcattccatgtaaagttaggcttctgaggggtcaggcagaatatggtgtccatatcttccatagctctgcagattcttggatgaagtcaagcacagtttgctagacccaggtcactcctctgagtataactaggacccatgagtgaaacttaatagctgtaaggaagaacctgctgtctgccagagaggataagctgcccatctcagcagctgtctaaaagaaggcaggtgtctctttaaagggaagagaagcattggtgaaatggatttcaggtcacttccattccagatgggtgagatcttgtggagctgggatcatgtttgaactcattcatacctgtagagcacgaatccaagtagattgtgtttggtctgtacaggctgaagccccctgctctcccacccaagtgcccccactgagcaggccaacatgctgttgtggccacatatactgggctgatccaggctggttatcaccaaacagcaaaccatagggaacagctgctttgccatagacccaatacccatgtagatctctcatgagagcagccataactcagacccactgaccaacagggccatgagtgacagccagaaccagtgaaggtccaagtaggacacagagcagggcttttcttaccatacacattatctccagaggttatttctaccccactccctattcaaggcctgttggagcacactgcaaaagcaaaagcacagtaactcaatttacacatgattataatcatttccagtgcacacatttcatcaccaggtggatcctgagctagcccatgtaaatccgggttaacccatattggtaatcatactcaaaagcacttttcaccctacattctactagccaatcaaagacaaagagttgtggcctctaccattgccttggcttctggacaccctcacaagctatcccaaggttcccgctcaactccagggaggctgacatcttcacatccactgggcatataatattgcatgagaccaaagtctccacactctttgcagcctcctccatgaatcccaatggcctgcacttgtacagtttgggtgtttgatagataaagcacgtatgagaagagaaaacaaaataaatcaactttttaaaaaagccagcactgtgctgtcaatgttttttttttcttttcaattctagctcagaaaagcagaaggtaaataatgtcaggtcaatgaatatcagatatattttttgactgtacattacagtgaagtgtaatctttttacacctgcaagtccatcttatttattcttgtaaatgttccctgacaatgtttgtaacatggctgtgttaaaaaatctatacaataaagctgtgaccctgagattcatgttttcctaagata

SEQ ID NO: 171927 - DNA, 12681 bp, Homo sapiens
  Payload ID: 13777
  Gene Symbol: PTPRT
  Gene Name: protein tyrosine phosphatase, receptor type, T
  Uniprot ID: O14522
  ENST ID: ENST00000373193
  CDS Start-End: 185-4576
cctcccgcctcagttcgcgccgcgcctcggcttggaacgcaggagcgccggctccgggagcccgagcggagccagccgcgcgcacagccagcggccgcgccggcgatgcggggccaccccgcgcccgccccagtcccggccccggcccccgcgggaaggggctgagctgcccgccgccgcccggatggcgagcctcgccgcgctcgccctcagcctgctcctgaggctgcagctgccgccactgcccggcgcccgggctcagagcgccgcaggtggctgttcctttgatgagcactacagcaactgtggttatagtgtggctctagggaccaatgggttcacctgggagcagattaacacatgggagaaaccaatgctggaccaggcagtgcccacaggatctttcatgatggtgaacagctctgggagagcctctggccagaaggcccaccttctcctgccaaccctgaaggagaatgacacccactgcatcgacttccattactacttctccagccgtgacaggtccagcccaggggccttgaacgtctacgtgaaggtgaatggtggcccccaagggaaccctgtgtggaatgtgtccggggtcgtcactgagggctgggtgaaggcagagctcgccatcagcactttctggccacatttctatcaggtgatatttgaatccgtctcattgaagggtcatcctggctacatcgccgtggacgaggtccgggtccttgctcatccatgcagaaaagcacctcattttctgcgactccaaaacgtggaggtgaatgtggggcagaatgccacatttcagtgcattgctggtgggaagtggtctcagcatgacaagctttggctccagcaatggaatggcagggacacggccctgatggtcacccgtgtggtcaaccacaggcgcttctcagccacagtcagtgtggcagacactgcccagcggagcgtcagcaagtaccgctgtgtgatccgctctgatggtgggtctggtgtgtccaactacgcggagctgatcgtgaaagagcctcccacgcccattgctcccccagagctgctggctgtgggggccacatacctgtggatcaagccaaatgccaactccatcatcggggatggccccatcatcctgaaggaagtggaatatcgcaccaccacaggcacgtgggcagagacccacatagtcgactctcccaactataagctgtggcatctggaccccgatgttgagtatgagatccgagtgctcctcacacgaccaggtgaggggggtacgggaccgccagggcctcccctcaccaccaggaccaagtgtgcagatccggtacatggcccacagaacgtggaaatcgtagacatcagagcccggcagctgaccctgcagtgggagcccttcggctacgcggtgacccgctgccatagctacaacctcaccgtgcagtaccagtatgtgttcaaccagcagcagtacgaggccgaggaggtcatccagacctcctcccactacaccctgcgaggcctgcgccccttcatgaccatccggctgcgactcttgctgtctaaccccgagggccgaatggagagcgaggagctggtggtgcagactgaggaagacgttccaggagctgttcctctagaatccatccaaggggggccctttgaggagaagatctacatccagtggaaacctcccaatgagaccaatggggtcatcacgctctacgagatcaactacaaggctgtcggctcgctggacccaagtgctgacctctcgagccagagggggaaagtgttcaagctccggaatgaaacccaccacctctttgtgggtctgtacccagggaccacctattccttcaccatcaaggccagcacagcaaagggctttgggccccctgtcaccactcggattgccaccaaaatttcagctccatccatgcctgagtacgacacagacaccccattgaatgagacagacacgaccatcacagtgatgctgaaacccgctcagtcccggggagctcctgtcagtgtttatcagctggttgtcaaggaggagcgacttcagaagtcacggagggcagctgacattattgagtgcttttcggtgcccgtgagctatcggaatgcctccagcctcgattctctacactactttgctgctgagttgaagcctgccaacctgcctgtcacccagccatttacagtgggtgacaataagacatacaatggctactggaaccctcctctctctcccctgaaaagctacagcatctacttccaggcactcagcaaagccaatggagagaccaaaatcaactgtgttcgtctggctacaaaagcaccaatgggcagcgcccaggtgaccccggggactccactctgcctcctcaccacaggtgcctccacccagaattctaacactgtggagccagagaagcaggtggacaacaccgtgaagatggctggcgtgatcgctggcctcctcatgttcatcatcattctcctgggcgtgatgctcaccatcaaaaggagaagaaatgcttattcctactcctattacttgtcccaaaggaagctggccaagaagcagaaggagacccagagtggagcccagagggagatggggcctgtggcctctgccgacaaacccaccaccaagctcagcgccagccgcaatgatgaaggcttctcttctagttctcaggacgtcaacggattcacagatggcagccgcggggagctttcccagcccaccctcacgatccagactcatccctaccgcacctgtgaccctgtggagatgagctacccccgggaccagttccaacccgccatccgggtggctgacttgctgcagcacatcacgcagatgaagagaggccagggctacgggttcaaggaggaatacgaggccttaccagaggggcagacagcttcgtgggacacagccaaggaggatgaaaaccgcaataagaatcgatatgggaacatcatatcctacgaccattcccgggtgaggctgctggtgctggatggagacccgcactctgactacatcaatgccaactacattgacggataccatcgacctcggcactacattgcgactcaaggtccgatgcaggagactgtaaaggacttttggagaatgatctggcaggagaactccgccagcatcgtcatggtcacaaacctggtggaagtgggcagggtgaaatgtgtgcgatactggccagatgacacggaggtctacggagacattaaagtcaccctgattgaaacagagcccctggcagaatacgtcatacgcaccttcacagtccagaagaaaggctaccatgagatccgggagctccgcctcttccacttcaccagctggcctgaccacggcgttccctgctatgccactggccttctgggcttcgtccgccaggtcaagttcctcaaccccccggaagctgggcccatagtggtccactgcagtgctggggctgggcggactggctgcttcattgccattgacaccatgcttgacatggccgagaatgaaggggtggtggacatcttcaactgcgtgcgtgagctccgggcccaaagggtcaacctggtacagacagaggagcaatatgtgtttgtgcacgatgccatcctggaagcgtgcctctgtggcaacactgccatccctgtgtgtgagttccgttctctctactacaatatcagcaggctggacccccagacaaactccagccaaatcaaagatgaatttcagaccctcaacattgtgacaccccgtgtgcggcccgaggactgcagcattgggctcctgccccggaaccatgataagaatcgaagtatggacgtgctgcctctggaccgctgcctgcccttccttatctcagtggacggagaatccagcaattacatcaacgcagcactgatggatagccacaagcagcctgccgccttcgtggtcacccagcaccctctacccaacaccgtggcagacttctggaggctggtgttcgattacaactgctcctctgtggtgatgctgaatgagatggacactgcccagttctgtatgcagtactggcctgagaagacctccgggtgctatgggcccatccaggtggagttcgtctccgcagacatcgacgaggacatcatccacagaatattccgcatctgtaacatggcccggccacaggatggttatcgtatagtccagcacctccagtacattggctggcctgcctaccgggacacgcccccctccaagcgctctctgctcaaagtggtccgacgactggagaagtggcaggagcagtatgacgggagggagggacgtactgtggtccactgcctaaatgggggaggccgtagtggaaccttctgtgccatctgcagtgtgtgtgagatgatccagcagcaaaacatcattgacgtgttccacatcgtgaaaacactgcgtaacaacaaatccaacatggtggagaccctggaacagtataaatttgtatacgaggtggcactggaatatttaagctccttttagctcaatgggatggggaacctgccggagtccagaggctgctgtgaccaagcccccttttgtgtgaatggcagtaactgggctcaggagctctgaggtggcaccctgcctgactccaaggagaagactggtggccctgtgttccacggggggctctgcaccttctgaggggtctcctgttgccgtgggagatgctgctccaaaaggcccaggcttccttttcaacctaaccagccacagccaagggcccaagcagaagtacacccacaagcaaggccttggatttctggctcccagaccacctgcttttgttctgagtttgtggatctcttggcaagccaactgtgcaggtgctggggagtgggaggctcccctgccctccttctccttaggagtggaggagatgtgtgttctgctcctctacgtcatggaaaagattgaggctcttgggggtcactgctctgctgccccctgcaacctccttcaggggcctctggcaccagacatttgcagtctggaccagtgtgaccttacgatgttccctaggccacaagagaggccccccatcctcacacctaacctgcatggggcttcgcccacaaccattctgtaccccttccccagcctgggccttgaccgtccagcattcactggccggccagctgtgtccacagcagtttttgataaaggtgttctttgcttttttgtgtggtcagtgggagggggtggaactgcagggaacttctctgctcctccttgtctttgtaaaaagggaccacctccctggggcagggcttgggctgacctgtaggatgtaacccctgtgtttctttggtggtagctttctttggaagagacaaacaagataagatttgattattttccaaagtgtatgtgaaaagaaactttcttttggagggtgtaaaatcttagtctcttatgtcaaaaagaagggggcgggggagtttgagtatgtacctctaagacaaatctctcgggccttttattttttcctggcaatgtccttaaaagctcccaccctgggacagcatgccactgagcaaggagagatgggtgagcctgaagatggtccctttggtttctggggcaaatagagcaccagctttgtgcataatttggatgtccaaatttgaactccttcctaaagaaacccagcagccaccttgaaaaaggccattgtggagcccattatactttgatttaaaataggccaagagaatcaggcctggagatctagggtcttgtccaaagtgtgagtgagtcaatgagagggaaccaacatttgctaagtctctactgtatgccagggatcatgcttggcactttccataggacatttcacacagtccttagaacccccaggagagagctactgacttgttatcatctccatttgatcatctcctccaatgaggaaacccacgcaccttccttagtaatgaaatcctgggttccaaaggggcaggtaatggcaatgagacttctccgtgctgttttcttcatcttctctaagccaagcaattattttatggagggaaaataaggccagaaacttctgagcagataactccacaaatggaaatttagtactttcttcctgatgccagttcttctgggaagcgcagaatttcagatatattttagtaacacattcccagctccccaggaaagccagtctcatctaatttcttagtcagtaaaaacaattccctgttccttcaggctatgaatggaccagccagggaaactctcgaccttgatctctagccagtgcttaggcccaatatctgacagcctcaggtgggctgggacctaggaagctccatcttgaaggctggtctagccccagacagggcatgaggggcagagaattcaagaaggtacagctttggccctcaagagcccactgtatgctggggaaatggaaccatggtgcagtagtgtggagtggatgagtgttccatgagcctaggagcaagaaagtctcttcggcctcgggcttcctggagaaggggacgtccattcctgctgggtcttaacaagcataaaaaggaaaaaaaggaaactcaggcaaagggatccatatgtgcaatggcaaagaaatgtgaaaaggcattgggagaagcagtctgggggaggccagcccagtgcgggcacagcacaacacggggagcagcaagagatgagccagggtccaggagacagatgcccatcgcgagtacagactttgtcctattggcaacaaggagtccatggagctttagagagatgcactcagcttcgtgttggccaagactccttctgggccaatggggctgcctcttttcctttcatcagacactgtgaaaacattcccttaagcgtgcactttttaatatcacatctatttgtctgtctgctcattgttttgttgctggaactaaatatgcaatggatcatgagactcagattctatgagaaacccagggtctctgctttaccacggagcagggtcaccaacccagatctccaggcccatgaggatggaacatgaaaggagccgacaaaagttgcttccattggcatgggctctggagctgtccagaagtccagggacaccagacttgatcaaggaagggctgtcactttagaggttcaaaaggaagtgcctcaaagcaaaggcaagcaaaggaaccccacgatgaacttgctcttttcctttgatgagcctctccccaggtgtatttcagcagaccccggggacccacccccactgggcctgctggcctccctcggctccagcccaatgccccagctggccttccccagcctgcaaggagcctgtagcatggcaaatctgcctgctgtatgctattttcttagatcttggtacatccagacaggatgagggtggagggagagctatttaacacaaatcctaagatttttttctgctcaggaaggggtgaaatagctggcagatacaaaagacagtggcttttatcattttaaatggtaggaatttaaggtgtgacttcagggagaaacaaacttgcaaaaaaaaaaaatctcaggccatgttggggtaacccagcaagggccagtgatgatttcccccagctcatccccttattttcccacaacccaaccattctctaaagcaggacagtgaataggtcttaggccagtgcacacaggaagaaattgaggcttatggatggggatgacttccctaagatcccatgggacaaggatgtggcaaggcttggatgagatggggcaccagtgcccaggaatttgaacattttcctttacccaggaaatctccggagccaacaccaccacccccagggggtctccccaccccaccccatttacagggtgagctcagcctgtcatgagcagaggaaaatattattaatgctctctgagtctttacaacaggagctcttacctcatagatgtgggctctgtttggggaagatgcaaggaagtaatgagaagcccaggaaatttctccacctgtgtttatggcctaaatagcttcaggatgtatcttagctgcactccaacattgcatcctttctggggtgaagaatctgggccaaccaggggtccttgggcctctagaaggccacagtaggcctctctttgtgggaatggaaggggacagtttgcttttagtgctggccctctctgtgggtgtggcctgcaaaggaaccaacagaccctatgctggggactctaacatgtgagctcattaaattcttccagcattctaaaggagggtttgtgattgtcaccatttactgatgaggaaactaaggctcctaggggagaaatcacttgcccacagttccacagctagtgagtgaatgaaccaggatttaaaccggttttttctcactacagagacaatatttttccaccattgtatctcacatttttcccaggaggttacccataacagaagagactagagtggaacagatacgtcagtggataaagctcaaagcaaacaacagtaagcttaaaattccttcatagtctcatgttttacgttcacaattcatgcaaaatttgcattccactttctgatttagccttgttggttttaatatgactctatgaatatttcaaaaaaaaatgtgctctgttcctcatgttgttctgttctgttcaccccgctatgacggaccctaggtcagctggtcttcagcttgaccctagaattgactctaggagcagtgaccctgctgcctcccagagccagttataggctcaagatcaagaccaactgaccttctcctaggcagctcctttggtgtgtgggtgctctgacctcactgttcatgaggggacctcaactaaggcatcttccagttgggtgctggaaggaacccattaactcacactagaatgatgaggatttgctcatctggcgtggagaaggatgagcccacaaaaccctaaagggaaaagagaagctggacacagctgtactcagcagattcctgaatgctaggctggaaagtggtgcctgttgtccaagtggagtcacatggttgctaatgtgggcaagtctgaggacacacttcatgagcagctggggtctggaaggctcctcactttaccctagccacacataattactgggtgcctacagcacctagcaccttggagggggcactattaggaaatcgagattactatggcacaattaattcctgggtaaggcatggggttgtggtggacagagctcagtctttagtttgaacgaaaacatacatacatgaaaaacatacatgaaaaaaggaccctcatcaacattagaaggggtagatttggagcactttaggcaggaaaacaggaacgcaaggccaggaaactggaacccagtgaatactcagaaccgaggatgcagatgacttatttagcaaaatggtcacttctgtgacatagctggagaaaggatgggtaacagcttgccagagccacttggaacaagggcaaatctcagtgtctggggcaaaagatgatgcatttccctctgacccatcatgtttattcatcctccactccccattgccacactagctcttgctgtaagtcctcaccaggatctacatttcctcgtcgctggtgggaaccccttagagtacatagaggtatcagtccagtaagactgctctacacaacagaagtgaggcccagggagtagcagccaggcccttatcctgttacctctgcaggagtgactgcccaacccagatccagagacattgaaggaaatgataattccttggtacctcactgccttgggacaaaatgaagaaagccacccttccttaggctgcagcttgccactcctgggctgggtaaacaggtcatcagcaccaagctcaaccaggagtaacactctggaagacatgggtgagcccaagaggaagcatgaacaggacgctgttcctaagtcatgtcaacaggttgtgctgggccaggatccccagggaaaaaaatggtcaacccaactggagggtaggttagaagaaaaaaaacataaacgtggatagtcatgtcatctcaaatccctgacttggcttccccattacttaacagtctgagctccttcttagcctgtgaccagcttcaaatcacagccaagtaaaacaaggaaataggaaaagtaaatccaactagaagagacaagctgagattcagatttgtttactcctcccatgcaaagtttccctgttggaggttttccatgtatacatgtctagaagtgatagaatgcaaggccttggctttgtcttgcagggatctgcctttgaggtcatagactgaacagcagggagagaggttagtggtggagtgtggggggagctgttctagctccagtttcttctgacacatttttcaggatcatggatctgatcctccgaagcacagcagagatatctaagccatatttgtgcacatgagcagactcttctagttttttagtaaccagggatgggcttttgcatggcactgactatagagatgtcttgtagagatcaagccagtcttttgcatcccacctgcccacctccagaagagatgggaaaaggtcatcaaagggcattcaccaactgaaatccactcatgaatgttaggtctctaaaaggaggcatcaacactcacaatggtagcctccaaacctagcatcccacctatctaagagctcaggggtggtccactggggcagatacaagggaagtgcaagggctcaggatgaaagaaaatctattgggaagagttttaggggcttgatcattatggggcttccttctatatctgagaactgctctgggtggtgagatgtggactctgatccttaattggaatgttcggagaatgagtgtctggtggccttgaagtgttggacagaaaagtatcagtataaaagcctggagctcagggtaattaatgtagttcatggttccttagtgagcaggactcttggatgtggaggagaaagggtcataggaagtaaaccaccaaaattacaaaattgagtctctgtacaattacttcagtgcctttgggcttatgaatacaaatcagtgggccttctctatgatggtccaacaaactctcagtgtccaccctgtccctgtatctcccatggaagatgaataatgtcaggtgttctttgggtcaaaggccccagggcagtctggaggcttagagggcagagtggtgtcattccatgtaaagttaggcttctgaggggtcaggcagaatatggtgtccatatcttccatagctctgcagattcttggatgaagtcaagcacagtttgctagacccaggtcactcctctgagtataactaggacccatgagtgaaacttaatagctgtaaggaagaacctgctgtctgccagagaggataagctgcccatctcagcagctgtctaaaagaaggcaggtgtctctttaaagggaagagaagcattggtgaaatggatttcaggtcacttccattccagatgggtgagatcttgtggagctgggatcatgtttgaactcattcatacctgtagagcacgaatccaagtagattgtgtttggtctgtacaggctgaagccccctgctctcccacccaagtgcccccactgagcaggccaacatgctgttgtggccacatatactgggctgatccaggctggttatcaccaaacagcaaaccatagggaacagctgctttgccatagacccaatacccatgtagatctctcatgagagcagccataactcagacccactgaccaacagggccatgagtgacagccagaaccagtgaaggtccaagtaggacacagagcagggcttttcttaccatacacattatctccagaggttatttctaccccactccctattcaaggcctgttggagcacactgcaaaagcaaaagcacagtaactcaatttacacatgattataatcatttccagtgcacacatttcatcaccaggtggatcctgagctagcccatgtaaatccgggttaacccatattggtaatcatactcaaaagcacttttcaccctacattctactagccaatcaaagacaaagagttgtggcctctaccattgccttggcttctggacaccctcacaagctatcccaaggttcccgctcaactccagggaggctgacatcttcacatccactgggcatataatattgcatgagaccaaagtctccacactctttgcagcctcctccatgaatcccaatggcctgcacttgtacagtttgggtgtttgatagataaagcacgtatgagaagagaaaacaaaataaatcaactttttaaaaaagccagcactgtgctgtcaatgttttttttttcttttcaattctagctcagaaaagcagaaggtaaataatgtcaggtcaatgaatatcagatatattttttgactgtacattacagtgaagtgtaatctttttacacctgcaagtccatcttatttattcttgtaaatgttccctgacaatgtttgtaacatggctgtgttaaaaaatctatacaataaagctgtgaccctg

SEQ ID NO: 171928 - DNA, 12746 bp, Homo sapiens
  Payload ID: 13777
  Gene Symbol: PTPRT
  Gene Name: protein tyrosine phosphatase, receptor type, T
  ENST ID: ENST00000373198
  CDS Start-End: 237-4619
ttaggactcgggggacaccgccccccgccccccgcgtcccgcccccgcccagcctcccgcctcagttcgcgccgcgcctcggcttggaacgcaggagcgccggctccgggagcccgagcggagccagccgcgcgcacagccagcggccgcgccggcgatgcggggccaccccgcgcccgccccagtcccggccccggcccccgcgggaaggggctgagctgcccgccgccgcccggatggcgagcctcgccgcgctcgccctcagcctgctcctgaggctgcagctgccgccactgcccggcgcccgggctcagagcgccgcaggtggctgttcctttgatgagcactacagcaactgtggttatagtgtggctctagggaccaatgggttcacctgggagcagattaacacatgggagaaaccaatgctggaccaggcagtgcccacaggatctttcatgatggtgaacagctctgggagagcctctggccagaaggcccaccttctcctgccaaccctgaaggagaatgacacccactgcatcgacttccattactacttctccagccgtgacaggtccagcccaggggccttgaacgtctacgtgaaggtgaatggtggcccccaagggaaccctgtgtggaatgtgtccggggtcgtcactgagggctgggtgaaggcagagctcgccatcagcactttctggccacatttctatcaggtgatatttgaatccgtctcattgaagggtcatcctggctacatcgccgtggacgaggtccgggtccttgctcatccatgcagaaaagcacctcattttctgcgactccaaaacgtggaggtgaatgtggggcagaatgccacatttcagtgcattgctggtgggaagtggtctcagcatgacaagctttggctccagcaatggaatggcagggacacggccctgatggtcacccgtgtggtcaaccacaggcgcttctcagccacagtcagtgtggcagacactgcccagcggagcgtcagcaagtaccgctgtgtgatccgctctgatggtgggtctggtgtgtccaactacgcggagctgatcgtgaaagagcctcccacgcccattgctcccccagagctgctggctgtgggggccacatacctgtggatcaagccaaatgccaactccatcatcggggatggccccatcatcctgaaggaagtggaatatcgcaccaccacaggcacgtgggcagagacccacatagtcgactctcccaactataagctgtggcatctggaccccgatgttgagtatgagatccgagtgctcctcacacgaccaggtgaggggggtacgggaccgccagggcctcccctcaccaccaggaccaagtgtgcagatccggtacatggcccacagaacgtggaaatcgtagacatcagagcccggcagctgaccctgcagtgggagcccttcggctacgcggtgacccgctgccatagctacaacctcaccgtgcagtaccagtatgtgttcaaccagcagcagtacgaggccgaggaggtcatccagacctcctcccactacaccctgcgaggcctgcgccccttcatgaccatccggctgcgactcttgctgtctaaccccgagggccgaatggagagcgaggagctggtggtgcagactgaggaagacgttccaggagctgttcctctagaatccatccaaggggggccctttgaggagaagatctacatccagtggaaacctcccaatgagaccaatggggtcatcacgctctacgagatcaactacaaggctgtcggctcgctggacccaagtgctgacctctcgagccagagggggaaagtgttcaagctccggaatgaaacccaccacctctttgtgggtctgtacccagggaccacctattccttcaccatcaaggccagcacagcaaagggctttgggccccctgtcaccactcggattgccaccaaaatttcagctccatccatgcctgagtacgacacagacaccccattgaatgagacagacacgaccatcacagtgatgctgaaacccgctcagtcccggggagctcctgtcagtgtttatcagctggttgtcaaggaggagcgacttcagaagtcacggagggcagctgacattattgagtgcttttcggtgcccgtgagctatcggaatgcctccagcctcgattctctacactactttgctgctgagttgaagcctgccaacctgcctgtcacccagccatttacagtgggtgacaataagacatacaatggctactggaaccctcctctctctcccctgaaaagctacagcatctacttccaggcactcagcaaagccaatggagagaccaaaatcaactgtgttcgtctggctacaaaagcaccaatgggcagcgcccaggtgaccccggggactccactctgcctcctcaccacaggtgcctccacccagaattctaacactgtggagccagagaagcaggtggacaacaccgtgaagatggctggcgtgatcgctggcctcctcatgttcatcatcattctcctgggcgtgatgctcaccatcaaaaggagaagaaatgcttattcctactcctattacttgaagctggccaagaagcagaaggagacccagagtggagcccagagggagatggggcctgtggcctctgccgacaaacccaccaccaagctcagcgccagccgcaatgatgaaggcttctcttctagttctcaggacgtcaacggattcacagatggcagccgcggggagctttcccagcccaccctcacgatccagactcatccctaccgcacctgtgaccctgtggagatgagctacccccgggaccagttccaacccgccatccgggtggctgacttgctgcagcacatcacgcagatgaagagaggccagggctacgggttcaaggaggaatacgaggccttaccagaggggcagacagcttcgtgggacacagccaaggaggatgaaaaccgcaataagaatcgatatgggaacatcatatcctacgaccattcccgggtgaggctgctggtgctggatggagacccgcactctgactacatcaatgccaactacattgacggataccatcgacctcggcactacattgcgactcaaggtccgatgcaggagactgtaaaggacttttggagaatgatctggcaggagaactccgccagcatcgtcatggtcacaaacctggtggaagtgggcagggtgaaatgtgtgcgatactggccagatgacacggaggtctacggagacattaaagtcaccctgattgaaacagagcccctggcagaatacgtcatacgcaccttcacagtccagaagaaaggctaccatgagatccgggagctccgcctcttccacttcaccagctggcctgaccacggcgttccctgctatgccactggccttctgggcttcgtccgccaggtcaagttcctcaaccccccggaagctgggcccatagtggtccactgcagtgctggggctgggcggactggctgcttcattgccattgacaccatgcttgacatggccgagaatgaaggggtggtggacatcttcaactgcgtgcgtgagctccgggcccaaagggtcaacctggtacagacagaggagcaatatgtgtttgtgcacgatgccatcctggaagcgtgcctctgtggcaacactgccatccctgtgtgtgagttccgttctctctactacaatatcagcaggctggacccccagacaaactccagccaaatcaaagatgaatttcagaccctcaacattgtgacaccccgtgtgcggcccgaggactgcagcattgggctcctgccccggaaccatgataagaatcgaagtatggacgtgctgcctctggaccgctgcctgcccttccttatctcagtggacggagaatccagcaattacatcaacgcagcactgatggatagccacaagcagcctgccgccttcgtggtcacccagcaccctctacccaacaccgtggcagacttctggaggctggtgttcgattacaactgctcctctgtggtgatgctgaatgagatggacactgcccagttctgtatgcagtactggcctgagaagacctccgggtgctatgggcccatccaggtggagttcgtctccgcagacatcgacgaggacatcatccacagaatattccgcatctgtaacatggcccggccacaggatggttatcgtatagtccagcacctccagtacattggctggcctgcctaccgggacacgcccccctccaagcgctctctgctcaaagtggtccgacgactggagaagtggcaggagcagtatgacgggagggagggacgtactgtggtccactgcctaaatgggggaggccgtagtggaaccttctgtgccatctgcagtgtgtgtgagatgatccagcagcaaaacatcattgacgtgttccacatcgtgaaaacactgcgtaacaacaaatccaacatggtggagaccctggaacagtataaatttgtatacgaggtggcactggaatatttaagctccttttagctcaatgggatggggaacctgccggagtccagaggctgctgtgaccaagcccccttttgtgtgaatggcagtaactgggctcaggagctctgaggtggcaccctgcctgactccaaggagaagactggtggccctgtgttccacggggggctctgcaccttctgaggggtctcctgttgccgtgggagatgctgctccaaaaggcccaggcttccttttcaacctaaccagccacagccaagggcccaagcagaagtacacccacaagcaaggccttggatttctggctcccagaccacctgcttttgttctgagtttgtggatctcttggcaagccaactgtgcaggtgctggggagtgggaggctcccctgccctccttctccttaggagtggaggagatgtgtgttctgctcctctacgtcatggaaaagattgaggctcttgggggtcactgctctgctgccccctgcaacctccttcaggggcctctggcaccagacatttgcagtctggaccagtgtgaccttacgatgttccctaggccacaagagaggccccccatcctcacacctaacctgcatggggcttcgcccacaaccattctgtaccccttccccagcctgggccttgaccgtccagcattcactggccggccagctgtgtccacagcagtttttgataaaggtgttctttgcttttttgtgtggtcagtgggagggggtggaactgcagggaacttctctgctcctccttgtctttgtaaaaagggaccacctccctggggcagggcttgggctgacctgtaggatgtaacccctgtgtttctttggtggtagctttctttggaagagacaaacaagataagatttgattattttccaaagtgtatgtgaaaagaaactttcttttggagggtgtaaaatcttagtctcttatgtcaaaaagaagggggcgggggagtttgagtatgtacctctaagacaaatctctcgggccttttattttttcctggcaatgtccttaaaagctcccaccctgggacagcatgccactgagcaaggagagatgggtgagcctgaagatggtccctttggtttctggggcaaatagagcaccagctttgtgcataatttggatgtccaaatttgaactccttcctaaagaaacccagcagccaccttgaaaaaggccattgtggagcccattatactttgatttaaaataggccaagagaatcaggcctggagatctagggtcttgtccaaagtgtgagtgagtcaatgagagggaaccaacatttgctaagtctctactgtatgccagggatcatgcttggcactttccataggacatttcacacagtccttagaacccccaggagagagctactgacttgttatcatctccatttgatcatctcctccaatgaggaaacccacgcaccttccttagtaatgaaatcctgggttccaaaggggcaggtaatggcaatgagacttctccgtgctgttttcttcatcttctctaagccaagcaattattttatggagggaaaataaggccagaaacttctgagcagataactccacaaatggaaatttagtactttcttcctgatgccagttcttctgggaagcgcagaatttcagatatattttagtaacacattcccagctccccaggaaagccagtctcatctaatttcttagtcagtaaaaacaattccctgttccttcaggctatgaatggaccagccagggaaactctcgaccttgatctctagccagtgcttaggcccaatatctgacagcctcaggtgggctgggacctaggaagctccatcttgaaggctggtctagccccagacagggcatgaggggcagagaattcaagaaggtacagctttggccctcaagagcccactgtatgctggggaaatggaaccatggtgcagtagtgtggagtggatgagtgttccatgagcctaggagcaagaaagtctcttcggcctcgggcttcctggagaaggggacgtccattcctgctgggtcttaacaagcataaaaaggaaaaaaaggaaactcaggcaaagggatccatatgtgcaatggcaaagaaatgtgaaaaggcattgggagaagcagtctgggggaggccagcccagtgcgggcacagcacaacacggggagcagcaagagatgagccagggtccaggagacagatgcccatcgcgagtacagactttgtcctattggcaacaaggagtccatggagctttagagagatgcactcagcttcgtgttggccaagactccttctgggccaatggggctgcctcttttcctttcatcagacactgtgaaaacattcccttaagcgtgcactttttaatatcacatctatttgtctgtctgctcattgttttgttgctggaactaaatatgcaatggatcatgagactcagattctatgagaaacccagggtctctgctttaccacggagcagggtcaccaacccagatctccaggcccatgaggatggaacatgaaaggagccgacaaaagttgcttccattggcatgggctctggagctgtccagaagtccagggacaccagacttgatcaaggaagggctgtcactttagaggttcaaaaggaagtgcctcaaagcaaaggcaagcaaaggaaccccacgatgaacttgctcttttcctttgatgagcctctccccaggtgtatttcagcagaccccggggacccacccccactgggcctgctggcctccctcggctccagcccaatgccccagctggccttccccagcctgcaaggagcctgtagcatggcaaatctgcctgctgtatgctattttcttagatcttggtacatccagacaggatgagggtggagggagagctatttaacacaaatcctaagatttttttctgctcaggaaggggtgaaatagctggcagatacaaaagacagtggcttttatcattttaaatggtaggaatttaaggtgtgacttcagggagaaacaaacttgcaaaaaaaaaaaatctcaggccatgttggggtaacccagcaagggccagtgatgatttcccccagctcatccccttattttcccacaacccaaccattctctaaagcaggacagtgaataggtcttaggccagtgcacacaggaagaaattgaggcttatggatggggatgacttccctaagatcccatgggacaaggatgtggcaaggcttggatgagatggggcaccagtgcccaggaatttgaacattttcctttacccaggaaatctccggagccaacaccaccacccccagggggtctccccaccccaccccatttacagggtgagctcagcctgtcatgagcagaggaaaatattattaatgctctctgagtctttacaacaggagctcttacctcatagatgtgggctctgtttggggaagatgcaaggaagtaatgagaagcccaggaaatttctccacctgtgtttatggcctaaatagcttcaggatgtatcttagctgcactccaacattgcatcctttctggggtgaagaatctgggccaaccaggggtccttgggcctctagaaggccacagtaggcctctctttgtgggaatggaaggggacagtttgcttttagtgctggccctctctgtgggtgtggcctgcaaaggaaccaacagaccctatgctggggactctaacatgtgagctcattaaattcttccagcattctaaaggagggtttgtgattgtcaccatttactgatgaggaaactaaggctcctaggggagaaatcacttgcccacagttccacagctagtgagtgaatgaaccaggatttaaaccggttttttctcactacagagacaatatttttccaccattgtatctcacatttttcccaggaggttacccataacagaagagactagagtggaacagatacgtcagtggataaagctcaaagcaaacaacagtaagcttaaaattccttcatagtctcatgttttacgttcacaattcatgcaaaatttgcattccactttctgatttagccttgttggttttaatatgactctatgaatatttcaaaaaaaaatgtgctctgttcctcatgttgttctgttctgttcaccccgctatgacggaccctaggtcagctggtcttcagcttgaccctagaattgactctaggagcagtgaccctgctgcctcccagagccagttataggctcaagatcaagaccaactgaccttctcctaggcagctcctttggtgtgtgggtgctctgacctcactgttcatgaggggacctcaactaaggcatcttccagttgggtgctggaaggaacccattaactcacactagaatgatgaggatttgctcatctggcgtggagaaggatgagcccacaaaaccctaaagggaaaagagaagctggacacagctgtactcagcagattcctgaatgctaggctggaaagtggtgcctgttgtccaagtggagtcacatggttgctaatgtgggcaagtctgaggacacacttcatgagcagctggggtctggaaggctcctcactttaccctagccacacataattactgggtgcctacagcacctagcaccttggagggggcactattaggaaatcgagattactatggcacaattaattcctgggtaaggcatggggttgtggtggacagagctcagtctttagtttgaacgaaaacatacatacatgaaaaacatacatgaaaaaaggaccctcatcaacattagaaggggtagatttggagcactttaggcaggaaaacaggaacgcaaggccaggaaactggaacccagtgaatactcagaaccgaggatgcagatgacttatttagcaaaatggtcacttctgtgacatagctggagaaaggatgggtaacagcttgccagagccacttggaacaagggcaaatctcagtgtctggggcaaaagatgatgcatttccctctgacccatcatgtttattcatcctccactccccattgccacactagctcttgctgtaagtcctcaccaggatctacatttcctcgtcgctggtgggaaccccttagagtacatagaggtatcagtccagtaagactgctctacacaacagaagtgaggcccagggagtagcagccaggcccttatcctgttacctctgcaggagtgactgcccaacccagatccagagacattgaaggaaatgataattccttggtacctcactgccttgggacaaaatgaagaaagccacccttccttaggctgcagcttgccactcctgggctgggtaaacaggtcatcagcaccaagctcaaccaggagtaacactctggaagacatgggtgagcccaagaggaagcatgaacaggacgctgttcctaagtcatgtcaacaggttgtgctgggccaggatccccagggaaaaaaatggtcaacccaactggagggtaggttagaagaaaaaaaacataaacgtggatagtcatgtcatctcaaatccctgacttggcttccccattacttaacagtctgagctccttcttagcctgtgaccagcttcaaatcacagccaagtaaaacaaggaaataggaaaagtaaatccaactagaagagacaagctgagattcagatttgtttactcctcccatgcaaagtttccctgttggaggttttccatgtatacatgtctagaagtgatagaatgcaaggccttggctttgtcttgcagggatctgcctttgaggtcatagactgaacagcagggagagaggttagtggtggagtgtggggggagctgttctagctccagtttcttctgacacatttttcaggatcatggatctgatcctccgaagcacagcagagatatctaagccatatttgtgcacatgagcagactcttctagttttttagtaaccagggatgggcttttgcatggcactgactatagagatgtcttgtagagatcaagccagtcttttgcatcccacctgcccacctccagaagagatgggaaaaggtcatcaaagggcattcaccaactgaaatccactcatgaatgttaggtctctaaaaggaggcatcaacactcacaatggtagcctccaaacctagcatcccacctatctaagagctcaggggtggtccactggggcagatacaagggaagtgcaagggctcaggatgaaagaaaatctattgggaagagttttaggggcttgatcattatggggcttccttctatatctgagaactgctctgggtggtgagatgtggactctgatccttaattggaatgttcggagaatgagtgtctggtggccttgaagtgttggacagaaaagtatcagtataaaagcctggagctcagggtaattaatgtagttcatggttccttagtgagcaggactcttggatgtggaggagaaagggtcataggaagtaaaccaccaaaattacaaaattgagtctctgtacaattacttcagtgcctttgggcttatgaatacaaatcagtgggccttctctatgatggtccaacaaactctcagtgtccaccctgtccctgtatctcccatggaagatgaataatgtcaggtgttctttgggtcaaaggccccagggcagtctggaggcttagagggcagagtggtgtcattccatgtaaagttaggcttctgaggggtcaggcagaatatggtgtccatatcttccatagctctgcagattcttggatgaagtcaagcacagtttgctagacccaggtcactcctctgagtataactaggacccatgagtgaaacttaatagctgtaaggaagaacctgctgtctgccagagaggataagctgcccatctcagcagctgtctaaaagaaggcaggtgtctctttaaagggaagagaagcattggtgaaatggatttcaggtcacttccattccagatgggtgagatcttgtggagctgggatcatgtttgaactcattcatacctgtagagcacgaatccaagtagattgtgtttggtctgtacaggctgaagccccctgctctcccacccaagtgcccccactgagcaggccaacatgctgttgtggccacatatactgggctgatccaggctggttatcaccaaacagcaaaccatagggaacagctgctttgccatagacccaatacccatgtagatctctcatgagagcagccataactcagacccactgaccaacagggccatgagtgacagccagaaccagtgaaggtccaagtaggacacagagcagggcttttcttaccatacacattatctccagaggttatttctaccccactccctattcaaggcctgttggagcacactgcaaaagcaaaagcacagtaactcaatttacacatgattataatcatttccagtgcacacatttcatcaccaggtggatcctgagctagcccatgtaaatccgggttaacccatattggtaatcatactcaaaagcacttttcaccctacattctactagccaatcaaagacaaagagttgtggcctctaccattgccttggcttctggacaccctcacaagctatcccaaggttcccgctcaactccagggaggctgacatcttcacatccactgggcatataatattgcatgagaccaaagtctccacactctttgcagcctcctccatgaatcccaatggcctgcacttgtacagtttgggtgtttgatagataaagcacgtatgagaagagaaaacaaaataaatcaactttttaaaaaagccagcactgtgctgtcaatgttttttttttcttttcaattctagctcagaaaagcagaaggtaaataatgtcaggtcaatgaatatcagatatattttttgactgtacattacagtgaagtgtaatctttttacacctgcaagtccatcttatttattcttgtaaatgttccctgacaatgtttgtaacatggctgtgttaaaaaatctatacaataaagctgtgaccctgagattcatgttttcctaagata

SEQ ID NO: 171929 - DNA, 12660 bp, Homo sapiens
  Payload ID: 13777
  Gene Symbol: PTPRT
  Gene Name: protein tyrosine phosphatase, receptor type, T
  ENST ID: ENST00000373201
  CDS Start-End: 238-4533
gttaggactcgggggacaccgccccccgccccccgcgtcccgcccccgcccagcctcccgcctcagttcgcgccgcgcctcggcttggaacgcaggagcgccggctccgggagcccgagcggagccagccgcgcgcacagccagcggccgcgccggcgatgcggggccaccccgcgcccgccccagtcccggccccggcccccgcgggaaggggctgagctgcccgccgccgcccggatggcgagcctcgccgcgctcgccctcagcctgctcctgaggctgcagctgccgccactgcccggcgcccgggctcagagcgccgcaggtggctgttcctttgatgagcactacagcaactgtggttatagtgtggctctagggaccaatgggttcacctgggagcagattaacacatgggagaaaccaatgctggaccaggcagtgcccacaggatctttcatgatggtgaacagctctgggagagcctctggccagaaggcccaccttctcctgccaaccctgaaggagaatgacacccactgcatcgacttccattactacttctccagccgtgacaggtccagcccaggggccttgaacgtctacgtgaaggtgaatggtggcccccaagggaaccctgtgtggaatgtgtccggggtcgtcactgagggctgggtgaaggcagagctcgccatcagcactttctggccacatttctatcaggtgatatttgaatccgtctcattgaagggtcatcctggctacatcgccgtggacgaggtccgggtccttgctcatccatgcagaaaagcacctcattttctgcgactccaaaacgtggaggtgaatgtggggcagaatgccacatttcagtgcattgctggtgggaagtggtctcagcatgacaagctttggctccagcaatggaatggcagggacacggccctgatggtcacccgtgtggtcaaccacaggcgcttctcagccacagtcagtgtggcagacactgcccagcggagcgtcagcaagtaccgctgtgtgatccgctctgatggtgggtctggtgtgtccaactacgcggagctgatcgtgaaagagcctcccacgcccattgctcccccagagctgctggctgtgggggccacatacctgtggatcaagccaaatgccaactccatcatcggggatggccccatcatcctgaaggaagtggaatatcgcaccaccacaggcacgtgggcagagacccacatagtcgactctcccaactataagctgtggcatctggaccccgatgttgagtatgagatccgagtgctcctcacacgaccaggtgaggggggtacgggaccgccagggcctcccctcaccaccaggaccaagtgtgcagatccggtacatggcccacagaacgtggaaatcgtagacatcagagcccggcagctgaccctgcagtgggagcccttcggctacgcggtgacccgctgccatagctacaacctcaccgtgcagtaccagtatgtgttcaaccagcagcagtacgaggccgaggaggtcatccagacctcctcccactacaccctgcgaggcctgcgccccttcatgaccatccggctgcgactcttgctgtctaaccccgagggccgaatggagagcgaggagctggtggtgcagactgaggaagacgttccaggagctgttcctctagaatccatccaaggggggccctttgaggagaagatctacatccagtggaaacctcccaatgagaccaatggggtcatcacgctctacgagatcaactacaaggctgtcggctcgctggacccaagtgctgacctctcgagccagagggggaaagtgttcaagctccggaatgaaacccaccacctctttgtgggtctgtacccagggaccacctattccttcaccatcaaggccagcacagcaaagggctttgggccccctgtcaccactcggattgccaccaaaatttcagctccatccatgcctgagtacgacacagacaccccattgaatgagacagacacgaccatcacagtgatgctgaaacccgctcagtcccggggagctcctgtcagtgtttatcagctggttgtcaaggaggagcgacttcagaagtcacggagggcagctgacattattgagtgcttttcggtgcccgtgagctatcggaatgcctccagcctcgattctctacactactttgctgctgagttgaagcctgccaacctgcctgtcacccagccatttacagtgggtgacaataagacatacaatggctactggaaccctcctctctctcccctgaaaagctacagcatctacttccaggcactcagcaaagccaatggagagaccaaaatcaactgtgttcgtctggctacaaaaggtgcctccacccagaattctaacactgtggagccagagaagcaggtggacaacaccgtgaagatggctggcgtgatcgctggcctcctcatgttcatcatcattctcctgggcgtgatgctcaccatcaaaaggaggaagctggccaagaagcagaaggagacccagagtggagcccagagggagatggggcctgtggcctctgccgacaaacccaccaccaagctcagcgccagccgcaatgatgaaggcttctcttctagttctcaggacgtcaacggattcacagatggcagccgcggggagctttcccagcccaccctcacgatccagactcatccctaccgcacctgtgaccctgtggagatgagctacccccgggaccagttccaacccgccatccgggtggctgacttgctgcagcacatcacgcagatgaagagaggccagggctacgggttcaaggaggaatacgaggccttaccagaggggcagacagcttcgtgggacacagccaaggaggatgaaaaccgcaataagaatcgatatgggaacatcatatcctacgaccattcccgggtgaggctgctggtgctggatggagacccgcactctgactacatcaatgccaactacattgacggataccatcgacctcggcactacattgcgactcaaggtccgatgcaggagactgtaaaggacttttggagaatgatctggcaggagaactccgccagcatcgtcatggtcacaaacctggtggaagtgggcagggtgaaatgtgtgcgatactggccagatgacacggaggtctacggagacattaaagtcaccctgattgaaacagagcccctggcagaatacgtcatacgcaccttcacagtccagaagaaaggctaccatgagatccgggagctccgcctcttccacttcaccagctggcctgaccacggcgttccctgctatgccactggccttctgggcttcgtccgccaggtcaagttcctcaaccccccggaagctgggcccatagtggtccactgcagtgctggggctgggcggactggctgcttcattgccattgacaccatgcttgacatggccgagaatgaaggggtggtggacatcttcaactgcgtgcgtgagctccgggcccaaagggtcaacctggtacagacagaggagcaatatgtgtttgtgcacgatgccatcctggaagcgtgcctctgtggcaacactgccatccctgtgtgtgagttccgttctctctactacaatatcagcaggctggacccccagacaaactccagccaaatcaaagatgaatttcagaccctcaacattgtgacaccccgtgtgcggcccgaggactgcagcattgggctcctgccccggaaccatgataagaatcgaagtatggacgtgctgcctctggaccgctgcctgcccttccttatctcagtggacggagaatccagcaattacatcaacgcagcactgatggatagccacaagcagcctgccgccttcgtggtcacccagcaccctctacccaacaccgtggcagacttctggaggctggtgttcgattacaactgctcctctgtggtgatgctgaatgagatggacactgcccagttctgtatgcagtactggcctgagaagacctccgggtgctatgggcccatccaggtggagttcgtctccgcagacatcgacgaggacatcatccacagaatattccgcatctgtaacatggcccggccacaggatggttatcgtatagtccagcacctccagtacattggctggcctgcctaccgggacacgcccccctccaagcgctctctgctcaaagtggtccgacgactggagaagtggcaggagcagtatgacgggagggagggacgtactgtggtccactgcctaaatgggggaggccgtagtggaaccttctgtgccatctgcagtgtgtgtgagatgatccagcagcaaaacatcattgacgtgttccacatcgtgaaaacactgcgtaacaacaaatccaacatggtggagaccctggaacagtataaatttgtatacgaggtggcactggaatatttaagctccttttagctcaatgggatggggaacctgccggagtccagaggctgctgtgaccaagcccccttttgtgtgaatggcagtaactgggctcaggagctctgaggtggcaccctgcctgactccaaggagaagactggtggccctgtgttccacggggggctctgcaccttctgaggggtctcctgttgccgtgggagatgctgctccaaaaggcccaggcttccttttcaacctaaccagccacagccaagggcccaagcagaagtacacccacaagcaaggccttggatttctggctcccagaccacctgcttttgttctgagtttgtggatctcttggcaagccaactgtgcaggtgctggggagtgggaggctcccctgccctccttctccttaggagtggaggagatgtgtgttctgctcctctacgtcatggaaaagattgaggctcttgggggtcactgctctgctgccccctgcaacctccttcaggggcctctggcaccagacatttgcagtctggaccagtgtgaccttacgatgttccctaggccacaagagaggccccccatcctcacacctaacctgcatggggcttcgcccacaaccattctgtaccccttccccagcctgggccttgaccgtccagcattcactggccggccagctgtgtccacagcagtttttgataaaggtgttctttgcttttttgtgtggtcagtgggagggggtggaactgcagggaacttctctgctcctccttgtctttgtaaaaagggaccacctccctggggcagggcttgggctgacctgtaggatgtaacccctgtgtttctttggtggtagctttctttggaagagacaaacaagataagatttgattattttccaaagtgtatgtgaaaagaaactttcttttggagggtgtaaaatcttagtctcttatgtcaaaaagaagggggcgggggagtttgagtatgtacctctaagacaaatctctcgggccttttattttttcctggcaatgtccttaaaagctcccaccctgggacagcatgccactgagcaaggagagatgggtgagcctgaagatggtccctttggtttctggggcaaatagagcaccagctttgtgcataatttggatgtccaaatttgaactccttcctaaagaaacccagcagccaccttgaaaaaggccattgtggagcccattatactttgatttaaaataggccaagagaatcaggcctggagatctagggtcttgtccaaagtgtgagtgagtcaatgagagggaaccaacatttgctaagtctctactgtatgccagggatcatgcttggcactttccataggacatttcacacagtccttagaacccccaggagagagctactgacttgttatcatctccatttgatcatctcctccaatgaggaaacccacgcaccttccttagtaatgaaatcctgggttccaaaggggcaggtaatggcaatgagacttctccgtgctgttttcttcatcttctctaagccaagcaattattttatggagggaaaataaggccagaaacttctgagcagataactccacaaatggaaatttagtactttcttcctgatgccagttcttctgggaagcgcagaatttcagatatattttagtaacacattcccagctccccaggaaagccagtctcatctaatttcttagtcagtaaaaacaattccctgttccttcaggctatgaatggaccagccagggaaactctcgaccttgatctctagccagtgcttaggcccaatatctgacagcctcaggtgggctgggacctaggaagctccatcttgaaggctggtctagccccagacagggcatgaggggcagagaattcaagaaggtacagctttggccctcaagagcccactgtatgctggggaaatggaaccatggtgcagtagtgtggagtggatgagtgttccatgagcctaggagcaagaaagtctcttcggcctcgggcttcctggagaaggggacgtccattcctgctgggtcttaacaagcataaaaaggaaaaaaaggaaactcaggcaaagggatccatatgtgcaatggcaaagaaatgtgaaaaggcattgggagaagcagtctgggggaggccagcccagtgcgggcacagcacaacacggggagcagcaagagatgagccagggtccaggagacagatgcccatcgcgagtacagactttgtcctattggcaacaaggagtccatggagctttagagagatgcactcagcttcgtgttggccaagactccttctgggccaatggggctgcctcttttcctttcatcagacactgtgaaaacattcccttaagcgtgcactttttaatatcacatctatttgtctgtctgctcattgttttgttgctggaactaaatatgcaatggatcatgagactcagattctatgagaaacccagggtctctgctttaccacggagcagggtcaccaacccagatctccaggcccatgaggatggaacatgaaaggagccgacaaaagttgcttccattggcatgggctctggagctgtccagaagtccagggacaccagacttgatcaaggaagggctgtcactttagaggttcaaaaggaagtgcctcaaagcaaaggcaagcaaaggaaccccacgatgaacttgctcttttcctttgatgagcctctccccaggtgtatttcagcagaccccggggacccacccccactgggcctgctggcctccctcggctccagcccaatgccccagctggccttccccagcctgcaaggagcctgtagcatggcaaatctgcctgctgtatgctattttcttagatcttggtacatccagacaggatgagggtggagggagagctatttaacacaaatcctaagatttttttctgctcaggaaggggtgaaatagctggcagatacaaaagacagtggcttttatcattttaaatggtaggaatttaaggtgtgacttcagggagaaacaaacttgcaaaaaaaaaaaatctcaggccatgttggggtaacccagcaagggccagtgatgatttcccccagctcatccccttattttcccacaacccaaccattctctaaagcaggacagtgaataggtcttaggccagtgcacacaggaagaaattgaggcttatggatggggatgacttccctaagatcccatgggacaaggatgtggcaaggcttggatgagatggggcaccagtgcccaggaatttgaacattttcctttacccaggaaatctccggagccaacaccaccacccccagggggtctccccaccccaccccatttacagggtgagctcagcctgtcatgagcagaggaaaatattattaatgctctctgagtctttacaacaggagctcttacctcatagatgtgggctctgtttggggaagatgcaaggaagtaatgagaagcccaggaaatttctccacctgtgtttatggcctaaatagcttcaggatgtatcttagctgcactccaacattgcatcctttctggggtgaagaatctgggccaaccaggggtccttgggcctctagaaggccacagtaggcctctctttgtgggaatggaaggggacagtttgcttttagtgctggccctctctgtgggtgtggcctgcaaaggaaccaacagaccctatgctggggactctaacatgtgagctcattaaattcttccagcattctaaaggagggtttgtgattgtcaccatttactgatgaggaaactaaggctcctaggggagaaatcacttgcccacagttccacagctagtgagtgaatgaaccaggatttaaaccggttttttctcactacagagacaatatttttccaccattgtatctcacatttttcccaggaggttacccataacagaagagactagagtggaacagatacgtcagtggataaagctcaaagcaaacaacagtaagcttaaaattccttcatagtctcatgttttacgttcacaattcatgcaaaatttgcattccactttctgatttagccttgttggttttaatatgactctatgaatatttcaaaaaaaaatgtgctctgttcctcatgttgttctgttctgttcaccccgctatgacggaccctaggtcagctggtcttcagcttgaccctagaattgactctaggagcagtgaccctgctgcctcccagagccagttataggctcaagatcaagaccaactgaccttctcctaggcagctcctttggtgtgtgggtgctctgacctcactgttcatgaggggacctcaactaaggcatcttccagttgggtgctggaaggaacccattaactcacactagaatgatgaggatttgctcatctggcgtggagaaggatgagcccacaaaaccctaaagggaaaagagaagctggacacagctgtactcagcagattcctgaatgctaggctggaaagtggtgcctgttgtccaagtggagtcacatggttgctaatgtgggcaagtctgaggacacacttcatgagcagctggggtctggaaggctcctcactttaccctagccacacataattactgggtgcctacagcacctagcaccttggagggggcactattaggaaatcgagattactatggcacaattaattcctgggtaaggcatggggttgtggtggacagagctcagtctttagtttgaacgaaaacatacatacatgaaaaacatacatgaaaaaaggaccctcatcaacattagaaggggtagatttggagcactttaggcaggaaaacaggaacgcaaggccaggaaactggaacccagtgaatactcagaaccgaggatgcagatgacttatttagcaaaatggtcacttctgtgacatagctggagaaaggatgggtaacagcttgccagagccacttggaacaagggcaaatctcagtgtctggggcaaaagatgatgcatttccctctgacccatcatgtttattcatcctccactccccattgccacactagctcttgctgtaagtcctcaccaggatctacatttcctcgtcgctggtgggaaccccttagagtacatagaggtatcagtccagtaagactgctctacacaacagaagtgaggcccagggagtagcagccaggcccttatcctgttacctctgcaggagtgactgcccaacccagatccagagacattgaaggaaatgataattccttggtacctcactgccttgggacaaaatgaagaaagccacccttccttaggctgcagcttgccactcctgggctgggtaaacaggtcatcagcaccaagctcaaccaggagtaacactctggaagacatgggtgagcccaagaggaagcatgaacaggacgctgttcctaagtcatgtcaacaggttgtgctgggccaggatccccagggaaaaaaatggtcaacccaactggagggtaggttagaagaaaaaaaacataaacgtggatagtcatgtcatctcaaatccctgacttggcttccccattacttaacagtctgagctccttcttagcctgtgaccagcttcaaatcacagccaagtaaaacaaggaaataggaaaagtaaatccaactagaagagacaagctgagattcagatttgtttactcctcccatgcaaagtttccctgttggaggttttccatgtatacatgtctagaagtgatagaatgcaaggccttggctttgtcttgcagggatctgcctttgaggtcatagactgaacagcagggagagaggttagtggtggagtgtggggggagctgttctagctccagtttcttctgacacatttttcaggatcatggatctgatcctccgaagcacagcagagatatctaagccatatttgtgcacatgagcagactcttctagttttttagtaaccagggatgggcttttgcatggcactgactatagagatgtcttgtagagatcaagccagtcttttgcatcccacctgcccacctccagaagagatgggaaaaggtcatcaaagggcattcaccaactgaaatccactcatgaatgttaggtctctaaaaggaggcatcaacactcacaatggtagcctccaaacctagcatcccacctatctaagagctcaggggtggtccactggggcagatacaagggaagtgcaagggctcaggatgaaagaaaatctattgggaagagttttaggggcttgatcattatggggcttccttctatatctgagaactgctctgggtggtgagatgtggactctgatccttaattggaatgttcggagaatgagtgtctggtggccttgaagtgttggacagaaaagtatcagtataaaagcctggagctcagggtaattaatgtagttcatggttccttagtgagcaggactcttggatgtggaggagaaagggtcataggaagtaaaccaccaaaattacaaaattgagtctctgtacaattacttcagtgcctttgggcttatgaatacaaatcagtgggccttctctatgatggtccaacaaactctcagtgtccaccctgtccctgtatctcccatggaagatgaataatgtcaggtgttctttgggtcaaaggccccagggcagtctggaggcttagagggcagagtggtgtcattccatgtaaagttaggcttctgaggggtcaggcagaatatggtgtccatatcttccatagctctgcagattcttggatgaagtcaagcacagtttgctagacccaggtcactcctctgagtataactaggacccatgagtgaaacttaatagctgtaaggaagaacctgctgtctgccagagaggataagctgcccatctcagcagctgtctaaaagaaggcaggtgtctctttaaagggaagagaagcattggtgaaatggatttcaggtcacttccattccagatgggtgagatcttgtggagctgggatcatgtttgaactcattcatacctgtagagcacgaatccaagtagattgtgtttggtctgtacaggctgaagccccctgctctcccacccaagtgcccccactgagcaggccaacatgctgttgtggccacatatactgggctgatccaggctggttatcaccaaacagcaaaccatagggaacagctgctttgccatagacccaatacccatgtagatctctcatgagagcagccataactcagacccactgaccaacagggccatgagtgacagccagaaccagtgaaggtccaagtaggacacagagcagggcttttcttaccatacacattatctccagaggttatttctaccccactccctattcaaggcctgttggagcacactgcaaaagcaaaagcacagtaactcaatttacacatgattataatcatttccagtgcacacatttcatcaccaggtggatcctgagctagcccatgtaaatccgggttaacccatattggtaatcatactcaaaagcacttttcaccctacattctactagccaatcaaagacaaagagttgtggcctctaccattgccttggcttctggacaccctcacaagctatcccaaggttcccgctcaactccagggaggctgacatcttcacatccactgggcatataatattgcatgagaccaaagtctccacactctttgcagcctcctccatgaatcccaatggcctgcacttgtacagtttgggtgtttgatagataaagcacgtatgagaagagaaaacaaaataaatcaactttttaaaaaagccagcactgtgctgtcaatgttttttttttcttttcaattctagctcagaaaagcagaaggtaaataatgtcaggtcaatgaatatcagatatattttttgactgtacattacagtgaagtgtaatctttttacacctgcaagtccatcttatttattcttgtaaatgttccctgacaatgtttgtaacatggctgtgttaaaaaatctatacaataaagctgtgaccctgagattcatgttttcctaagata

SEQ ID NO: 171930 - DNA, 940 bp, Homo sapiens
  Payload ID: 13777
  Gene Symbol: PTPRT
  Gene Name: protein tyrosine phosphatase, receptor type, T
  ENST ID: ENST00000620410
  CDS Start-End: 1-940
ggatctttcatgatggtgaacagctctgggagagcctctggccagaaggcccaccttctcctgccaaccctgaaggagaatgacacccactgcatcgacttccattactacttctccagccgtgacaggtccagcccaggggccttgaacgtctacgtgaaggtgaatggtggcccccaagggaaccctgtgtggaatgtgtccggggtcgtcactgagggctgggtgaaggcagagctcgccatcagcactttctggccacatttctatcaggtgatatttgaatccgtctcattgaagggtcatcctggctacatcgccgtggacgaggtccgggtccttgctcatccatgcagaaaagcacctcattttctgcgactccaaaacgtggaggtgaatgtggggcagaatgccacatttcagtgcattgctggtgggaagtggtctcagcatgacaagctttggctccagcaatggaatggcagggacacggccctgatggtcacccgtgtggtcaaccacaggcgcttctcagccacagtcagtgtggcagacactgcccagcggagcgtcagcaagtaccgctgtgtgatccgctctgatggtgggtctggtgtgtccaactacgcggagctgatcgtgaaagagcctcccacgcccattgctcccccagagctgctggctgtgggggccacatacctgtggatcaagccaaatgccaactccatcatcggggatggccccatcatcctgaaggaagtggaatatcgcaccaccacaggcacgtgggcagagacccacatagtcgactctcccaactataagctgtggcatctggaccccgatgttgagtatgagatccgagtgctcctcacacgaccaggtgaggggggtacgggaccgccagggcctcccctcaccaccaggaccaagtgtgcag

SEQ ID NO: 171931 - DNA, 11285 bp, Homo sapiens
  Payload ID: 13777
  Gene Symbol: PTPRT
  Gene Name: protein tyrosine phosphatase, receptor type, T
  ENST ID: ENST00000612229
  CDS Start-End: 1-3180
tttgcagatccggtacatggcccacagaacgtggaaatcgtagacatcagagcccggcagctgaccctgcagtgggagcccttcggctacgcggtgacccgctgccatagctacaacctcaccgtgcagtaccagtatgtgttcaaccagcagcagtacgaggccgaggaggtcatccagacctcctcccactacaccctgcgaggcctgcgccccttcatgaccatccggctgcgactcttgctgtctaaccccgagggccgaatggagagcgaggagctggtggtgcagactgaggaagacgttccaggagctgttcctctagaatccatccaaggggggccctttgaggagaagatctacatccagtggaaacctcccaatgagaccaatggggtcatcacgctctacgagatcaactacaaggctgtcggctcgctggacccaagtgctgacctctcgagccagagggggaaagtgttcaagctccggaatgaaacccaccacctctttgtgggtctgtacccagggaccacctattccttcaccatcaaggccagcacagcaaagggctttgggccccctgtcaccactcggattgccaccaaaatttcagctccatccatgcctgagtacgacacagacaccccattgaatgagacagacacgaccatcacagtgatgctgaaacccgctcagtcccggggagctcctgtcagtgtttatcagctggttgtcaaggaggagcgacttcagaagtcacggagggcagctgacattattgagtgcttttcggtgcccgtgagctatcggaatgcctccagcctcgattctctacactactttgctgctgagttgaagcctgccaacctgcctgtcacccagccatttacagtgggtgacaataagacatacaatggctactggaaccctcctctctctcccctgaaaagctacagcatctacttccaggcactcagcaaagccaatggagagaccaaaatcaactgtgttcgtctggctacaaaaggtgcctccacccagaattctaacactgtggagccagagaagcaggtggacaacaccgtgaagatggctggcgtgatcgctggcctcctcatgttcatcatcattctcctgggcgtgatgctcaccatcaaaaggagaagaaatgcttattcctactcctattacttgaagctggccaagaagcagaaggagacccagagtggagcccagagggagatggggcctgtggcctctgccgacaaacccaccaccaagctcagcgccagccgcaatgatgaaggcttctcttctagttctcaggacgtcaacggattcacagatggcagccgcggggagctttcccagcccaccctcacgatccagactcatccctaccgcacctgtgaccctgtggagatgagctacccccgggaccagttccaacccgccatccgggtggctgacttgctgcagcacatcacgcagatgaagagaggccagggctacgggttcaaggaggaatacgaggccttaccagaggggcagacagcttcgtgggacacagccaaggaggatgaaaaccgcaataagaatcgatatgggaacatcatatcctacgaccattcccgggtgaggctgctggtgctggatggagacccgcactctgactacatcaatgccaactacattgacggataccatcgacctcggcactacattgcgactcaaggtccgatgcaggagactgtaaaggacttttggagaatgatctggcaggagaactccgccagcatcgtcatggtcacaaacctggtggaagtgggcagggtgaaatgtgtgcgatactggccagatgacacggaggtctacggagacattaaagtcaccctgattgaaacagagcccctggcagaatacgtcatacgcaccttcacagtccagaagaaaggctaccatgagatccgggagctccgcctcttccacttcaccagctggcctgaccacggcgttccctgctatgccactggccttctgggcttcgtccgccaggtcaagttcctcaaccccccggaagctgggcccatagtggtccactgcagtgctggggctgggcggactggctgcttcattgccattgacaccatgcttgacatggccgagaatgaaggggtggtggacatcttcaactgcgtgcgtgagctccgggcccaaagggtcaacctggtacagacagaggagcaatatgtgtttgtgcacgatgccatcctggaagcgtgcctctgtggcaacactgccatccctgtgtgtgagttccgttctctctactacaatatcagcaggctggacccccagacaaactccagccaaatcaaagatgaatttcagaccctcaacattgtgacaccccgtgtgcggcccgaggactgcagcattgggctcctgccccggaaccatgataagaatcgaagtatggacgtgctgcctctggaccgctgcctgcccttccttatctcagtggacggagaatccagcaattacatcaacgcagcactgatggatagccacaagcagcctgccgccttcgtggtcacccagcaccctctacccaacaccgtggcagacttctggaggctggtgttcgattacaactgctcctctgtggtgatgctgaatgagatggacactgcccagttctgtatgcagtactggcctgagaagacctccgggtgctatgggcccatccaggtggagttcgtctccgcagacatcgacgaggacatcatccacagaatattccgcatctgtaacatggcccggccacaggatggttatcgtatagtccagcacctccagtacattggctggcctgcctaccgggacacgcccccctccaagcgctctctgctcaaagtggtccgacgactggagaagtggcaggagcagtatgacgggagggagggacgtactgtggtccactgcctaaatgggggaggccgtagtggaaccttctgtgccatctgcagtgtgtgtgagatgatccagcagcaaaacatcattgacgtgttccacatcgtgaaaacactgcgtaacaacaaatccaacatggtggagaccctggaacagtataaatttgtatacgaggtggcactggaatatttaagctccttttagctcaatgggatggggaacctgccggagtccagaggctgctgtgaccaagcccccttttgtgtgaatggcagtaactgggctcaggagctctgaggtggcaccctgcctgactccaaggagaagactggtggccctgtgttccacggggggctctgcaccttctgaggggtctcctgttgccgtgggagatgctgctccaaaaggcccaggcttccttttcaacctaaccagccacagccaagggcccaagcagaagtacacccacaagcaaggccttggatttctggctcccagaccacctgcttttgttctgagtttgtggatctcttggcaagccaactgtgcaggtgctggggagtgggaggctcccctgccctccttctccttaggagtggaggagatgtgtgttctgctcctctacgtcatggaaaagattgaggctcttgggggtcactgctctgctgccccctgcaacctccttcaggggcctctggcaccagacatttgcagtctggaccagtgtgaccttacgatgttccctaggccacaagagaggccccccatcctcacacctaacctgcatggggcttcgcccacaaccattctgtaccccttccccagcctgggccttgaccgtccagcattcactggccggccagctgtgtccacagcagtttttgataaaggtgttctttgcttttttgtgtggtcagtgggagggggtggaactgcagggaacttctctgctcctccttgtctttgtaaaaagggaccacctccctggggcagggcttgggctgacctgtaggatgtaacccctgtgtttctttggtggtagctttctttggaagagacaaacaagataagatttgattattttccaaagtgtatgtgaaaagaaactttcttttggagggtgtaaaatcttagtctcttatgtcaaaaagaagggggcgggggagtttgagtatgtacctctaagacaaatctctcgggccttttattttttcctggcaatgtccttaaaagctcccaccctgggacagcatgccactgagcaaggagagatgggtgagcctgaagatggtccctttggtttctggggcaaatagagcaccagctttgtgcataatttggatgtccaaatttgaactccttcctaaagaaacccagcagccaccttgaaaaaggccattgtggagcccattatactttgatttaaaataggccaagagaatcaggcctggagatctagggtcttgtccaaagtgtgagtgagtcaatgagagggaaccaacatttgctaagtctctactgtatgccagggatcatgcttggcactttccataggacatttcacacagtccttagaacccccaggagagagctactgacttgttatcatctccatttgatcatctcctccaatgaggaaacccacgcaccttccttagtaatgaaatcctgggttccaaaggggcaggtaatggcaatgagacttctccgtgctgttttcttcatcttctctaagccaagcaattattttatggagggaaaataaggccagaaacttctgagcagataactccacaaatggaaatttagtactttcttcctgatgccagttcttctgggaagcgcagaatttcagatatattttagtaacacattcccagctccccaggaaagccagtctcatctaatttcttagtcagtaaaaacaattccctgttccttcaggctatgaatggaccagccagggaaactctcgaccttgatctctagccagtgcttaggcccaatatctgacagcctcaggtgggctgggacctaggaagctccatcttgaaggctggtctagccccagacagggcatgaggggcagagaattcaagaaggtacagctttggccctcaagagcccactgtatgctggggaaatggaaccatggtgcagtagtgtggagtggatgagtgttccatgagcctaggagcaagaaagtctcttcggcctcgggcttcctggagaaggggacgtccattcctgctgggtcttaacaagcataaaaaggaaaaaaaggaaactcaggcaaagggatccatatgtgcaatggcaaagaaatgtgaaaaggcattgggagaagcagtctgggggaggccagcccagtgcgggcacagcacaacacggggagcagcaagagatgagccagggtccaggagacagatgcccatcgcgagtacagactttgtcctattggcaacaaggagtccatggagctttagagagatgcactcagcttcgtgttggccaagactccttctgggccaatggggctgcctcttttcctttcatcagacactgtgaaaacattcccttaagcgtgcactttttaatatcacatctatttgtctgtctgctcattgttttgttgctggaactaaatatgcaatggatcatgagactcagattctatgagaaacccagggtctctgctttaccacggagcagggtcaccaacccagatctccaggcccatgaggatggaacatgaaaggagccgacaaaagttgcttccattggcatgggctctggagctgtccagaagtccagggacaccagacttgatcaaggaagggctgtcactttagaggttcaaaaggaagtgcctcaaagcaaaggcaagcaaaggaaccccacgatgaacttgctcttttcctttgatgagcctctccccaggtgtatttcagcagaccccggggacccacccccactgggcctgctggcctccctcggctccagcccaatgccccagctggccttccccagcctgcaaggagcctgtagcatggcaaatctgcctgctgtatgctattttcttagatcttggtacatccagacaggatgagggtggagggagagctatttaacacaaatcctaagatttttttctgctcaggaaggggtgaaatagctggcagatacaaaagacagtggcttttatcattttaaatggtaggaatttaaggtgtgacttcagggagaaacaaacttgcaaaaaaaaaaaatctcaggccatgttggggtaacccagcaagggccagtgatgatttcccccagctcatccccttattttcccacaacccaaccattctctaaagcaggacagtgaataggtcttaggccagtgcacacaggaagaaattgaggcttatggatggggatgacttccctaagatcccatgggacaaggatgtggcaaggcttggatgagatggggcaccagtgcccaggaatttgaacattttcctttacccaggaaatctccggagccaacaccaccacccccagggggtctccccaccccaccccatttacagggtgagctcagcctgtcatgagcagaggaaaatattattaatgctctctgagtctttacaacaggagctcttacctcatagatgtgggctctgtttggggaagatgcaaggaagtaatgagaagcccaggaaatttctccacctgtgtttatggcctaaatagcttcaggatgtatcttagctgcactccaacattgcatcctttctggggtgaagaatctgggccaaccaggggtccttgggcctctagaaggccacagtaggcctctctttgtgggaatggaaggggacagtttgcttttagtgctggccctctctgtgggtgtggcctgcaaaggaaccaacagaccctatgctggggactctaacatgtgagctcattaaattcttccagcattctaaaggagggtttgtgattgtcaccatttactgatgaggaaactaaggctcctaggggagaaatcacttgcccacagttccacagctagtgagtgaatgaaccaggatttaaaccggttttttctcactacagagacaatatttttccaccattgtatctcacatttttcccaggaggttacccataacagaagagactagagtggaacagatacgtcagtggataaagctcaaagcaaacaacagtaagcttaaaattccttcatagtctcatgttttacgttcacaattcatgcaaaatttgcattccactttctgatttagccttgttggttttaatatgactctatgaatatttcaaaaaaaaatgtgctctgttcctcatgttgttctgttctgttcaccccgctatgacggaccctaggtcagctggtcttcagcttgaccctagaattgactctaggagcagtgaccctgctgcctcccagagccagttataggctcaagatcaagaccaactgaccttctcctaggcagctcctttggtgtgtgggtgctctgacctcactgttcatgaggggacctcaactaaggcatcttccagttgggtgctggaaggaacccattaactcacactagaatgatgaggatttgctcatctggcgtggagaaggatgagcccacaaaaccctaaagggaaaagagaagctggacacagctgtactcagcagattcctgaatgctaggctggaaagtggtgcctgttgtccaagtggagtcacatggttgctaatgtgggcaagtctgaggacacacttcatgagcagctggggtctggaaggctcctcactttaccctagccacacataattactgggtgcctacagcacctagcaccttggagggggcactattaggaaatcgagattactatggcacaattaattcctgggtaaggcatggggttgtggtggacagagctcagtctttagtttgaacgaaaacatacatacatgaaaaacatacatgaaaaaaggaccctcatcaacattagaaggggtagatttggagcactttaggcaggaaaacaggaacgcaaggccaggaaactggaacccagtgaatactcagaaccgaggatgcagatgacttatttagcaaaatggtcacttctgtgacatagctggagaaaggatgggtaacagcttgccagagccacttggaacaagggcaaatctcagtgtctggggcaaaagatgatgcatttccctctgacccatcatgtttattcatcctccactccccattgccacactagctcttgctgtaagtcctcaccaggatctacatttcctcgtcgctggtgggaaccccttagagtacatagaggtatcagtccagtaagactgctctacacaacagaagtgaggcccagggagtagcagccaggcccttatcctgttacctctgcaggagtgactgcccaacccagatccagagacattgaaggaaatgataattccttggtacctcactgccttgggacaaaatgaagaaagccacccttccttaggctgcagcttgccactcctgggctgggtaaacaggtcatcagcaccaagctcaaccaggagtaacactctggaagacatgggtgagcccaagaggaagcatgaacaggacgctgttcctaagtcatgtcaacaggttgtgctgggccaggatccccagggaaaaaaatggtcaacccaactggagggtaggttagaagaaaaaaaacataaacgtggatagtcatgtcatctcaaatccctgacttggcttccccattacttaacagtctgagctccttcttagcctgtgaccagcttcaaatcacagccaagtaaaacaaggaaataggaaaagtaaatccaactagaagagacaagctgagattcagatttgtttactcctcccatgcaaagtttccctgttggaggttttccatgtatacatgtctagaagtgatagaatgcaaggccttggctttgtcttgcagggatctgcctttgaggtcatagactgaacagcagggagagaggttagtggtggagtgtggggggagctgttctagctccagtttcttctgacacatttttcaggatcatggatctgatcctccgaagcacagcagagatatctaagccatatttgtgcacatgagcagactcttctagttttttagtaaccagggatgggcttttgcatggcactgactatagagatgtcttgtagagatcaagccagtcttttgcatcccacctgcccacctccagaagagatgggaaaaggtcatcaaagggcattcaccaactgaaatccactcatgaatgttaggtctctaaaaggaggcatcaacactcacaatggtagcctccaaacctagcatcccacctatctaagagctcaggggtggtccactggggcagatacaagggaagtgcaagggctcaggatgaaagaaaatctattgggaagagttttaggggcttgatcattatggggcttccttctatatctgagaactgctctgggtggtgagatgtggactctgatccttaattggaatgttcggagaatgagtgtctggtggccttgaagtgttggacagaaaagtatcagtataaaagcctggagctcagggtaattaatgtagttcatggttccttagtgagcaggactcttggatgtggaggagaaagggtcataggaagtaaaccaccaaaattacaaaattgagtctctgtacaattacttcagtgcctttgggcttatgaatacaaatcagtgggccttctctatgatggtccaacaaactctcagtgtccaccctgtccctgtatctcccatggaagatgaataatgtcaggtgttctttgggtcaaaggccccagggcagtctggaggcttagagggcagagtggtgtcattccatgtaaagttaggcttctgaggggtcaggcagaatatggtgtccatatcttccatagctctgcagattcttggatgaagtcaagcacagtttgctagacccaggtcactcctctgagtataactaggacccatgagtgaaacttaatagctgtaaggaagaacctgctgtctgccagagaggataagctgcccatctcagcagctgtctaaaagaaggcaggtgtctctttaaagggaagagaagcattggtgaaatggatttcaggtcacttccattccagatgggtgagatcttgtggagctgggatcatgtttgaactcattcatacctgtagagcacgaatccaagtagattgtgtttggtctgtacaggctgaagccccctgctctcccacccaagtgcccccactgagcaggccaacatgctgttgtggccacatatactgggctgatccaggctggttatcaccaaacagcaaaccatagggaacagctgctttgccatagacccaatacccatgtagatctctcatgagagcagccataactcagacccactgaccaacagggccatgagtgacagccagaaccagtgaaggtccaagtaggacacagagcagggcttttcttaccatacacattatctccagaggttatttctaccccactccctattcaaggcctgttggagcacactgcaaaagcaaaagcacagtaactcaatttacacatgattataatcatttccagtgcacacatttcatcaccaggtggatcctgagctagcccatgtaaatccgggttaacccatattggtaatcatactcaaaagcacttttcaccctacattctactagccaatcaaagacaaagagttgtggcctctaccattgccttggcttctggacaccctcacaagctatcccaaggttcccgctcaactccagggaggctgacatcttcacatccactgggcatataatattgcatgagaccaaagtctccacactctttgcagcctcctccatgaatcccaatggcctgcacttgtacagtttgggtgtttgatagataaagcacgtatgagaagagaaaacaaaataaatcaactttttaaaaaagccagcactgtgctgtcaatgttttttttttcttttcaattctagctcagaaaagcagaaggtaaataatgtcaggtcaatgaatatcagatatattttttgactgtacattacagtgaagtgtaatctttttacacctgcaagtccatcttatttattcttgtaaatgttccctgacaatgtttgtaacatggctgtgttaaaaaatctatacaataaagctgtgaccctg

SEQ ID NO: 171932 - DNA, 4521 bp, Homo sapiens
  Payload ID: 13777
  Gene Symbol: PTPRT
  Gene Name: protein tyrosine phosphatase, receptor type, T
  ENST ID: ENST00000617474
  CDS Start-End: 185-328
cctcccgcctcagttcgcgccgcgcctcggcttggaacgcaggagcgccggctccgggagcccgagcggagccagccgcgcgcacagccagcggccgcgccggcgatgcggggccaccccgcgcccgccccagtcccggccccggcccccgcgggaaggggctgagctgcccgccgccgcccggatggcgagcctcgccgcgctcgccctcagcctgctcctgaggctgcagctgccgccactgcccggcgcccgggctcagagcgccgcaggtgtggctgttcctttgatgagcactacagcaactgtggttatagtgtggctctagggaccaatgggttcacctgggagcagattaacacatgggagaaaccaatgctggaccaggcagtgcccacaggatctttcatgatggtgaacagctctgggagagcctctggccagaaggcccaccttctcctgccaaccctgaaggagaatgacacccactgcatcgacttccattactacttctccagccgtgacaggtccagcccaggggccttgaacgtctacgtgaaggtgaatggtggcccccaagggaaccctgtgtggaatgtgtccggggtcgtcactgagggctgggtgaaggcagagctcgccatcagcactttctggccacatttctatcaggtgatatttgaatccgtctcattgaagggtcatcctggctacatcgccgtggacgaggtccgggtccttgctcatccatgcagaaaagcacctcattttctgcgactccaaaacgtggaggtgaatgtggggcagaatgccacatttcagtgcattgctggtgggaagtggtctcagcatgacaagctttggctccagcaatggaatggcagggacacggccctgatggtcacccgtgtggtcaaccacaggcgcttctcagccacagtcagtgtggcagacactgcccagcggagcgtcagcaagtaccgctgtgtgatccgctctgatggtgggtctggtgtgtccaactacgcggagctgatcgtgaaagagcctcccacgcccattgctcccccagagctgctggctgtgggggccacatacctgtggatcaagccaaatgccaactccatcatcggggatggccccatcatcctgaaggaagtggaatatcgcaccaccacaggcacgtgggcagagacccacatagtcgactctcccaactataagctgtggcatctggaccccgatgttgagtatgagatccgagtgctcctcacacgaccaggtgaggggggtacgggaccgccagggcctcccctcaccaccaggaccaagtgtgcagatccggtacatggcccacagaacgtggaaatcgtagacatcagagcccggcagctgaccctgcagtgggagcccttcggctacgcggtgacccgctgccatagctacaacctcaccgtgcagtaccagtatgtgttcaaccagcagcagtacgaggccgaggaggtcatccagacctcctcccactacaccctgcgaggcctgcgccccttcatgaccatccggctgcgactcttgctgtctaaccccgagggccgaatggagagcgaggagctggtggtgcagactgaggaagacgttccaggagctgttcctctagaatccatccaaggggggccctttgaggagaagatctacatccagtggaaacctcccaatgagaccaatggggtcatcacgctctacgagatcaactacaaggctgtcggctcgctggacccaagtgctgacctctcgagccagagggggaaagtgttcaagctccggaatgaaacccaccacctctttgtgggtctgtacccagggaccacctattccttcaccatcaaggccagcacagcaaagggctttgggccccctgtcaccactcggattgccaccaaaatttcagctccatccatgcctgagtacgacacagacaccccattgaatgagacagacacgaccatcacagtgatgctgaaacccgctcagtcccggggagctcctgtcagtgtttatcagctggttgtcaaggaggagcgacttcagaagtcacggagggcagctgacattattgagtgcttttcggtgcccgtgagctatcggaatgcctccagcctcgattctctacactactttgctgctgagttgaagcctgccaacctgcctgtcacccagccatttacagtgggtgacaataagacatacaatggctactggaaccctcctctctctcccctgaaaagctacagcatctacttccaggcactcagcaaagccaatggagagaccaaaatcaactgtgttcgtctggctacaaaaggtgcctccacccagaattctaacactgtggagccagagaagcaggtggacaacaccgtgaagatggctggcgtgatcgctggcctcctcatgttcatcatcattctcctgggcgtgatgctcaccatcaaaaggagaagaaatgcttattcctactcctattacttgtcccaaaggaagctggccaagaagcagaaggagacccagagtggagcccagagggagatggggcctgtggcctctgccgacaaacccaccaccaagctcagcgccagccgcaatgatgaaggcttctcttctagttctcaggacgtcaacggattcacagatggcagccgcggggagctttcccagcccaccctcacgatccagactcatccctaccgcacctgtgaccctgtggagatgagctacccccgggaccagttccaacccgccatccgggtggctgacttgctgcagcacatcacgcagatgaagagaggccagggctacgggttcaaggaggaatacgaggccttaccagaggggcagacagcttcgtgggacacagccaaggaggatgaaaaccgcaataagaatcgatatgggaacatcatatcctacgaccattcccgggtgaggctgctggtgctggatggagacccgcactctgactacatcaatgccaactacattgacggataccatcgacctcggcactacattgcgactcaaggtccgatgcaggagactgtaaaggacttttggagaatgatctggcaggagaactccgccagcatcgtcatggtcacaaacctggtggaagtgggcagggtgaaatgtgtgcgatactggccagatgacacggaggtctacggagacattaaagtcaccctgattgaaacagagcccctggcagaatacgtcatacgcaccttcacagtccagaagaaaggctaccatgagatccgggagctccgcctcttccacttcaccagctggcctgaccacggcgttccctgctatgccactggccttctgggcttcgtccgccaggtcaagttcctcaaccccccggaagctgggcccatagtggtccactgcagtgctggggctgggcggactggctgcttcattgccattgacaccatgcttgacatggccgagaatgaaggggtggtggacatcttcaactgcgtgcgtgagctccgggcccaaagggtcaacctggtacagacagaggagcaatatgtgtttgtgcacgatgccatcctggaagcgtgcctctgtggcaacactgccatccctgtgtgtgagttccgttctctctactacaatatcagcaggctggacccccagacaaactccagccaaatcaaagatgaatttcagaccctcaacattgtgacaccccgtgtgcggcccgaggactgcagcattgggctcctgccccggaaccatgataagaatcgaagtatggacgtgctgcctctggaccgctgcctgcccttccttatctcagtggacggagaatccagcaattacatcaacgcagcactgatggatagccacaagcagcctgccgccttcgtggtcacccagcaccctctacccaacaccgtggcagacttctggaggctggtgttcgattacaactgctcctctgtggtgatgctgaatgagatggacactgcccagttctgtatgcagtactggcctgagaagacctccgggtgctatgggcccatccaggtggagttcgtctccgcagacatcgacgaggacatcatccacagaatattccgcatctgtaacatggcccggccacaggatggttatcgtatagtccagcacctccagtacattggctggcctgcctaccgggacacgcccccctccaagcgctctctgctcaaagtggtccgacgactggagaagtggcaggagcagtatgacgggagggagggacgtactgtggtccactgcctaaatgggggaggccgtagtggaaccttctgtgccatctgcagtgtgtgtgagatgatccagcagcaaaacatcattgacgtgttccacatcgtgaaaacactgcgtaacaacaaatccaacatggtggagaccctggaacagtataaatttgtatacgaggtggcactggaatatttaagctccttttag

SEQ ID NO: 171933 - DNA, 3230 bp, Homo sapiens
  Payload ID: 13777
  Gene Symbol: PTPRT
  Gene Name: protein tyrosine phosphatase, receptor type, T
  ENST ID: ENST00000618610
  CDS Start-End: 1-3230
atccggtacatggcccacagaacgtggaaatcgtagacatcagagcccggcagctgaccctgcagtgggagcccttcggctacgcggtgacccgctgccatagctacaacctcaccgtgcagtaccagtatgtgttcaaccagcagcagtacgaggccgaggaggtcatccagacctcctcccactacaccctgcgaggcctgcgccccttcatgaccatccggctgcgactcttgctgtctaaccccgagggccgaatggagagcgaggagctggtggtgcagactgaggaagacgttccaggagctgttcctctagaatccatccaaggggggccctttgaggagaagatctacatccagtggaaacctcccaatgagaccaatggggtcatcacgctctacgagatcaactacaaggctgtcggctcgctggacccaagtgctgacctctcgagccagagggggaaagtgttcaagctccggaatgaaacccaccacctctttgtgggtctgtacccagggaccacctattccttcaccatcaaggccagcacagcaaagggctttgggccccctgtcaccactcggattgccaccaaaatttcagctccatccatgcctgagtacgacacagacaccccattgaatgagacagacacgaccatcacagtgatgctgaaacccgctcagtcccggggagctcctgtcagtgtttatcagctggttgtcaaggaggagcgacttcagaagtcacggagggcagctgacattattgagtgcttttcggtgcccgtgagctatcggaatgcctccagcctcgattctctacactactttgctgctgagttgaagcctgccaacctgcctgtcacccagccatttacagtgggtgacaataagacatacaatggctactggaaccctcctctctctcccctgaaaagctacagcatctacttccaggcactcagcaaagccaatggagagaccaaaatcaactgtgttcgtctggctacaaaagcaccaatgggcagcgcccaggtgaccccggggactccactctgcctcctcaccacaggtgcctccacccagaattctaacactgtggagccagagaagcaggtggacaacaccgtgaagatggctggcgtgatcgctggcctcctcatgttcatcatcattctcctgggcgtgatgctcaccatcaaaaggagaagaaatgcttattcctactcctattacttgaagctggccaagaagcagaaggagacccagagtggagcccagagggagatggggcctgtggcctctgccgacaaacccaccaccaagctcagcgccagccgcaatgatgaaggcttctcttctagttctcaggacgtcaacggattcacagatggcagccgcggggagctttcccagcccaccctcacgatccagactcatccctaccgcacctgtgaccctgtggagatgagctacccccgggaccagttccaacccgccatccgggtggctgacttgctgcagcacatcacgcagatgaagagaggccagggctacgggttcaaggaggaatacgaggccttaccagaggggcagacagcttcgtgggacacagccaaggaggatgaaaaccgcaataagaatcgatatgggaacatcatatcctacgaccattcccgggtgaggctgctggtgctggatggagacccgcactctgactacatcaatgccaactacattgacggataccatcgacctcggcactacattgcgactcaaggtccgatgcaggagactgtaaaggacttttggagaatgatctggcaggagaactccgccagcatcgtcatggtcacaaacctggtggaagtgggcagggtgaaatgtgtgcgatactggccagatgacacggaggtctacggagacattaaagtcaccctgattgaaacagagcccctggcagaatacgtcatacgcaccttcacagtccagaagaaaggctaccatgagatccgggagctccgcctcttccacttcaccagctggcctgaccacggcgttccctgctatgccactggccttctgggcttcgtccgccaggtcaagttcctcaaccccccggaagctgggcccatagtggtccactgcagtgctggggctgggcggactggctgcttcattgccattgacaccatgcttgacatggccgagaatgaaggggtggtggacatcttcaactgcgtgcgtgagctccgggcccaaagggtcaacctggtacagacagaggagcaatatgtgtttgtgcacgatgccatcctggaagcgtgcctctgtggcaacactgccatccctgtgtgtgagttccgttctctctactacaatatcagcaggctggacccccagacaaactccagccaaatcaaagatgaatttcagaccctcaacattgtgacaccccgtgtgcggcccgaggactgcagcattgggctcctgccccggaaccatgataagaatcgaagtatggacgtgctgcctctggaccgctgcctgcccttccttatctcagtggacggagaatccagcaattacatcaacgcagcactgatggatagccacaagcagcctgccgccttcgtggtcacccagcaccctctacccaacaccgtggcagacttctggaggctggtgttcgattacaactgctcctctgtggtgatgctgaatgagatggacactgcccagttctgtatgcagtactggcctgagaagacctccgggtgctatgggcccatccaggtggagttcgtctccgcagacatcgacgaggacatcatccacagaatattccgcatctgtaacatggcccggccacaggatggttatcgtatagtccagcacctccagtacattggctggcctgcctaccgggacacgcccccctccaagcgctctctgctcaaagtggtccgacgactggagaagtggcaggagcagtatgacgggagggagggacgtactgtggtccactgcctaaatgggggaggccgtagtggaaccttctgtgccatctgcagtgtgtgtgagatgatccagcagcaaaacatcattgacgtgttccacatcgtgaaaacactgcgtaacaacaaatccaacatggtggagaccctggaacagtataaatttgtatacgaggtggcactggaatatttaagctccttttag

SEQ ID NO: 171934 - DNA, 4470 bp, Homo sapiens
  Payload ID: 13778
  Gene Symbol: PTPRU
  Gene Name: protein tyrosine phosphatase, receptor type, U
  Uniprot ID: Q92729
  ENST ID: ENST00000345512
  CDS Start-End: 130-4470
ggcgccagtcccgctccgcgccgcgccgctccgctccggctcgggctccggctcgcctcgggctgggctcgggctccgggggcggcgtcccccgcgccgggccccgggacgggcggcgacgctccaaccatggcccgtgcccaggcgctcgtgctggcactcaccttccagctctgcgcgccggagaccgagactccggcagctggctgcaccttcgaggaggcaagtgacccagcagtgccctgcgagtacagccaggcccagtacgatgacttccagtgggagcaagtgcgaatccaccctggcacccgggcacctgcggacctgccccacggctcctacttgatggtcaacacttcccagcatgccccaggccagcgagcccatgtcatcttccagagcctgagcgagaatgatacccactgtgtgcagttcagctacttcctgtacagccgggacgggcacagcccgggcaccctgggcgtctacgtgcgcgttaatgggggccccctgggcagtgctgtgtggaatatgactggatcccacggccgtcagtggcaccaggctgagctggctgtcagcactttctggcccaatgaatatcaggtgctgtttgaggccctcatctccccagaccgcaggggctacatgggcctagatgacatcctgcttctcagctacccctgcgcaaaggccccacacttctcccgcctgggcgacgtggaggtcaacgcgggccagaacgcgtcgttccagtgcatggccgcgggcagagcggccgaggccgaacgcttcctcttgcaacggcagagcggggcgctggtgccggcggcgggcgtgcggcacatcagccaccggcgcttcctggccactttcccgctggctgccgtgagccgcgccgagcaggacctgtaccgctgtgtgtcccaggccccgcgcggcgcgggcgtctctaacttcgcggagctcatcgtcaaggagcccccaactcccatcgcgcccccacagctgctgcgtgctggccccacctacctcatcatccagctcaacaccaactccatcattggcgacgggccgatcgtgcgcaaggagattgagtaccgcatggcgcgcgggccctgggctgaggtgcacgccgtcagcctgcagacctacaagctgtggcacctcgaccccgacacagagtatgagatcagcgtgctgctcacgcgtcccggagacggcggcactggccgccctgggccacccctcatcagccgcaccaaatgcgcagagcccatgagggcccccaaaggcctggcttttgctgagatccaggcccgtcagctgaccctgcagtgggaaccactgggctacaacgtgacgcgttgccacacctatactgtgtcgctgtgctatcactacaccctgggcagcagccacaaccagaccatccgagagtgtgtgaagacagagcaaggtgtcagccgctacaccatcaagaacctgctgccctatcggaacgttcacgtgaggcttgtcctcactaaccctgaggggcgcaaagagggcaaggaggtcactttccagacggatgaggatgtgcccagtgggattgcagccgagtccctgaccttcactccactggaggacatgatcttcctcaagtgggaggagccccaggagcccaatggtctcatcacccagtatgagatcagctaccagagcatcgagtcatcagacccggcagtgaacgtgccaggcccacgacgtaccatctccaagctccgcaatgagacctaccatgtcttctccaacctgcacccaggcaccacctacctgttctccgtgcgggcccgcacaggcaaaggcttcggccaggcggcactcactgagataaccactaacatctctgctcccagctttgattatgccgacatgccgtcacccctgggcgagtctgagaacaccatcaccgtgctgctgaggccggcacagggccgcggtgcgcccatcagtgtgtaccaggtgattgtggaggaggagcgggcgcggaggctgcggcgggagccaggtggacaggactgcttcccagtgccattgaccttcgaggcggcgctggcccgaggcctggtgcactacttcggggccgaactggcggccagcagtctacctgaggccatgccctttaccgtgggtgacaaccagacctaccgaggcttctggaacccaccacttgagcctaggaaggcctatctcatctacttccaggcagcaagccacctgaagggggagacccggctgaattgcatccgcattgccaggaaagctgcctgcaaggaaagcaagcggcccctggaggtgtcccagagatcggaggagatggggcttatcctgggcatctgtgcaggggggcttgctgtcctcatccttctcctgggtgccatcattgtcatcatccgcaaagggagagaccactatgcctactcctactacccgaagccggtgaacatgaccaaggccaccgtcaactaccgccaggagaagacacacatgatgagcgccgtggaccgcagcttcacagaccagagcaccctgcaggaggacgagcggctgggcctgtccttcatggacacccatggctacagcacccggggagaccagcgcagcggtggggtcactgaggccagcagcctcctggggggctccccgaggcgtccctgtggccggaagggctccccataccacacggggcagctgcaccctgcggtgcgtgtcgcagaccttctgcagcacatcaaccagatgaagacggccgagggttacggcttcaagcaggagtatgagagcttctttgaaggctgggacgccacaaagaagaaagacaaggtcaagggcagccggcaggagccaatgcctgcctatgatcggcaccgagtgaaactgcacccgatgctgggagaccccaatgccgactacattaatgccaactacatagatggttaccacaggtcaaaccacttcatagccactcaagggccgaagcctgagatggtctatgacttctggcgtatggtgtggcaggagcactgttccagcatcgtcatgatcaccaagctggtcgaggtgggcagggtgaaatgctcacggtactggccggaggactcagacacctacggggacatcaagattatgctggtgaagacagagaccctggctgagtatgtcgtgcgcacttttgccctggagcggagaggctactctgcccggcacgaggtccgccagttccacttcacagcgtggccagagcatggcgtcccctaccatgccacggggctgctggctttcatccggcgcgtgaaggcctccaccccacctgatgccgggcccattgtcatccactgcagcgcgggcaccggccgcacaggttgctatatcgtcctggatgtgatgctggacatggcagagtgtgagggcgtcgtggacatttacaactgtgtgaagactctctgctcccggcgtgtcaacatgatccagactgaggagcagtacatcttcattcatgatgcaatcctggaggcctgcctgtgtggggagaccaccatccctgtcagtgagttcaaggccacctacaaggagatgatccgcattgatcctcagagtaattcctcccagctgcgggaagagttccagacgctgaactcggtcaccccgccgctggacgtggaggagtgcagcatcgccctgttgccccggaaccgcgacaagaaccgcagcatggacgtcctgccgcccgaccgctgcctgcccttcctcatctccactgatggggactccaacaactacattaatgcagccctgactgacagctacacacggagtgcggccttcatcgtgaccctgcacccgctgcagagcaccacgcccgacttctggcggctggtctacgattacgggtgcacctccatcgtcatgctcaaccagctgaaccagtccaactccgcctggccctgcctgcagtactggccagagccaggccggcagcaatatggcctcatggaggtggagtttatgtcgggcacagctgatgaagacttagtggctcgagtcttccgggtgcagaacatctctcggttgcaggaggggcacctgctggtgcggcacttccagttcctgcgctggtctgcataccgggacacacctgactccaagaaggccttcttgcacctgctggctgaggtggacaagtggcaggccgagagtggggatgggcgcaccatcgtgcactgcctaaacgggggaggacgcagcggcaccttctgcgcctgcgccacggtcctggagatgatccgctgccacaacttggtggacgttttctttgctgccaaaaccctccggaactacaaacccaacatggtggagaccatggatcagtaccacttttgctacgatgtggccctggagtacttggaggggctggagtcaagatag

SEQ ID NO: 171935 - DNA, 5579 bp, Homo sapiens
  Payload ID: 13778
  Gene Symbol: PTPRU
  Gene Name: protein tyrosine phosphatase, receptor type, U
  Uniprot ID: Q92729
  ENST ID: ENST00000373779
  CDS Start-End: 130-4440
ggcgccagtcccgctccgcgccgcgccgctccgctccggctcgggctccggctcgcctcgggctgggctcgggctccgggggcggcgtcccccgcgccgggccccgggacgggcggcgacgctccaaccatggcccgtgcccaggcgctcgtgctggcactcaccttccagctctgcgcgccggagaccgagactccggcagctggctgcaccttcgaggaggcaagtgacccagcagtgccctgcgagtacagccaggcccagtacgatgacttccagtgggagcaagtgcgaatccaccctggcacccgggcacctgcggacctgccccacggctcctacttgatggtcaacacttcccagcatgccccaggccagcgagcccatgtcatcttccagagcctgagcgagaatgatacccactgtgtgcagttcagctacttcctgtacagccgggacgggcacagcccgggcaccctgggcgtctacgtgcgcgttaatgggggccccctgggcagtgctgtgtggaatatgactggatcccacggccgtcagtggcaccaggctgagctggctgtcagcactttctggcccaatgaatatcaggtgctgtttgaggccctcatctccccagaccgcaggggctacatgggcctagatgacatcctgcttctcagctacccctgcgcaaaggccccacacttctcccgcctgggcgacgtggaggtcaacgcgggccagaacgcgtcgttccagtgcatggccgcgggcagagcggccgaggccgaacgcttcctcttgcaacggcagagcggggcgctggtgccggcggcgggcgtgcggcacatcagccaccggcgcttcctggccactttcccgctggctgccgtgagccgcgccgagcaggacctgtaccgctgtgtgtcccaggccccgcgcggcgcgggcgtctctaacttcgcggagctcatcgtcaaggagcccccaactcccatcgcgcccccacagctgctgcgtgctggccccacctacctcatcatccagctcaacaccaactccatcattggcgacgggccgatcgtgcgcaaggagattgagtaccgcatggcgcgcgggccctgggctgaggtgcacgccgtcagcctgcagacctacaagctgtggcacctcgaccccgacacagagtatgagatcagcgtgctgctcacgcgtcccggagacggcggcactggccgccctgggccacccctcatcagccgcaccaaatgcgcagagcccatgagggcccccaaaggcctggcttttgctgagatccaggcccgtcagctgaccctgcagtgggaaccactgggctacaacgtgacgcgttgccacacctatactgtgtcgctgtgctatcactacaccctgggcagcagccacaaccagaccatccgagagtgtgtgaagacagagcaaggtgtcagccgctacaccatcaagaacctgctgccctatcggaacgttcacgtgaggcttgtcctcactaaccctgaggggcgcaaagagggcaaggaggtcactttccagacggatgaggatgtgcccagtgggattgcagccgagtccctgaccttcactccactggaggacatgatcttcctcaagtgggaggagccccaggagcccaatggtctcatcacccagtatgagatcagctaccagagcatcgagtcatcagacccggcagtgaacgtgccaggcccacgacgtaccatctccaagctccgcaatgagacctaccatgtcttctccaacctgcacccaggcaccacctacctgttctccgtgcgggcccgcacaggcaaaggcttcggccaggcggcactcactgagataaccactaacatctctgctcccagctttgattatgccgacatgccgtcacccctgggcgagtctgagaacaccatcaccgtgctgctgaggccggcacagggccgcggtgcgcccatcagtgtgtaccaggtgattgtggaggaggagcgggcgcggaggctgcggcgggagccaggtggacaggactgcttcccagtgccattgaccttcgaggcggcgctggcccgaggcctggtgcactacttcggggccgaactggcggccagcagtctacctgaggccatgccctttaccgtgggtgacaaccagacctaccgaggcttctggaacccaccacttgagcctaggaaggcctatctcatctacttccaggcagcaagccacctgaagggggagacccggctgaattgcatccgcattgccaggaaagctgcctgcaaggaaagcaagcggcccctggaggtgtcccagagatcggaggagatggggcttatcctgggcatctgtgcaggggggcttgctgtcctcatccttctcctgggtgccatcattgtcatcatccgcaaagggaagccggtgaacatgaccaaggccaccgtcaactaccgccaggagaagacacacatgatgagcgccgtggaccgcagcttcacagaccagagcaccctgcaggaggacgagcggctgggcctgtccttcatggacacccatggctacagcacccggggagaccagcgcagcggtggggtcactgaggccagcagcctcctggggggctccccgaggcgtccctgtggccggaagggctccccataccacacggggcagctgcaccctgcggtgcgtgtcgcagaccttctgcagcacatcaaccagatgaagacggccgagggttacggcttcaagcaggagtatgagagcttctttgaaggctgggacgccacaaagaagaaagacaaggtcaagggcagccggcaggagccaatgcctgcctatgatcggcaccgagtgaaactgcacccgatgctgggagaccccaatgccgactacattaatgccaactacatagatggttaccacaggtcaaaccacttcatagccactcaagggccgaagcctgagatggtctatgacttctggcgtatggtgtggcaggagcactgttccagcatcgtcatgatcaccaagctggtcgaggtgggcagggtgaaatgctcacggtactggccggaggactcagacacctacggggacatcaagattatgctggtgaagacagagaccctggctgagtatgtcgtgcgcacttttgccctggagcggagaggctactctgcccggcacgaggtccgccagttccacttcacagcgtggccagagcatggcgtcccctaccatgccacggggctgctggctttcatccggcgcgtgaaggcctccaccccacctgatgccgggcccattgtcatccactgcagcgcgggcaccggccgcacaggttgctatatcgtcctggatgtgatgctggacatggcagagtgtgagggcgtcgtggacatttacaactgtgtgaagactctctgctcccggcgtgtcaacatgatccagactgaggagcagtacatcttcattcatgatgcaatcctggaggcctgcctgtgtggggagaccaccatccctgtcagtgagttcaaggccacctacaaggagatgatccgcattgatcctcagagtaattcctcccagctgcgggaagagttccagacgctgaactcggtcaccccgccgctggacgtggaggagtgcagcatcgccctgttgccccggaaccgcgacaagaaccgcagcatggacgtcctgccgcccgaccgctgcctgcccttcctcatctccactgatggggactccaacaactacattaatgcagccctgactgacagctacacacggagtgcggccttcatcgtgaccctgcacccgctgcagagcaccacgcccgacttctggcggctggtctacgattacgggtgcacctccatcgtcatgctcaaccagctgaaccagtccaactccgcctggccctgcctgcagtactggccagagccaggccggcagcaatatggcctcatggaggtggagtttatgtcgggcacagctgatgaagacttagtggctcgagtcttccgggtgcagaacatctctcggttgcaggaggggcacctgctggtgcggcacttccagttcctgcgctggtctgcataccgggacacacctgactccaagaaggccttcttgcacctgctggctgaggtggacaagtggcaggccgagagtggggatgggcgcaccatcgtgcactgcctaaacgggggaggacgcagcggcaccttctgcgcctgcgccacggtcctggagatgatccgctgccacaacttggtggacgttttctttgctgccaaaaccctccggaactacaaacccaacatggtggagaccatggatcagtaccacttttgctacgatgtggccctggagtacttggaggggctggagtcaagatagcggggccctggcctggggcacccactgcacactcagggccagacccaccatcctggactggcgaggaagatcagtgcctcctgctctgcccaaacacactcccatggggcaagcactggagtggatgctgggctatcttgctcccccttccactgtgggcagggcctttcgcttgtcccatgggcgggtggtgggccaaggaggagcttagcaagtctgcagcccagccccacctccatagggtcctgcaggcctgtgctgagaggcctggtgctgcctggcagagtgacaaaggctcaggacggctggctctgggggactcaggccaagccccttggcaccatcctggcttttggcagggatgagtgaggccctgcagagagcatcccaggccaaggttcccactcagcctgccccctctgcatgtgggtagaggatgtactgggacttggcatttaggattccatctggcccagcccctgaaggtcctggggaagcaggtctcaattctgaatagccagtggggcacactgactgtcctccccaggggaactgcagcgccctcctccccactgccccctgcagcccctgagatattttgctcactatccctccccacttgcttccctgatatgtgctctgagcttccctgaaccaggatctgcctattactgctgtgccccatggggggctccttccctgcctgacccactgttgcagaatgaagtcacctcgcccccctcttcctttaatcttcaggcctcactggcctgtcctgctcagcttgggccagtgacaatctgcaaggctgaacaacagcccctggggttgaggcccctgtggctcctggtcaggctgcccgttgtggggaggggcagtgttagagcagggctggtcataccctctggagttcagaggaagaggtaggaccagtgcttttttgtttcttttgttatttttggttgggtgggtgggaaggtctctttaaaatggggcaggccacacccccattccgtgcctcaatttccccatctgtaaactgtagatatgactactgacctacctcgcagggggctgtggggaggcataagctgatgtttgtaaagcgctttgtaaataaacgtgctctctgaatgcca

SEQ ID NO: 171936 - DNA, 5550 bp, Homo sapiens
  Payload ID: 13778
  Gene Symbol: PTPRU
  Gene Name: protein tyrosine phosphatase, receptor type, U
  Uniprot ID: Q92729
  ENST ID: ENST00000428026
  CDS Start-End: 97-4398
ctccggctcgggctccggctcgcctcgggctgggctcgggctccgggggcggcgtcccccgcgccgggccccgggacgggcggcgacgctccaaccatggcccgtgcccaggcgctcgtgctggcactcaccttccagctctgcgcgccggagaccgagactccggcagctggctgcaccttcgaggaggcaagtgacccagcagtgccctgcgagtacagccaggcccagtacgatgacttccagtgggagcaagtgcgaatccaccctggcacccgggcacctgcggacctgccccacggctcctacttgatggtcaacacttcccagcatgccccaggccagcgagcccatgtcatcttccagagcctgagcgagaatgatacccactgtgtgcagttcagctacttcctgtacagccgggacgggcacagcccgggcaccctgggcgtctacgtgcgcgttaatgggggccccctgggcagtgctgtgtggaatatgactggatcccacggccgtcagtggcaccaggctgagctggctgtcagcactttctggcccaatgaatatcaggtgctgtttgaggccctcatctccccagaccgcaggggctacatgggcctagatgacatcctgcttctcagctacccctgcgcaaaggccccacacttctcccgcctgggcgacgtggaggtcaacgcgggccagaacgcgtcgttccagtgcatggccgcgggcagagcggccgaggccgaacgcttcctcttgcaacggcagagcggggcgctggtgccggcggcgggcgtgcggcacatcagccaccggcgcttcctggccactttcccgctggctgccgtgagccgcgccgagcaggacctgtaccgctgtgtgtcccaggccccgcgcggcgcgggcgtctctaacttcgcggagctcatcgtcaaggagcccccaactcccatcgcgcccccacagctgctgcgtgctggccccacctacctcatcatccagctcaacaccaactccatcattggcgacgggccgatcgtgcgcaaggagattgagtaccgcatggcgcgcgggccctgggctgaggtgcacgccgtcagcctgcagacctacaagctgtggcacctcgaccccgacacagagtatgagatcagcgtgctgctcacgcgtcccggagacggcggcactggccgccctgggccacccctcatcagccgcaccaaatgcgcagagcccatgagggcccccaaaggcctggcttttgctgagatccaggcccgtcagctgaccctgcagtgggaaccactgggctacaacgtgacgcgttgccacacctatactgtgtcgctgtgctatcactacaccctgggcagcagccacaaccagaccatccgagagtgtgtgaagacagagcaaggtgtcagccgctacaccatcaagaacctgctgccctatcggaacgttcacgtgaggcttgtcctcactaaccctgaggggcgcaaagagggcaaggaggtcactttccagacggatgaggatgtgcccagtgggattgcagccgagtccctgaccttcactccactggaggacatgatcttcctcaagtgggaggagccccaggagcccaatggtctcatcacccagtatgagatcagctaccagagcatcgagtcatcagacccggcagtgaacgtgccaggcccacgacgtaccatctccaagctccgcaatgagacctaccatgtcttctccaacctgcacccaggcaccacctacctgttctccgtgcgggcccgcacaggcaaaggcttcggccaggcggcactcactgagataaccactaacatctctgctcccagctttgattatgccgacatgccgtcacccctgggcgagtctgagaacaccatcaccgtgctgctgaggccggcacagggccgcggtgcgcccatcagtgtgtaccaggtgattgtggaggaggagcgggcgcggaggctgcggcgggagccaggtggacaggactgcttcccagtgccattgaccttcgaggcggcgctggcccgaggcctggtgcactacttcggggccgaactggcggccagcagtctacctgaggccatgccctttaccgtgggtgacaaccagacctaccgaggcttctggaacccaccacttgagcctaggaaggcctatctcatctacttccaggcagcaagccacctgaagggggagacccggctgaattgcatccgcattgccaggaaagctgcctgcaaggaaagcaagcggcccctggaggtgtcccagagatcggaggagatggggcttatcctgggcatctgtgcaggggggcttgctgtcctcatccttctcctgggtgccatcattgtcatcatccgcaaagggaagccggtgaacatgaccaaggccaccgtcaactaccgccaggagaagacacacatgatgagcgccgtggaccgcagcttcacagaccagagcaccctgcaggaggacgagcggctgggcctgtccttcatggacacccatggctacagcacccggggagaccagcgcagcggtggggtcactgaggccagcagcctcctggggggctccccgaggcgtccctgtggccggaagggctccccataccacacggggcagctgcaccctgcggtgcgtgtcgcagaccttctgcagcacatcaaccagatgaagacggccgagggttacggcttcaagcaggagtatgagagcttctttgaaggctgggacgccacaaagaagaaagacaaggtcaagggcagccggcaggagccaatgcctgcctatgatcggcaccgagtgaaactgcacccgatgctgggagaccccaatgccgactacattaatgccaactacatagatggttaccacaggtcaaaccacttcatagccactcaagggccgaagcctgagatggtctatgacttctggcgtatggtgtggcaggagcactgttccagcatcgtcatgatcaccaagctggtcgaggtgaaatgctcacggtactggccggaggactcagacacctacggggacatcaagattatgctggtgaagacagagaccctggctgagtatgtcgtgcgcacttttgccctggagcggagaggctactctgcccggcacgaggtccgccagttccacttcacagcgtggccagagcatggcgtcccctaccatgccacggggctgctggctttcatccggcgcgtgaaggcctccaccccacctgatgccgggcccattgtcatccactgcagcgcgggcaccggccgcacaggttgctatatcgtcctggatgtgatgctggacatggcagagtgtgagggcgtcgtggacatttacaactgtgtgaagactctctgctcccggcgtgtcaacatgatccagactgaggagcagtacatcttcattcatgatgcaatcctggaggcctgcctgtgtggggagaccaccatccctgtcagtgagttcaaggccacctacaaggagatgatccgcattgatcctcagagtaattcctcccagctgcgggaagagttccagacgctgaactcggtcaccccgccgctggacgtggaggagtgcagcatcgccctgttgccccggaaccgcgacaagaaccgcagcatggacgtcctgccgcccgaccgctgcctgcccttcctcatctccactgatggggactccaacaactacattaatgcagccctgactgacagctacacacggagtgcggccttcatcgtgaccctgcacccgctgcagagcaccacgcccgacttctggcggctggtctacgattacgggtgcacctccatcgtcatgctcaaccagctgaaccagtccaactccgcctggccctgcctgcagtactggccagagccaggccggcagcaatatggcctcatggaggtggagtttatgtcgggcacagctgatgaagacttagtggctcgagtcttccgggtgcagaacatctctcggttgcaggaggggcacctgctggtgcggcacttccagttcctgcgctggtctgcataccgggacacacctgactccaagaaggccttcttgcacctgctggctgaggtggacaagtggcaggccgagagtggggatgggcgcaccatcgtgcactgcctaaacgggggaggacgcagcggcaccttctgcgcctgcgccacggtcctggagatgatccgctgccacaacttggtggacgttttctttgctgccaaaaccctccggaactacaaacccaacatggtggagaccatggatcagtaccacttttgctacgatgtggccctggagtacttggaggggctggagtcaagatagcggggccctggcctggggcacccactgcacactcagggccagacccaccatcctggactggcgaggaagatcagtgcctcctgctctgcccaaacacactcccatggggcaagcactggagtggatgctgggctatcttgctcccccttccactgtgggcagggcctttcgcttgtcccatgggcgggtggtgggccaaggaggagcttagcaagtctgcagcccagccccacctccatagggtcctgcaggcctgtgctgagaggcctggtgctgcctggcagagtgacaaaggctcaggacggctggctctgggggactcaggccaagccccttggcaccatcctggcttttggcagggatgagtgaggccctgcagagagcatcccaggccaaggttcccactcagcctgccccctctgcatgtgggtagaggatgtactgggacttggcatttaggattccatctggcccagcccctgaaggtcctggggaagcaggtctcaattctgaatagccagtggggcacactgactgtcctccccaggggaactgcagcgccctcctccccactgccccctgcagcccctgagatattttgctcactatccctccccacttgcttccctgatatgtgctctgagcttccctgaaccaggatctgcctattactgctgtgccccatggggggctccttccctgcctgacccactgttgcagaatgaagtcacctcgcccccctcttcctttaatcttcaggcctcactggcctgtcctgctcagcttgggccagtgacaatctgcaaggctgaacaacagcccctggggttgaggcccctgtggctcctggtcaggctgcccgttgtggggaggggcagtgttagagcagggctggtcataccctctggagttcagaggaagaggtaggaccagtgcttttttgtttcttttgttatttttggttgggtgggtgggaaggtctctttaaaatggggcaggccacacccccattccgtgcctcaatttccccatctgtaaactgtagatatgactactgacctacctcgcagggggctgtggggaggcataagctgatgtttgtaaagcgctttgtaaataaacgtgctctctgaatgccacagagcagccctg

SEQ ID NO: 171937 - DNA, 5337 bp, Homo sapiens
  Payload ID: 13778
  Gene Symbol: PTPRU
  Gene Name: protein tyrosine phosphatase, receptor type, U
  Uniprot ID: Q92729
  ENST ID: ENST00000460170
  CDS Start-End: 7-4329
ccaaccatggcccgtgcccaggcgctcgtgctggcactcaccttccagctctgcgcgccggagaccgagactccggcagctggctgcaccttcgaggaggcaagtgacccagcagtgccctgcgagtacagccaggcccagtacgatgacttccagtgggagcaagtgcgaatccaccctggcacccgggcacctgcggacctgccccacggctcctacttgatggtcaacacttcccagcatgccccaggccagcgagcccatgtcatcttccagagcctgagcgagaatgatacccactgtgtgcagttcagctacttcctgtacagccgggacgggcacagcccgggcaccctgggcgtctacgtgcgcgttaatgggggccccctgggcagtgctgtgtggaatatgactggatcccacggccgtcagtggcaccaggctgagctggctgtcagcactttctggcccaatgaatatcaggtgctgtttgaggccctcatctccccagaccgcaggggctacatgggcctagatgacatcctgcttctcagctacccctgcgcaaaggccccacacttctcccgcctgggcgacgtggaggtcaacgcgggccagaacgcgtcgttccagtgcatggccgcgggcagagcggccgaggccgaacgcttcctcttgcaacggcagagcggggcgctggtgccggcggcgggcgtgcggcacatcagccaccggcgcttcctggccactttcccgctggctgccgtgagccgcgccgagcaggacctgtaccgctgtgtgtcccaggccccgcgcggcgcgggcgtctctaacttcgcggagctcatcgtcaaggagcccccaactcccatcgcgcccccacagctgctgcgtgctggccccacctacctcatcatccagctcaacaccaactccatcattggcgacgggccgatcgtgcgcaaggagattgagtaccgcatggcgcgcgggccctgggctgaggtgcacgccgtcagcctgcagacctacaagctgtggcacctcgaccccgacacagagtatgagatcagcgtgctgctcacgcgtcccggagacggcggcactggccgccctgggccacccctcatcagccgcaccaaatgcgcagagcccatgagggcccccaaaggcctggcttttgctgagatccaggcccgtcagctgaccctgcagtgggaaccactgggctacaacgtgacgcgttgccacacctatactgtgtcgctgtgctatcactacaccctgggcagcagccacaaccagaccatccgagagtgtgtgaagacagagcaaggtgtcagccgctacaccatcaagaacctgctgccctatcggaacgttcacgtgaggcttgtcctcactaaccctgaggggcgcaaagagggcaaggaggtcactttccagacggatgaggatgtgcccagtgggattgcagccgagtccctgaccttcactccactggaggacatgatcttcctcaagtgggaggagccccaggagcccaatggtctcatcacccagtatgagatcagctaccagagcatcgagtcatcagacccggcagtgaacgtgccaggcccacgacgtaccatctccaagctccgcaatgagacctaccatgtcttctccaacctgcacccaggcaccacctacctgttctccgtgcgggcccgcacaggcaaaggcttcggccaggcggcactcactgagataaccactaacatctctgctcccagctttgattatgccgacatgccgtcacccctgggcgagtctgagaacaccatcaccgtgctgctgaggccggcacagggccgcggtgcgcccatcagtgtgtaccaggtgattgtggaggaggagcgggcgcggaggctgcggcgggagccaggtggacaggactgcttcccagtgccattgaccttcgaggcggcgctggcccgaggcctggtgcactacttcggggccgaactggcggccagcagtctacctgaggccatgccctttaccgtgggtgacaaccagacctaccgaggcttctggaacccaccacttgagcctaggaaggcctatctcatctacttccaggcagcaagccacctgaagggggagacccggctgaattgcatccgcattgccaggaaagctgcctgcaaggaaagcaagcggcccctggaggtgtcccagagatcggaggagatggggcttatcctgggcatctgtgcaggggggcttgctgtcctcatccttctcctgggtgccatcattgtcatcatccgcaaagggaagccggtgaacatgaccaaggccaccgtcaactaccgccaggagaagacacacatgatgagcgccgtggaccgcagcttcacagaccagagcaccctgcaggaggacgagcggctgggcctgtccttcatggacacccatggctacagcacccggggagaccagcgcagcggtggggtcactgaggccagcagcctcctggggggctccccgaggcgtccctgtggccggaagggctccccataccacacggggcagctgcaccctgcggtgcgtgtcgcagaccttctgcagcacatcaaccagatgaagacggccgagggttacggcttcaagcaggagtatgagagcttctttgaaggctgggacgccacaaagaagaaagacaaggtcaagggcagccggcaggagccaatgcctgcctatgatcggcaccgagtgaaactgcacccgatgctgggagaccccaatgccgactacattaatgccaactacatagatattcggataaaccgagaaggttaccacaggtcaaaccacttcatagccactcaagggccgaagcctgagatggtctatgacttctggcgtatggtgtggcaggagcactgttccagcatcgtcatgatcaccaagctggtcgaggtgggcagggtgaaatgctcacggtactggccggaggactcagacacctacggggacatcaagattatgctggtgaagacagagaccctggctgagtatgtcgtgcgcacttttgccctggagcggagaggctactctgcccggcacgaggtccgccagttccacttcacagcgtggccagagcatggcgtcccctaccatgccacggggctgctggctttcatccggcgcgtgaaggcctccaccccacctgatgccgggcccattgtcatccactgcagcgcgggcaccggccgcacaggttgctatatcgtcctggatgtgatgctggacatggcagagtgtgagggcgtcgtggacatttacaactgtgtgaagactctctgctcccggcgtgtcaacatgatccagactgaggagcagtacatcttcattcatgatgcaatcctggaggcctgcctgtgtggggagaccaccatccctgtcagtgagttcaaggccacctacaaggagatgatccgcattgatcctcagagtaattcctcccagctgcgggaagagttccagacgctgaactcggtcaccccgccgctggacgtggaggagtgcagcatcgccctgttgccccggaaccgcgacaagaaccgcagcatggacgtcctgccgcccgaccgctgcctgcccttcctcatctccactgatggggactccaacaactacattaatgcagccctgactgacagctacacacggagtgcggccttcatcgtgaccctgcacccgctgcagagcaccacgcccgacttctggcggctggtctacgattacgggtgcacctccatcgtcatgctcaaccagctgaaccagtccaactccgcctggccctgcctgcagtactggccagagccaggccggcagcaatatggcctcatggaggtggagtttatgtcgggcacagctgatgaagacttagtggctcgagtcttccgggtgcagaacatctctcgggaggggcacctgctggtgcggcacttccagttcctgcgctggtctgcataccgggacacacctgactccaagaaggccttcttgcacctgctggctgaggtggacaagtggcaggccgagagtggggatgggcgcaccatcgtgcactgcctaaacgggggaggacgcagcggcaccttctgcgcctgcgccacggtcctggagatgatccgctgccacaacttggtggacgttttctttgctgccaaaaccctccggaactacaaacccaacatggtggagaccatggatcagtaccacttttgctacgatgtggccctggagtacttggaggggctggagtcaagatagcggggccctggcctggggcacccactgcacactcagggccagacccaccatcctggactggcgaggaagatcagtgcctcctgctctgcccaaacacactcccatggggcaagcactggagtggatgctgggctatcttgctcccccttccactgtgggcagggcctttcgcttgtcccatgggcgggtggtgggccaaggaggagcttagcaagtctgcagcccagccccacctccatagggtcctgcaggcctgtgctgagaggcctggtgctgcctggcagagtgacaaaggctcaggacggctggctctgggggactcaggccaagccccttggcaccatcctggcttttggcagggatgagtgaggccctgcagagagcatcccaggccaaggttcccactcagcctgccccctctgcatgtgggtagaggatgtactgggacttggcatttaggattccatctggcccagcccctgaaggtcctggggaagcaggtctcaattctgaatagccagtggggcacactgactgtcctccccaggggaactgcagcgccctcctccccactgccccctgcagcccctgagatattttgctcactatccctccccacttgcttccctgatatgtgctctgagcttccctgaaccaggatctgcctattactgctgtgccccatggggggctccttccctgcctgacccactgttgcagaatgaagtcacctcgcccccctcttcctttaatcttcaggcctcactggcctgtcctgctcagcttgggccagtgacaatctgcaaggctgaacaacagcccctggggttgaggcccctgtggctcctggtcaggctgcccgttgtggggaggggcagtgttagagcagggctggtcataccctctggagttcagaggaagaggtaggaccagtgcttttttgtttcttttgttatttttggttgggtgggtgggaaggtctctttaaaatggggcaggccacacccc

SEQ ID NO: 171938 - DNA, 8175 bp, Homo sapiens
  Payload ID: 13779
  Gene Symbol: PTPRZ1
  Gene Name: protein tyrosine phosphatase, receptor-type, Z polypeptide 1
  Uniprot ID: P23471
  ENST ID: ENST00000393386
  CDS Start-End: 412-7359
aggagccgcggcgcgcacagccgggctggagcgcgcacccggcactgaggcttcgctgctctcggagcgctcagaccgcggccgccgcagccggcgaaagaggcaaagtcccgcacgccggaggacatgcgcctcggctagcggccccgggccccaccaccgtgcggctttctccagattattcctctctcgctgtctctgactgtctctctctgtctctgtctctgtctctctctctctcacacacacacacacacacacaaacacacatacgcacgcacgatctcacttcgatctatacactggaggattaaaacaaacaaacaaaaaaaacatttccttcgctccccctccctctccactctgagaagcagaggagccgcacggcgaggggccgcagaccgtctggaaatgcgaatcctaaagcgtttcctcgcttgcattcagctcctctgtgtttgccgcctggattgggctaatggatactacagacaacagagaaaacttgttgaagagattggctggtcctatacaggagcactgaatcaaaaaaattggggaaagaaatatccaacatgtaatagcccaaaacaatctcctatcaatattgatgaagatcttacacaagtaaatgtgaatcttaagaaacttaaatttcagggttgggataaaacatcattggaaaacacattcattcataacactgggaaaacagtggaaattaatctcactaatgactaccgtgtcagcggaggagtttcagaaatggtgtttaaagcaagcaagataacttttcactggggaaaatgcaatatgtcatctgatggatcagagcatagtttagaaggacaaaaatttccacttgagatgcaaatctactgctttgatgcggaccgattttcaagttttgaggaagcagtcaaaggaaaagggaagttaagagctttatccattttgtttgaggttgggacagaagaaaatttggatttcaaagcgattattgatggagtcgaaagtgttagtcgttttgggaagcaggctgctttagatccattcatactgttgaaccttctgccaaactcaactgacaagtattacatttacaatggctcattgacatctcctccctgcacagacacagttgactggattgtttttaaagatacagttagcatctctgaaagccagttggctgttttttgtgaagttcttacaatgcaacaatctggttatgtcatgctgatggactacttacaaaacaattttcgagagcaacagtacaagttctctagacaggtgttttcctcatacactggaaaggaagagattcatgaagcagtttgtagttcagaaccagaaaatgttcaggctgacccagagaattataccagccttcttgttacatgggaaagacctcgagtcgtttatgataccatgattgagaagtttgcagttttgtaccagcagttggatggagaggaccaaaccaagcatgaatttttgacagatggctatcaagacttgggtgctattctcaataatttgctacccaatatgagttatgttcttcagatagtagccatatgcactaatggcttatatggaaaatacagcgaccaactgattgtcgacatgcctactgataatcctgaacttgatcttttccctgaattaattggaactgaagaaataatcaaggaggaggaagagggaaaagacattgaagaaggcgctattgtgaatcctggtagagacagtgctacaaaccaaatcaggaaaaaggaaccccagatttctaccacaacacactacaatcgcatagggacgaaatacaatgaagccaagactaaccgatccccaacaagaggaagtgaattctctggaaagggtgatgttcccaatacatctttaaattccacttcccaaccagtcactaaattagccacagaaaaagatatttccttgacttctcagactgtgactgaactgccacctcacactgtggaaggtacttcagcctctttaaatgatggctctaaaactgttcttagatctccacatatgaacttgtcggggactgcagaatccttaaatacagtttctataacagaatatgaggaggagagtttattgaccagtttcaagcttgatactggagctgaagattcttcaggctccagtcccgcaacttctgctatcccattcatctctgagaacatatcccaagggtatatattttcctccgaaaacccagagacaataacatatgatgtccttataccagaatctgctagaaatgcttccgaagattcaacttcatcaggttcagaagaatcactaaaggatccttctatggagggaaatgtgtggtttcctagctctacagacataacagcacagcccgatgttggatcaggcagagagagctttctccagactaattacactgagatacgtgttgatgaatctgagaagacaaccaagtccttttctgcaggcccagtgatgtcacagggtccctcagttacagatctggaaatgccacattattctacctttgcctacttcccaactgaggtaacacctcatgcttttaccccatcctccagacaacaggatttggtctccacggtcaacgtggtatactcgcagacaacccaaccggtatacaatggtgagacacctcttcaaccttcctacagtagtgaagtctttcctctagtcacccctttgttgcttgacaatcagatcctcaacactacccctgctgcttcaagtagtgattcggccttgcatgctacgcctgtatttcccagtgtcgatgtgtcatttgaatccatcctgtcttcctatgatggtgcacctttgcttccattttcctctgcttccttcagtagtgaattgtttcgccatctgcatacagtttctcaaatccttccacaagttacttcagctaccgagagtgataaggtgcccttgcatgcttctctgccagtggctgggggtgatttgctattagagcccagccttgctcagtattctgatgtgctgtccactactcatgctgcttcagagacgctggaatttggtagtgaatctggtgttctttataaaacgcttatgttttctcaagttgaaccacccagcagtgatgccatgatgcatgcacgttcttcagggcctgaaccttcttatgccttgtctgataatgagggctcccaacacatcttcactgtttcttacagttctgcaatacctgtgcatgattctgtgggtgtaacttatcagggttccttatttagcggccctagccatataccaatacctaagtcttcgttaataaccccaactgcatcattactgcagcctactcatgccctctctggtgatggggaatggtctggagcctcttctgatagtgaatttcttttacctgacacagatgggctgacagcccttaacatttcttcacctgtttctgtagctgaatttacatatacaacatctgtgtttggtgatgataataaggcgctttctaaaagtgaaataatatatggaaatgagactgaactgcaaattccttctttcaatgagatggtttacccttctgaaagcacagtcatgcccaacatgtatgataatgtaaataagttgaatgcgtctttacaagaaacctctgtttccatttctagcaccaagggcatgtttccagggtcccttgctcataccaccactaaggtttttgatcatgagattagtcaagttccagaaaataacttttcagttcaacctacacatactgtctctcaagcatctggtgacacttcgcttaaacctgtgcttagtgcaaactcagagccagcatcctctgaccctgcttctagtgaaatgttatctccttcaactcagctcttattttatgagacctcagcttcttttagtactgaagtattgctacaaccttcctttcaggcttctgatgttgacaccttgcttaaaactgttcttccagctgtgcccagtgatccaatattggttgaaacccccaaagttgataaaattagttctacaatgttgcatctcattgtatcaaattctgcttcaagtgaaaacatgctgcactctacatctgtaccagtttttgatgtgtcgcctacttctcatatgcactctgcttcacttcaaggtttgaccatttcctatgcaagtgagaaatatgaaccagttttgttaaaaagtgaaagttcccaccaagtggtaccttctttgtacagtaatgatgagttgttccaaacggccaatttggagattaaccaggcccatcccccaaaaggaaggcatgtatttgctacacctgttttatcaattgatgaaccattaaatacactaataaataagcttatacattccgatgaaattttaacctccaccaaaagttctgttactggtaaggtatttgctggtattccaacagttgcttctgatacatttgtatctactgatcattctgttcctataggaaatgggcatgttgccattacagctgtttctccccacagagatggttctgtaacctcaacaaagttgctgtttccttctaaggcaacttctgagctgagtcatagtgccaaatctgatgccggtttagtgggtggtggtgaagatggtgacactgatgatgatggtgatgatgatgatgatgacagaggtagtgatggcttatccattcataagtgtatgtcatgctcatcctatagagaatcacaggaaaaggtaatgaatgattcagacacccacgaaaacagtcttatggatcagaataatccaatctcatactcactatctgagaattctgaagaagataatagagtcacaagtgtatcctcagacagtcaaactggtatggacagaagtcctggtaaatcaccatcagcaaatgggctatcccaaaagcacaatgatggaaaagaggaaaatgacattcagactggtagtgctctgcttcctctcagccctgaatctaaagcatgggcagttctgacaagtgatgaagaaagtggatcagggcaaggtacctcagatagccttaatgagaatgagacttccacagatttcagttttgcagacactaatgaaaaagatgctgatgggatcctggcagcaggtgactcagaaataactcctggattcccacagtccccaacatcatctgttactagcgagaactcagaagtgttccacgtttcagaggcagaggccagtaatagtagccatgagtctcgtattggtctagctgaggggttggaatccgagaagaaggcagttataccccttgtgatcgtgtcagccctgacttttatctgtctagtggttcttgtgggtattctcatctactggaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgagacactgaaagagttttaccaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaacacagaaaggggtgggggaactcacatctgagcattgttttcctcttcctaaaattaggcaggaaaatcagtctagttctgttatctgttgatttcccatcacctgacagtaactttcatgacataggattctgccgccaaatttatatcattaacaatgtgtgcctttttgcaagacttgtaatttacttattatgtttgaactaaaatgattgaattttacagtatttctaagaatggaattgtggtatttttttctgtattgattttaacagaaaatttcaatttatagaggttaggaattccaaactacagaaaatgtttgtttttagtgtcaaatttttagctgtatttgtagcaattatcaggtttgctagaaatataacttttaatacagtagcctgtaaataaaacactcttccatatgatattcaacattttacaactgcagtattcacctaaagtagaaataatctgttacttattgtaaatactgccctagtgtctccatggaccaaatttatatttataattgtagatttttatattttactactgagtcaagttttctagttctgtgtaattgtttagtttaatgacgtagttcattagctggtcttactctaccagttttctgacattgtattgtgttacctaagtcattaactttgtttcagcatgtaattttaacttttgtggaaaatagaaataccttcattttgaaagaagtttttatgagaataacaccttaccaaacattgttcaaatggtttttatccaaggaattgcaaaaataaatataaatattgccattaa

SEQ ID NO: 171939 - DNA, 4627 bp, Homo sapiens
  Payload ID: 13779
  Gene Symbol: PTPRZ1
  Gene Name: protein tyrosine phosphatase, receptor-type, Z polypeptide 1
  Uniprot ID: P23471
  ENST ID: ENST00000449182
  CDS Start-End: 140-4486
cgcacgcacgatctcacttcgatctatacactggaggattaaaacaaacaaacaaaaaaaacatttccttcgctccccctccctctccactctgagaagcagaggagccgcacggcgaggggccgcagaccgtctggaaatgcgaatcctaaagcgtttcctcgcttgcattcagctcctctgtgtttgccgcctggattgggctaatggatactacagacaacagagaaaacttgttgaagagattggctggtcctatacaggagcactgaatcaaaaaaattggggaaagaaatatccaacatgtaatagcccaaaacaatctcctatcaatattgatgaagatcttacacaagtaaatgtgaatcttaagaaacttaaatttcagggttgggataaaacatcattggaaaacacattcattcataacactgggaaaacagtggaaattaatctcactaatgactaccgtgtcagcggaggagtttcagaaatggtgtttaaagcaagcaagataacttttcactggggaaaatgcaatatgtcatctgatggatcagagcatagtttagaaggacaaaaatttccacttgagatgcaaatctactgctttgatgcggaccgattttcaagttttgaggaagcagtcaaaggaaaagggaagttaagagctttatccattttgtttgaggttgggacagaagaaaatttggatttcaaagcgattattgatggagtcgaaagtgttagtcgttttgggaagcaggctgctttagatccattcatactgttgaaccttctgccaaactcaactgacaagtattacatttacaatggctcattgacatctcctccctgcacagacacagttgactggattgtttttaaagatacagttagcatctctgaaagccagttggctgttttttgtgaagttcttacaatgcaacaatctggttatgtcatgctgatggactacttacaaaacaattttcgagagcaacagtacaagttctctagacaggtgttttcctcatacactggaaaggaagagattcatgaagcagtttgtagttcagaaccagaaaatgttcaggctgacccagagaattataccagccttcttgttacatgggaaagacctcgagtcgtttatgataccatgattgagaagtttgcagttttgtaccagcagttggatggagaggaccaaaccaagcatgaatttttgacagatggctatcaagacttgggtgctattctcaataatttgctacccaatatgagttatgttcttcagatagtagccatatgcactaatggcttatatggaaaatacagcgaccaactgattgtcgacatgcctactgataatcctgaacttgatcttttccctgaattaattggaactgaagaaataatcaaggaggaggaagagggaaaagacattgaagaaggcgctattgtgaatcctggtagagacagtgctacaaaccaaatcaggaaaaaggaaccccagatttctaccacaacacactacaatcgcatagggacgaaatacaatgaagccaagactaaccgatccccaacaagaggaagtgaattctctggaaagggtgatgttcccaatacatctttaaattccacttcccaaccagtcactaaattagccacagaaaaagatatttccttgacttctcagactgtgactgaactgccacctcacactgtggaaggtacttcagcctctttaaatgatggctctaaaactgttcttagatctccacatatgaacttgtcggggactgcagaatccttaaatacagtttctataacagaatatgaggaggagagtttattgaccagtttcaagcttgatactggagctgaagattcttcaggctccagtcccgcaacttctgctatcccattcatctctgagaacatatcccaagggtatatattttcctccgaaaacccagagacaataacatatgatgtccttataccagaatctgctagaaatgcttccgaagattcaacttcatcaggttcagaagaatcactaaaggatccttctatggagggaaatgtgtggtttcctagctctacagacataacagcacagcccgatgttggatcaggcagagagagctttctccagactaattacactgagatacgtgttgatgaatctgagaagacaaccaagtccttttctgcaggcccagtgatgtcacagggtccctcagttacagatctggaaatgccacattattctacctttgcctacttcccaactgaggtaacacctcatgcttttaccccatcctccagacaacaggatttggtctccacggtcaacgtggtatactcgcagacaacccaaccggtatacaatgaggccagtaatagtagccatgagtctcgtattggtctagctgaggggttggaatccgagaagaaggcagttataccccttgtgatcgtgtcagccctgacttttatctgtctagtggttcttgtgggtattctcatctactggaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaacacagaaaggggtgggggaactcacatctgagcattgttttcctcttcctaaaattaggcaggaaaatcagtctagttctgttatctgttgatttcccatcacctgacagtaactttcatgacataggattctgccgccaa

SEQ ID NO: 171940 - DNA, 1551 bp, Homo sapiens
  Payload ID: 13780
  Gene Symbol: PROZ
  Gene Name: protein Z, vitamin K-dependent plasma glycoprotein
  Uniprot ID: P22891
  ENST ID: ENST00000342783
  CDS Start-End: 8-1276
ggtgggaatggcaggctgcgtcccactgctccagggcctggtcctggtcctcgccctccatcgtgtggagccctcagccacttcactgaaggaacgacatggactccattctgactctgcctgcacaggcgtccaggaaagcttatttctcccggcctccaaagcaaacgacgttctggtgaggtggaagcgtgcgggctcctatcttctggaagaactcttcgagggaaacttggaaaaagaatgttatgaagaaatctgtgtctatgaagaagcaagagaagtgtttgaaaatgaagtagtcactgatgaattctggagacgatataagggcggctccccgtgcatctcccagccctgcctccacaacggctcttgccaggacagcatctggggctacacctgcacctgctcccccggctatgagggcagcaactgcgagctggctaaaaatgaatgtcacccagagcggactgatgggtgtcaacacttctgcctcccaggacaggaatcctacacatgcagctgtgctcagggctacaggcttggtgaggaccacaaacagtgtgtgccccacgaccagtgtgcctgcggggtgctgacctctgagaagcgtgcaccggatctacaggacctcccgtggcaggtaaagttaacaaattccgaaggaaaagacttctgtggtggtgttataatacgggaaaattttgtactgacaacagcaaaatgttcactgttacacaggaatattactgtaaaaacatattttaacagaacgagccaagacccgctgatgatcaagataacgcacgtccatgtgcacatgcggtatgacgcggacgcgggggagaatgacctgtcactgctggagctggagtggcccatccagtgcccaggtgcggggctccccgtgtgcacccctgagaaagacttcgctgagcacctcctcatcccacgcaccaggggcctcctcagcggctgggcacgcaatggcactgacctgggcaactcgctgaccacgcggcctgtcacacttgtggagggggaggagtgcgggcaggtcctgaatgtgactgtcaccaccaggacctactgtgagagaagcagcgtggcggccatgcactggatggatggaagtgtggtcaccagagaacacagaggctcctggtttctcacgggggtcctgggctcgcagccagtaggagggcaggctcacatggtccttgtcaccaaggtctccaggtactcactctggtttaaacagatcatgaactaactgaaactcagctagccagaatgaacaacacaaccggaagcgggattccaagctggcactgccactgtggagggcgctgaaacttcatcacacactgagaggccgtcacagccccagaccacccgcttggcccacgcagcagcagagccgccgtttgctgggttgtttaccgagcactgtgacctttctttccctggaactctttatctcaatagagaccttaaaagaaaacatgagatacgttaaataataaaataagataatctgtcagtcat

SEQ ID NO: 171941 - DNA, 1488 bp, Homo sapiens
  Payload ID: 13780
  Gene Symbol: PROZ
  Gene Name: protein Z, vitamin K-dependent plasma glycoprotein
  Uniprot ID: P22891
  ENST ID: ENST00000375547
  CDS Start-End: 8-1210
ggtgggaatggcaggctgcgtcccactgctccagggcctggtcctggtcctcgccctccatcgtgtggagccctcagtatttctcccggcctccaaagcaaacgacgttctggtgaggtggaagcgtgcgggctcctatcttctggaagaactcttcgagggaaacttggaaaaagaatgttatgaagaaatctgtgtctatgaagaagcaagagaagtgtttgaaaatgaagtagtcactgatgaattctggagacgatataagggcggctccccgtgcatctcccagccctgcctccacaacggctcttgccaggacagcatctggggctacacctgcacctgctcccccggctatgagggcagcaactgcgagctggctaaaaatgaatgtcacccagagcggactgatgggtgtcaacacttctgcctcccaggacaggaatcctacacatgcagctgtgctcagggctacaggcttggtgaggaccacaaacagtgtgtgccccacgaccagtgtgcctgcggggtgctgacctctgagaagcgtgcaccggatctacaggacctcccgtggcaggtaaagttaacaaattccgaaggaaaagacttctgtggtggtgttataatacgggaaaattttgtactgacaacagcaaaatgttcactgttacacaggaatattactgtaaaaacatattttaacagaacgagccaagacccgctgatgatcaagataacgcacgtccatgtgcacatgcggtatgacgcggacgcgggggagaatgacctgtcactgctggagctggagtggcccatccagtgcccaggtgcggggctccccgtgtgcacccctgagaaagacttcgctgagcacctcctcatcccacgcaccaggggcctcctcagcggctgggcacgcaatggcactgacctgggcaactcgctgaccacgcggcctgtcacacttgtggagggggaggagtgcgggcaggtcctgaatgtgactgtcaccaccaggacctactgtgagagaagcagcgtggcggccatgcactggatggatggaagtgtggtcaccagagaacacagaggctcctggtttctcacgggggtcctgggctcgcagccagtaggagggcaggctcacatggtccttgtcaccaaggtctccaggtactcactctggtttaaacagatcatgaactaactgaaactcagctagccagaatgaacaacacaaccggaagcgggattccaagctggcactgccactgtggagggcgctgaaacttcatcacacactgagaggccgtcacagccccagaccacccgcttggcccacgcagcagcagagccgccgtttgctgggttgtttaccgagcactgtgacctttctttccctggaactctttatctcaatagagaccttaaaagaaaacatgagatacgttaaataataaaataagataatctgtcagtcataaa

SEQ ID NO: 171942 - DNA, 841 bp, Homo sapiens; identical to SEQ ID NO: 164250
  Payload ID: 13781
  Gene Symbol:
  Gene Name: Protein-arginine deiminase type-4  [Source:UniProtKB/Swiss-Prot
  Acc:Q9UM07]
  ENST ID: ENST00000626048
  CDS Start-End: 29-412

SEQ ID NO: 171943 - DNA, 2267 bp, Homo sapiens; identical to SEQ ID NO: 164249
  Payload ID: 13781
  Gene Symbol:
  Gene Name: Protein-arginine deiminase type-4  [Source:UniProtKB/Swiss-Prot
  Acc:Q9UM07]
  Uniprot ID: Q9UM07
  ENST ID: ENST00000628229
  CDS Start-End: 27-2018

SEQ ID NO: 171944 - DNA, 2396 bp, Homo sapiens; identical to SEQ ID NO: 164251
  Payload ID: 13782
  Gene Symbol:
  Gene Name: Protein-arginine deiminase type-6  [Source:UniProtKB/Swiss-Prot
  Acc:Q6TGC4]
  Uniprot ID: Q6TGC4
  ENST ID: ENST00000625380
  CDS Start-End: 51-2135

SEQ ID NO: 171945 - DNA, 1026 bp, Homo sapiens
  Payload ID: 13783
  Gene Symbol: PRTN3
  Gene Name: proteinase 3
  Uniprot ID: P24158
  ENST ID: ENST00000234347
  CDS Start-End: 50-820
cattgggctataagaggagcttgaccgtgggtgcaccctggaccccaccatggctcaccggccccccagccctgccctggcgtccgtgctgctggccttgctgctgagcggtgctgcccgagctgcggagatcgtgggcgggcacgaggcgcagccacactcccggccctacatggcctccctgcagatgcgggggaacccgggcagccacttctgcggaggcaccttgatccaccccagcttcgtgctgacggccgcgcactgcctgcgggacataccccagcgcctggtgaacgtggtgctcggagcccacaacgtgcggacgcaggagcccacccagcagcacttctcggtggctcaggtgtttctgaacaactacgacgcggagaacaaactgaacgacgttctcctcatccagctgagcagcccagccaacctcagtgcctccgtcgccacagtccagctgccacagcaggaccagccagtgccccacggcacccagtgcctggccatgggctggggccgcgtgggtgcccacgaccccccagcccaggtcctgcaggagctcaatgtcaccgtggtcaccttcttctgccggccacataacatttgcactttcgtccctcgccgcaaggccggcatctgcttcggagactcaggtggccccctgatctgtgatggcatcatccaaggaatagactccttcgtgatctggggatgtgccacccgccttttccctgacttcttcacgcgggtagccctctacgtggactggatccgttccacgctgcgccgtgtggaggccaagggccgcccctgaaccgcccctcccacagcgctggccgggaccccgagcctggctccaaaccctcgaggcggatctttggacagaagcagctcttccccgaacactgtggcgtccgggacggccccacccgtccccccacactccctcccacggggctccgggagacaggccggccctgcacctcaccccaccgtgacctcaataaacgttgaaactcc

SEQ ID NO: 171946 - DNA, 1036 bp, Homo sapiens
  Payload ID: 13783
  Gene Symbol: PRTN3
  Gene Name: proteinase 3
  ENST ID: ENST00000544537
  CDS Start-End: 183-830
aggcactgaccgggttgcagatcgggagacggaggctcggagaggcccaggggctgctctgccatcccccctttccctgcagcctgggggctccctgacgcctggactccccccctgcaggtgctgcccgagctgcggagatcgtgggcgggcacgaggcgcagccacactcccggccctacatggcctccctgcagatgcgggggaacccgggcagccacttctgcggaggcaccttgatccaccccagcttcgtgctgacggccgcgcactgcctgcgggacataccccagcgcctggtgaacgtggtgctcggagcccacaacgtgcggacgcaggagcccacccagcagcacttctcggtggctcaggtgtttctgaacaactacgacgcggagaacaaactgaacgacgttctcctcatccagctgagcagcccagccaacctcagtgcctccgtcgccacagtccagctgccacagcaggaccagccagtgccccacggcacccagtgcctggccatgggctggggccgcgtgggtgcccacgaccccccagcccaggtcctgcaggagctcaatgtcaccgtggtcaccttcttctgccggccacataacatttgcactttcgtccctcgccgcaaggccggcatctgcttcggagactcaggtggccccctgatctgtgatggcatcatccaaggaatagactccttcgtgatctggggatgtgccacccgccttttccctgacttcttcacgcgggtagccctctacgtggactggatccgttccacgctgcgccgtgtggaggccaagggccgcccctgaaccgcccctcccacagcgctggccgggaccccgagcctggctccaaaccctcgaggcggatctttggacagaagcagctcttccccgaacactgtggcgtccgggacggccccacccgtccccccacactccctcccacggggctccgggagacaggccggccctgcacctcaccccaccgtgacctcaataaacgttgaaactcc

SEQ ID NO: 171947 - DNA, 1036 bp, Homo sapiens; identical to SEQ ID NO: 171946
  Payload ID: 13783
  Gene Symbol: PRTN3
  Gene Name: proteinase 3
  ENST ID: ENST00000622152
  CDS Start-End: 183-830

SEQ ID NO: 171948 - DNA, 1026 bp, Homo sapiens; identical to SEQ ID NO: 171945
  Payload ID: 13783
  Gene Symbol: PRTN3
  Gene Name: proteinase 3
  Uniprot ID: P24158
  ENST ID: ENST00000612112
  CDS Start-End: 50-820

SEQ ID NO: 171949 - DNA, 2864 bp, Homo sapiens; identical to SEQ ID NO: 140003
  Payload ID: 13784
  Gene Symbol:
  Gene Name: Protein-cysteine N-palmitoyltransferase HHAT  [Source:UniProtKB/Swiss-Prot
  Acc:Q5VTY9]
  ENST ID: ENST00000628249
  CDS Start-End: 284-532

SEQ ID NO: 171950 - DNA, 3626 bp, Homo sapiens; identical to SEQ ID NO: 139999
  Payload ID: 13784
  Gene Symbol:
  Gene Name: Protein-cysteine N-palmitoyltransferase HHAT  [Source:UniProtKB/Swiss-Prot
  Acc:Q5VTY9]
  Uniprot ID: Q5VTY9
  ENST ID: ENST00000625820
  CDS Start-End: 228-1709

SEQ ID NO: 171951 - DNA, 3594 bp, Homo sapiens; identical to SEQ ID NO: 139997
  Payload ID: 13784
  Gene Symbol:
  Gene Name: Protein-cysteine N-palmitoyltransferase HHAT  [Source:UniProtKB/Swiss-Prot
  Acc:Q5VTY9]
  Uniprot ID: Q5VTY9
  ENST ID: ENST00000629360
  CDS Start-End: 196-1677

SEQ ID NO: 171952 - DNA, 2714 bp, Homo sapiens; identical to SEQ ID NO: 139998
  Payload ID: 13784
  Gene Symbol:
  Gene Name: Protein-cysteine N-palmitoyltransferase HHAT  [Source:UniProtKB/Swiss-Prot
  Acc:Q5VTY9]
  ENST ID: ENST00000629127
  CDS Start-End: 246-797

SEQ ID NO: 171953 - DNA, 3507 bp, Homo sapiens; identical to SEQ ID NO: 140002
  Payload ID: 13784
  Gene Symbol:
  Gene Name: Protein-cysteine N-palmitoyltransferase HHAT  [Source:UniProtKB/Swiss-Prot
  Acc:Q5VTY9]
  Uniprot ID: Q5VTY9
  ENST ID: ENST00000628693
  CDS Start-End: 106-1590

SEQ ID NO: 171954 - DNA, 3164 bp, Homo sapiens; identical to SEQ ID NO: 140005
  Payload ID: 13784
  Gene Symbol:
  Gene Name: Protein-cysteine N-palmitoyltransferase HHAT  [Source:UniProtKB/Swiss-Prot
  Acc:Q5VTY9]
  Uniprot ID: Q5VTY9
  ENST ID: ENST00000625523
  CDS Start-End: 177-1247

SEQ ID NO: 171955 - DNA, 721 bp, Homo sapiens; identical to SEQ ID NO: 140000
  Payload ID: 13784
  Gene Symbol:
  Gene Name: Protein-cysteine N-palmitoyltransferase HHAT  [Source:UniProtKB/Swiss-Prot
  Acc:Q5VTY9]
  ENST ID: ENST00000631353
  CDS Start-End: 99-721

SEQ ID NO: 171956 - DNA, 3575 bp, Homo sapiens; identical to SEQ ID NO: 140001
  Payload ID: 13784
  Gene Symbol:
  Gene Name: Protein-cysteine N-palmitoyltransferase HHAT  [Source:UniProtKB/Swiss-Prot
  Acc:Q5VTY9]
  Uniprot ID: Q5VTY9
  ENST ID: ENST00000627903
  CDS Start-End: 177-1658

SEQ ID NO: 171957 - DNA, 3446 bp, Homo sapiens; identical to SEQ ID NO: 140004
  Payload ID: 13784
  Gene Symbol:
  Gene Name: Protein-cysteine N-palmitoyltransferase HHAT  [Source:UniProtKB/Swiss-Prot
  Acc:Q5VTY9]
  Uniprot ID: Q5VTY9
  ENST ID: ENST00000626327
  CDS Start-End: 243-1529

SEQ ID NO: 171958 - DNA, 3300 bp, Homo sapiens
  Payload ID: 13785
  Gene Symbol: PRKRIR
  Gene Name: protein-kinase, interferon-inducible double stranded RNA dependent inhibitor, repressor of (P58 repressor)
  Uniprot ID: O43422
  ENST ID: ENST00000260045
  CDS Start-End: 107-2392
cgagccggccggccggcctggctcccctccccggccccgacgggcgggcggactgccctgaggaggcggggaggggagggctgggccggccggcgggcgggcgacgatgccgaacttctgcgctgcccccaactgcacgcggaagagcacgcagtccgacttggccttcttcaggttcccgcgggaccctgccagatgccagaagtgggtggagaactgtaggagagcagacttagaagataaaacacctgatcagctaaataaacattatcgattatgtgccaaacattttgagacctctatgatctgtagaactagtccttataggacagttcttcgagataatgcaataccaacaatatttgatcttaccagtcatttgaacaacccacatagtagacacagaaaacgaataaaagaactgagtgaagatgaaatcaggacactgaaacagaaaaaaattgatgaaacttctgagcaggaacaaaaacataaagaaaccaacaatagcaatgctcagaaccccagcgaagaagagggtgaagggcaagatgaggacattttacctctaacccttgaagagaaggaaaacaaagaatacctaaaatctctatttgaaatcttgattctgatgggaaagcaaaacatacctctggatggacatgaggctgatgaaatcccagaaggtctctttactccagataactttcaggcactgctggagtgtcggataaattctggtgaagaggttctgagaaagcggtttgagacaacagcagttaacacgttgttttgttcaaaaacacagcagaggcagatgctagagatctgtgagagctgtattcgagaagaaactctcagggaagtgagagactcacacttcttttccattatcactgacgatgtagtggacatagcaggggaagagcacctacctgtgttggtgaggtttgttgatgaatctcataacctaagagaggaatttataggcttcctgccttatgaagccgatgcagaaattttggctgtgaaatttcacactatgataactgagaagtggggattaaatatggagtattgtcgtggccaggcttacattgtctctagtggattttcttccaaaatgaaagttgttgcttctagacttttagagaaatatccccaagctatctacacactctgctcttcctgtgccttaaatatgtggttggcaaaatcagtacctgttatgggagtatctgttgcattaggaacaattgaggaagtttgttcttttttccatcgatcaccacaactgcttttagaacttgacaacgtaatttctgttctttttcagaacagtaaagaaaggggtaaagaactgaaggaaatctgccattctcagtggacaggcaggcatgatgcttttgaaattttagtggaactcctgcaagcacttgttttatgtttagatggtataaatagtgacacaaatattagatggaataactatatagctggccgagcatttgtactctgcagtgcagtgtcagattttgatttcattgttactattgttgttcttaaaaatgtcctatcttttacaagagcctttgggaaaaacctccaggggcaaacctctgatgtcttctttgcggccggtagcttgactgcagtactgcattcactcaacgaagtgatggaaaatattgaagtttatcatgaattttggtttgaggaagccacaaatttggcaaccaaacttgatattcaaatgaaactccctgggaaattccgcagagctcaccagggtaacttggaatctcagctaacctctgagagttactataaagaaaccctaagtgtcccaacagtggagcacattattcaggaacttaaagatatattctcagaacagcacctcaaagctcttaaatgcttatctctggtaccctcagtcatgggacaactcaaattcaatacgtcggaggaacaccatgctgacatgtatagaagtgacttacccaatcctgacacgctgtcagctgagcttcattgttggagaatcaaatggaaacacagggggaaagatatagagcttccgtccaccatctatgaagccctccacctgcctgacatcaagttttttcctaatgtgtatgcattgctgaaggtcctgtgtattcttcctgtgatgaaggttgagaatgagcggtatgaaaatggacgaaagcgtcttaaagcatatttgaggaacactttgacagaccaaaggtcaagtaacttggctttgcttaacataaattttgatataaaacacgacctggatttaatggtggacacatatattaaactctatacaagtaagtcagagcttcctacagataattccgaaactgtggaaaatacctaagagacttttaaaaataggctttcttatatttgatatttggaagaaaaagccgtaaggtgtatgtagaccacttaatcactaaatatctttgcctataggactccattgaatacattagccattgataatctacctgtttaaatggcccctgtttgaactctcaagctttgaagacctacctgttcttccagaagagaacgttgaaagtgccatgtttccttttgcgtgatctctgttgatggcactctggaattgtttcagttaagtcattttagacatagcatttattatcactgtggatctctacttgttgggtgttatgaattctttgaagaaatatattttgaagaggtgtgggaggaaggaatacattttataaaatgttgtagtgaagcccacaattgacctttgactaataggagttttaagtatgttaaaaatctatactggacagttacaagaaattaccggagaaaagcttgtgagctcaccaaacaaggatttcagtgtagattttgtctttcttgaacttaaagaaacaaatgacaaagtttgaatggaaaagcctgctgttgttccacatctcgttgctgtttacattcctttgtggagcctacatcttcctaagctttttagcaggtatatgttgaacacttctgtttcatggttgagacagaatcagaggccatggatactgacaactgatttgtctgttttttttctctgtctttttccatgactcttatatactgcctcatcttgatttataagcaaaacctggaaaacctacaaaataagtgttgtggtttatctagaaaaatatggaaaatattgctgttatttttggtgaagaaaatcaattttgtatagtttatttcaatctaaataaaatgtgaattttgtttaaa

SEQ ID NO: 171959 - DNA, 882 bp, Homo sapiens
  Payload ID: 13785
  Gene Symbol: PRKRIR
  Gene Name: protein-kinase, interferon-inducible double stranded RNA dependent inhibitor, repressor of (P58 repressor)
  ENST ID: ENST00000528993
  CDS Start-End: 136-375
cccgcccctcccccgcgcgtcggccctgccgagccggccggccggcctggctcccctccccggccccgacgggcgggcggactgccctgaggaggcggggaggggagggctgggccggccggcgggcgggcgacgatgccgaacttctgcgctgcccccaactgcacgcggaagagcacgcagtccgacttggccttcttcaggttcccgcgggaccctgccagatgccagaagtgggtggagaactgtaggagagcagacttagaagataaaacacctgatcagctaaataaacattatcgattatgtgccaaacattttgagacctctatgatctgtagaactatacattttgcagaggcatcagaaaactaaagaatgattgggttattttatttctcaaaattaattgaagcagatacttgtgaagtcattgggagagtccttataggacagttcttcgagataatgcaataccaacaatatttgatcttaccagtcatttgaacaacccacatagtagacacagaaaacgaataaaagaactgagtgaagatgaaatcaggacactgaaacagaaaaaaattgatgaaacttctgagcaggaacaaaaacataaagaaaccaacaatagcaatgctcagaaccccagcgaagaagagggtgaagggcaagatgaggacattttacctctaacccttgaagagaaggaaaacaaagaatacctaaaatctctatttgaaatcttgattctgatgggaaagcaaaacatacctctggatggacatgaggctgatgaaatcccagaaggtctctttactccagataactttcaggcactgctggagtgtcggataaattctggtgaagaggttctgagaa

SEQ ID NO: 171960 - DNA, 1293 bp, Homo sapiens
  Payload ID: 13786
  Gene Symbol: PCMT1
  Gene Name: protein-L-isoaspartate (D-aspartate) O-methyltransferase
  ENST ID: ENST00000367378
  CDS Start-End: 285-1142
ccgccatcccgccgtcccgctcggtgaccggagacacagccgggaacgcgactgatcaggctaccgagccgggccgcagggcgaaagcggtgcggtccgaggcctcagaaagggacacgcagcagcggaagtggcgctgactcagcccggcctccctgcagtcccctggcagcggtagcagccacaggggcgggcggctgggccacacgcctcccccgccctcggccccacccggccgcaccctaagccgcgcggcgtcacagagcgcatgcgtgccgcgggggatgccgggagcgcgcagtggcggcagcggcggcgacggcagtaacagcggcagctacagcggggacgcgagcggggcggtgacggtgtgggaggtggtctcactcttgggaaaactgctgggcaccgtcgtcgcgctgaaggtggttctgtacctgctccgagtgtgcttagcgatggcctggaaatccggcggcgccagccactcggagctaatccacaatctccgcaaaaatggaatcatcaagacagataaagtatttgaagtgatgctggctacagaccgctcccactatgcaaaatgtaacccatacatggattctccacaatcaataggtttccaagcaacaatcagtgctccacacatgcatgcatatgcgctagaacttctatttgatcagttgcatgaaggagctaaagctcttgatgtaggatctggaagtggaatccttactgcatgttttgcacgtatggttggatgtactggaaaagtcataggaattgatcacattaaagagctagtagatgactcagtaaataatgtcaggaaggacgatccaacacttctgtcttcagggagagtacagcttgttgtgggggatggaagaatgggatatgctgaagaagccccttatgatgccattcatgtgggagctgcagcccctgttgtaccccaggcgctaatagatcagttaaagcccggaggaagattgatattgcctgttggtcctgcaggcggaaaccaaatgttggagcagtatgacaagctacaagatggcagcatcaaaatgaagcctctgatgggggtgatatacgtgcctttaacagataaagaaaagcagtggtccaggtggaagtgattttatcttctgctctttcttcttccacacatgcaaggtgaaagggtgtggattttaagacattagactacaagagctgtttttggttgtcacctttatgctcctccattataacgtcagaaattcattacattaaaaatgtgaaaaatgt

SEQ ID NO: 171961 - DNA, 1628 bp, Homo sapiens
  Payload ID: 13786
  Gene Symbol: PCMT1
  Gene Name: protein-L-isoaspartate (D-aspartate) O-methyltransferase
  Uniprot ID: P22061
  ENST ID: ENST00000367380
  CDS Start-End: 34-786
gcggcgtcacagagcgcatgcgtgccgcgggggatgccgggagcgcgcagtggcggcagcggcggcgacggcagtaacagcggcagctacagcggggacgcgagcggggcggtgacggtgtgggaggtggtctcactcttgggaaaactgctgggcaccgtcgtcgcgctgaaggtggttctgtacctgctccgagtgtgcttagcgatggcctggaaatccggcggcgccagccactcggagctaatccacaatctccgcagtttccaagcaacaatcagtgctccacacatgcatgcatatgcgctagaacttctatttgatcagttgcatgaaggagctaaagctcttgatgtaggatctggaagtggaatccttactgcatgttttgcacgtatggttggatgtactggaaaagtcataggaattgatcacattaaagagctagtagatgactcagtaaataatgtcaggaaggacgatccaacacttctgtcttcagggagagtacagcttgttgtgggggatggaagaatgggatatgctgaagaagccccttatgatgccattcatgtgggagctgcagcccctgttgtaccccaggcgctaatagatcagttaaagcccggaggaagattgatattgcctgttggtcctgcaggcggaaaccaaatgttggagcagtatgacaagctacaagatggcagcatcaaaatgaagcctctgatgggggtgatatacgtgcctttaacagataaagaaaagcagtggtccaggtggaagtgattttatcttctgctctttcttcttccacacatgcaagggatgaattgtaaaagcaacatcagcttgaccagtataaaattacagtggattgctcatctcagtcctcaaagctttttgaaaaccaacaccatcacagcttgttttggactttgttacactgttattttcagcatgaaaatgtgtgtttttttagggtttctgattcttcaaagaggcacagagccaaattggtagaggaaggatgcaaagtataaatttgtgtaatattactttaacatgcccatattttacttggaaatattaaaagaaagggttctgtaaaatggaaaacttagtttgtgaattgattttgaggagtggtttttcttttcttggacacttaattctgttctgatattaatttatcagattgcttttgtgcattggataacaccaccattcacaagttaagattcttggtatttggatatctgttagatgctactaagaaaatagagatgagctttctttttaaagcttttgatgtggtgtcatagaatagcatgttgtagatacaatcagctgctttgttaccttaaaactaggcatttgtaaatattaaaccataagatggcaggtgatgtcctgtaaacactcagctgttcagattggacataactgacttagttcttcccttctctctctctcaaaattataggagacttgtagtttagtgtggttttctgtttctaatttgctgctgataatgtatatgaacttaacatgctgtgtaagctgtgtcctagttcttgaacagtttatgcagtgctgctttgccaaataaagttaaaagtaaaagaggc

SEQ ID NO: 171962 - DNA, 1938 bp, Homo sapiens
  Payload ID: 13786
  Gene Symbol: PCMT1
  Gene Name: protein-L-isoaspartate (D-aspartate) O-methyltransferase
  ENST ID: ENST00000367384
  CDS Start-End: 286-1146
cccgccatcccgccgtcccgctcggtgaccggagacacagccgggaacgcgactgatcaggctaccgagccgggccgcagggcgaaagcggtgcggtccgaggcctcagaaagggacacgcagcagcggaagtggcgctgactcagcccggcctccctgcagtcccctggcagcggtagcagccacaggggcgggcggctgggccacacgcctcccccgccctcggccccacccggccgcaccctaagccgcgcggcgtcacagagcgcatgcgtgccgcgggggatgccgggagcgcgcagtggcggcagcggcggcgacggcagtaacagcggcagctacagcggggacgcgagcggggcggtgacggtgtgggaggtggtctcactcttgggaaaactgctgggcaccgtcgtcgcgctgaaggtggttctgtacctgctccgagtgtgcttagcgatggcctggaaatccggcggcgccagccactcggagctaatccacaatctccgcaaaaatggaatcatcaagacagataaagtatttgaagtgatgctggctacagaccgctcccactatgcaaaatgtaacccatacatggattctccacaatcaataggtttccaagcaacaatcagtgctccacacatgcatgcatatgcgctagaacttctatttgatcagttgcatgaaggagctaaagctcttgatgtaggatctggaagtggaatccttactgcatgttttgcacgtatggttggatgtactggaaaagtcataggaattgatcacattaaagagctagtagatgactcagtaaataatgtcaggaaggacgatccaacacttctgtcttcagggagagtacagcttgttgtgggggatggaagaatgggatatgctgaagaagccccttatgatgccattcatgtgggagctgcagcccctgttgtaccccaggcgctaatagatcagttaaagcccggaggaagattgatattgcctgttggtcctgcaggcggaaaccaaatgttggagcagtatgacaagctacaagatggcagcatcaaaatgaagcctctgatgggggtgatatacgtgcctttaacagataaagaaaagcagtggtccagggatgaattgtaaaagcaacatcagcttgaccagtataaaattacagtggattgctcatctcagtcctcaaagctttttgaaaaccaacaccatcacagcttgttttggactttgttacactgttattttcagcatgaaaatgtgtgtttttttagggtttctgattcttcaaagaggcacagagccaaattggtagaggaaggatgcaaagtataaatttgtgtaatattactttaacatgcccatattttacttggaaatattaaaagaaagggttctgtaaaatggaaaacttagtttgtgaattgattttgaggagtggtttttcttttcttggacacttaattctgttctgatattaatttatcagattgcttttgtgcattggataacaccaccattcacaagttaagattcttggtatttggatatctgttagatgctactaagaaaatagagatgagctttctttttaaagcttttgatgtggtgtcatagaatagcatgttgtagatacaatcagctgctttgttaccttaaaactaggcatttgtaaatattaaaccataagatggcaggtgatgtcctgtaaacactcagctgttcagattggacataactgacttagttcttcccttctctctctctcaaaattataggagacttgtagtttagtgtggttttctgtttctaatttgctgctgataatgtatatgaacttaacatgctgtgtaagctgtgtcctagttcttgaacagtttatgcagtgctgctttgccaaataaagttaaaagtaaaagaggc

SEQ ID NO: 171963 - DNA, 600 bp, Homo sapiens
  Payload ID: 13786
  Gene Symbol: PCMT1
  Gene Name: protein-L-isoaspartate (D-aspartate) O-methyltransferase
  ENST ID: ENST00000494411
  CDS Start-End: 2-394
gatgccgggagcgcgcagtggcggcagcggcggcgacggcagtaacagcggcagctacagcggggacgcgagcggggcggtgacggtgtgggaggtggtctcactcttgggaaaactgctgggcaccgtcgtcgcgctgaaggtggttctgtacctgctccgagtgtgcttagcgatggcctggaaatccggcggcgccagccactcggagctaatccacaatctccgcaaaaatggaatcatcaagacagataaagtatttgaagtgatgctggctacagaccgctcccactatgcaaaatgtaacccatacatggattctccacaatcaatagctgactctacaggagaagaaatttttagctgccgtactttagagggactgttttactagatgagcacgttaccctttggcatgattatattttctaattttaactgctgggtgacagtactctaatagaagtttccaagcaacaatcagtgctccacacatgcatgcatatgcgctagaacttctatttgatcagttgcatgaaggagctaaagctcttgatgtaggatctggaagtggaatccttactgcatgttttgcacgta

SEQ ID NO: 171964 - DNA, 1095 bp, Homo sapiens
  Payload ID: 13786
  Gene Symbol: PCMT1
  Gene Name: protein-L-isoaspartate (D-aspartate) O-methyltransferase
  ENST ID: ENST00000484601
  CDS Start-End: 285-659
ccgccatcccgccgtcccgctcggtgaccggagacacagccgggaacgcgactgatcaggctaccgagccgggccgcagggcgaaagcggtgcggtccgaggcctcagaaagggacacgcagcagcggaagtggcgctgactcagcccggcctccctgcagtcccctggcagcggtagcagccacaggggcgggcggctgggccacacgcctcccccgccctcggccccacccggccgcaccctaagccgcgcggcgtcacagagcgcatgcgtgccgcgggggatgccgggagcgcgcagtggcggcagcggcggcgacggcagtaacagcggcagctacagcggggacgcgagcggggcggtgacggtgtgggaggtggtctcactcttgggaaaactgctgggcaccgtcgtcgcgctgaaggtggttctgtacctgctccgagtgtgcttagcgatggcctggaaatccggcggcgccagccactcggagctaatccacaatctccgcaaaaatggaatcatcaagacagataaagtatttgaagtgatgctggctacagaccgctcccactatgcaaaatgtaacccatacatggattctccacaatcaataggttttgctgaactgctgagccttggcagtgggcgcctttgaggcttagaagtgcctcaggattctgtcagtcggctgccatgctatcttcttttgacgcactataacagtcagcagagaagatcctggggagcttctgaaccccgaaggcacctgctaccaccgctcagtgaaacttgcttcagaggcagaaagaagcaggtttccaagcaacaatcagtgctccacacatgcatgcatatgcgctagaacttctatttgatcagttgcatgaaggagctaaagctcttgatgtaggatctggaagtggaatccttactgcatgttttgcacgtatggttggatgtactggaaaagtcataggaattgatcacattaaagagctagtagatgactcagtaaataatgtcaggaaggacgatccaacacttctgtcttcagggagagtacagcttgttgtgggggatggaagaatggg

SEQ ID NO: 171965 - DNA, 801 bp, Homo sapiens
  Payload ID: 13786
  Gene Symbol: PCMT1
  Gene Name: protein-L-isoaspartate (D-aspartate) O-methyltransferase
  ENST ID: ENST00000486585
  CDS Start-End: 1-203
gggaggtggtctcactcttgggaaaactgctgggcaccgtcgtcgcgctgaaggtggttctgtacctgctccgagtgtgcttagcgatggcctggaaatccggcggcgccagccactcggagctaatccacaatctccgcagcatgatggctcatacctgtaataccagcactttgggaggacgaggaaggtggatcacctaagaaaatggaatcatcaagacagataaagtatttgaagtgatgctggctacagaccgctcccactatgcaaaatgtaacccatacatggattctccacaatcaatagaaagtcctgtatttaactccttctcctgaagcaggttttgctgaactgctgagccttggcagtgggcgcctttgaggcttagaagtgcctcaggattctgtcagtcggctgccatgctatcttcttttgacgcactataacagtcagcagagaagatcctggggagcttctgaaccccgaaggcacctgctaccaccgctcagtgaaacttgcttcagaggcagaaagaagcaggtttccaagcaacaatcagtgctccacacatgcatgcatatgcgctagaacttctatttgatcagttgcatgaaggagctaaagctcttgatgtaggatctggaagtggaatccttactgcatgttttgcacgtatggttggatgtactggaaaagtcataggaattgatcacattaaagagctagtagatgactcagtaaataatgtcaggaaggacgatccaacacttctgtcttcagggagagtacagcttgttg

SEQ ID NO: 171966 - DNA, 548 bp, Homo sapiens
  Payload ID: 13786
  Gene Symbol: PCMT1
  Gene Name: protein-L-isoaspartate (D-aspartate) O-methyltransferase
  ENST ID: ENST00000495487
  CDS Start-End: 261-548
gtccccgcgcgcctgttggagggcttcggcgcagagttgccccggtagtcccgaacggcgtgcgcttgcagtcgcctccctcgggacctgtcactcgtcgacgacgtggactggaaggggagagaaagagccaggggccgctgctggtgggggcaggggcagtcgtctccctgcaggccctgggggagggagtgcagtacaggtgatgctgctgtcactcagaaaatggaatcatcaagacagataaagtatttgaagtgatgctggctacagaccgctcccactatgcaaaatgtaacccatacatggattctccacaatcaataggtttccaagcaacaatcagtgctccacacatgcatgcatatgcgctagaacttctatttgatcagttgcatgaaggagctaaagctcttgatgtaggatctggaagtggaatccttactgcatgttttgcacgtatggttggatgtactggaaaagtcataggaattgatcacattaaagagctagtagatgactcagtaaataatgtcaggaaggacgat

SEQ ID NO: 171967 - DNA, 582 bp, Homo sapiens
  Payload ID: 13786
  Gene Symbol: PCMT1
  Gene Name: protein-L-isoaspartate (D-aspartate) O-methyltransferase
  ENST ID: ENST00000460828
  CDS Start-End: 2-364
gatgccgggagcgcgcagtggcggcagcggcggcgacggcagtaacagcggcagctacagcggggacgcgagcggggcggtgacggtgtgggaggtggtctcactcttgggaaaactgctgggcaccgtcgtcgcgctgaaggtggttctgtacctgctccgagtgtgcttagcgatggcctggaaatccggcggcgccagccactcggagctaatccacaatctccgcaaaaatggaatcatcaagacagataaagtatttgaagtgatgctggctacagaccgctcccactatgcaaaatgtaacccatacatggattctccacaatcaatagaaagtcctgtatttaactccttctcctgaagcaggttttgctgaactgctgagccttggcagtgggcgcctttgaggcttagaagtgcctcaggattctgtcagtcggctgccatgctatcttcttttgacgcactataacagtcagcagagaagatcctggggagcttctgaaccccgaaggcacctgctaccaccgctcagtgaaacttgcttcagaggcagaaagaagcaggtttccaagcaac

SEQ ID NO: 171968 - DNA, 1984 bp, Homo sapiens
  Payload ID: 13786
  Gene Symbol: PCMT1
  Gene Name: protein-L-isoaspartate (D-aspartate) O-methyltransferase
  ENST ID: ENST00000464889
  CDS Start-End: 285-1142
ccgccatcccgccgtcccgctcggtgaccggagacacagccgggaacgcgactgatcaggctaccgagccgggccgcagggcgaaagcggtgcggtccgaggcctcagaaagggacacgcagcagcggaagtggcgctgactcagcccggcctccctgcagtcccctggcagcggtagcagccacaggggcgggcggctgggccacacgcctcccccgccctcggccccacccggccgcaccctaagccgcgcggcgtcacagagcgcatgcgtgccgcgggggatgccgggagcgcgcagtggcggcagcggcggcgacggcagtaacagcggcagctacagcggggacgcgagcggggcggtgacggtgtgggaggtggtctcactcttgggaaaactgctgggcaccgtcgtcgcgctgaaggtggttctgtacctgctccgagtgtgcttagcgatggcctggaaatccggcggcgccagccactcggagctaatccacaatctccgcaaaaatggaatcatcaagacagataaagtatttgaagtgatgctggctacagaccgctcccactatgcaaaatgtaacccatacatggattctccacaatcaataggtttccaagcaacaatcagtgctccacacatgcatgcatatgcgctagaacttctatttgatcagttgcatgaaggagctaaagctcttgatgtaggatctggaagtggaatccttactgcatgttttgcacgtatggttggatgtactggaaaagtcataggaattgatcacattaaagagctagtagatgactcagtaaataatgtcaggaaggacgatccaacacttctgtcttcagggagagtacagcttgttgtgggggatggaagaatgggatatgctgaagaagccccttatgatgccattcatgtgggagctgcagcccctgttgtaccccaggcgctaatagatcagttaaagcccggaggaagattgatattgcctgttggtcctgcaggcggaaaccaaatgttggagcagtatgacaagctacaagatggcagcatcaaaatgaagcctctgatgggggtgatatacgtgcctttaacagataaagaaaagcagtggtccaggtggaagtgattttatcttctgctctttcttcttccacacatgcaagggatgaattgtaaaagcaacatcagcttgaccagtataaaattacagtggattgctcatctcagtcctcaaagctttttgaaaaccaacaccatcacagcttgttttggactttgttacactgttattttcagcatgaaaatgtgtgtttttttagggtttctgattcttcaaagaggcacagagccaaattggtagaggaaggatgcaaagtataaatttgtgtaatattactttaacatgcccatattttacttggaaatattaaaagaaagggttctgtaaaatggaaaacttagtttgtgaattgattttgaggagtggtttttcttttcttggacacttaattctgttctgatattaatttatcagattgcttttgtgcattggataacaccaccattcacaagttaagattcttggtatttggatatctgttagatgctactaagaaaatagagatgagctttctttttaaagcttttgatgtggtgtcatagaatagcatgttgtagatacaatcagctgctttgttaccttaaaactaggcatttgtaaatattaaaccataagatggcaggtgatgtcctgtaaacactcagctgttcagattggacataactgacttagttcttcccttctctctctctcaaaattataggagacttgtagtttagtgtggttttctgtttctaatttgctgctgataatgtatatgaacttaacatgctgtgtaagctgtgtcctagttcttgaacagtttatgcagtgctgctttgccaaataaagttaaaagtaaaagaggc

SEQ ID NO: 171969 - DNA, 1628 bp, Homo sapiens
  Payload ID: 13786
  Gene Symbol: PCMT1
  Gene Name: protein-L-isoaspartate (D-aspartate) O-methyltransferase
  ENST ID: ENST00000544496
  CDS Start-End: 34-786
gcggcgtcacagagcgcatgcgtgccgcgggggatgccgggagcgcgcagtggcggcagcggcggcgacggcagtaacagcggcagctacagcggggacgcgagcggggcggtgacggtgtgggaggtggtctcactcttgggaaaactgctgggcaccgtcgtcgcgctgaaggtggttctgtacctgctccgagtgtgcttagcgatggcctggaaatccggcggcgccagccactcggagctaatccacaatctccgcaaaaatggaatcatcaagacagataaagtatttgaagtgatgctggctacagaccgctcccactatgcaaaatgtaacccatacatggattctccacaatcaataggtttccaagcaacaatcagtgctccacacatggttggatgtactggaaaagtcataggaattgatcacattaaagagctagtagatgactcagtaaataatgtcaggaaggacgatccaacacttctgtcttcagggagagtacagcttgttgtgggggatggaagaatgggatatgctgaagaagccccttatgatgccattcatgtgggagctgcagcccctgttgtaccccaggcgctaatagatcagttaaagcccggaggaagattgatattgcctgttggtcctgcaggcggaaaccaaatgttggagcagtatgacaagctacaagatggcagcatcaaaatgaagcctctgatgggggtgatatacgtgcctttaacagataaagaaaagcagtggtccaggtggaagtgattttatcttctgctctttcttcttccacacatgcaagggatgaattgtaaaagcaacatcagcttgaccagtataaaattacagtggattgctcatctcagtcctcaaagctttttgaaaaccaacaccatcacagcttgttttggactttgttacactgttattttcagcatgaaaatgtgtgtttttttagggtttctgattcttcaaagaggcacagagccaaattggtagaggaaggatgcaaagtataaatttgtgtaatattactttaacatgcccatattttacttggaaatattaaaagaaagggttctgtaaaatggaaaacttagtttgtgaattgattttgaggagtggtttttcttttcttggacacttaattctgttctgatattaatttatcagattgcttttgtgcattggataacaccaccattcacaagttaagattcttggtatttggatatctgttagatgctactaagaaaatagagatgagctttctttttaaagcttttgatgtggtgtcatagaatagcatgttgtagatacaatcagctgctttgttaccttaaaactaggcatttgtaaatattaaaccataagatggcaggtgatgtcctgtaaacactcagctgttcagattggacataactgacttagttcttcccttctctctctctcaaaattataggagacttgtagtttagtgtggttttctgtttctaatttgctgctgataatgtatatgaacttaacatgctgtgtaagctgtgtcctagttcttgaacagtttatgcagtgctgctttgccaaataaagttaaaagtaaaagaggc

SEQ ID NO: 171970 - DNA, 4252 bp, Homo sapiens
  Payload ID: 13787
  Gene Symbol: PCMTD1
  Gene Name: protein-L-isoaspartate (D-aspartate) O-methyltransferase domain containing 1
  Uniprot ID: Q96MG8
  ENST ID: ENST00000360540
  CDS Start-End: 408-1481
ggcggctccggagtccgggaggctctggctgctccagtcgcgggtccgggccccgcctctccactcggcggtggcgtccgtgttgttattgtggtggtagcggcgtctggctgctgcggaccccgccgagtcctagcgcctggcctgcgcgccgctgcccgcgccacagccccatcactgagaagaattttttcactgtatagttgcctctgcacttaaagcaggcttggtccatgaatcccatgacaagagctttgaggacatgaggagcattctttgttcaaacatactgtgttttcctttggatcactggattaatttatttttggaaatcaagtgcaatattggaagccatttctactaattttatttcacttttaaatttatgatttgatttgaatactatcatgggaggagctgtgagtgctggggaagataatgatgacttaattgataatttaaaagaagctcagtatattcgtactgaaagagtggagcaagccttcagagcgattgatcgtggagattactatttggaaggctacagagacaatgcttacaaagacttagcctggaagcatggaaacatccacttgtcagcaccttgcatttattctgaagttatggaagcattgaaacttcaaccaggattgtcttttcttaacctgggaagtggaaccggatatttaagtacaatggtgggcttaattttaggtccttttggaataaatcatgggattgagcttcattcagatgtggtggaatatgccaaggaaaaactggagagcttcatcaaaaatagtgatagctttgataaatttgagttctgtgaacctgcatttgttgttggtaattgcctccagatagcttctgacagtcatcagtatgatcgaatttattgtggagctggagtgcagaaagaccatgaaaactacatgaaaatattactaaaagttggaggcatattagtcatgcctatagaggatcagttaacacagattatgcgaactggacagaacacttgggaaagtaaaaatatccttgctgtttcatttgctccacttgtgcaaccaagtaagaatgataatggcaaaccagattctgtgggactccctccctgtgctgtcaggaatctacaggacttggctcgtatttacattcgacgcacacttagaaatttcataaatgatgagatgcaggccaaggggattcctcaaagggctccacccaaaaggaaaagaaagagagttaaacagagaattaacacttacgtatttgtgggtaatcagcttattcctcagcctctagacagtgaagaggatgaaaaaatggaagaggataacaaagaagaggaggaaaaagatcacaatgaagcaatgaagccagaggagccacctcaaaatttactgagagaaaaaatcatgaagctgcccctccctgaatctttaaaagcttacttgacatattttagagacaaataacttagatcaagaagaaaaatgcctactgataattcctttagtcttgaaaatgtagcatttgttaggagttaaaagagagaattatttctttcatcagagcaaattatagtggaaaaaaaatcacttgtttctgtcagtaacacaaatgatgtattcagtgaataaaagaatcccttttataaaatctatttttctttaaatcttggaaaaatgttgttttagctcagagtgatttcaaagtggaatgcaacagtagtcaagacttgtgtactataaatccttttctgattccttacagatttgtagtgatgaggtttagatttaattttatatatggtttaaataattgttaagcttatataacctgatctgaattgcagttgtttgcatttcctctatgaaaacttcatttatctaataaggaagtcaaatgctttgtagactatttaccttacttttgttgcaatcactgttgttgggttgctgtatatatattccgggcaatatatgagtgcaataacaatacaagatattgaataatttagctttaaaaaatcccacaaattttatgaaattttacagccctgctacttttgcttttgaatctcttgccaaaagacatgggtaaaatatctgcctctctcatagagattttaagagcacagcaagtgaattattaaaacaaagtctatacttaatacaactctttatatggaccctttacattttcagtatttaaaaaaatgaggttatcttaactctatagaattttaaaagtatatttagaattgttttttctgtagttcactgtataaagtatttggttttttaaaaaaagcaaaaccattgttatgtgtgactcttgataggacacagaacgagtgaatgagcatgagtgaggccactttcttggatggctgtaagtagcagggccagggtagacctggtcagcggatgcactttagcagatggaacttctagtttatctgaatatttatctttgacaaggtagggctgagcctacatttgcttttgatctatctagtataagaaatattcacagaaattgtatgtagataccctttgttttgaaaatgctgttcagaatcatagtgtaatctttgggacctatgccatgttcatttcactccttcccatattttttgtgtttcttttggtaaaactataatggttttcattttttacttaatatcacacagttaaactgtccatatttgagctttattttagcttatcagtgataaaaaacaggtagtaactgccattgtttgtttgttttcctaataaggcctgaaaacagccattccttgttaagaaagtgtacaatgtaacatatttgctagagttacatggattatatatttcttaaagggaaaaatttgagagtatcatggactaccaccagcattattattacagtagttactcagatttggttaaggaagcccaagcaatgtatagtgaaaggattattatctctctgctaagattcagatattgtttcagaaatctcagctccagtaattccacaacatctaaaaacaaatgtttgtgatcatgtgtaagcatgaaattgttccaagtaagtgaggatattttagttatgtgaaagacagtttcatggaaggtatttgttttataccagtggctgggatggtggaattggggttatttctacaattattcttagacgattactaaactgttaagaaatgccccatatcatttttgtatctaggaaagaaaaaaatcagtttcatactgttgtcatctgtcagaaatgctcattttattttgaattaaatgtggcttttgaagtacctagttaccttgaattcctggtgaccacatgtttttatctggaaaacctggagaaagttatctgtcccatctcccctgcttgtttttttttttttttttggttggagctgctgtttagatgatgcttttactatgcaggagagagtttttgttaaggatatatttgaagattggcttttccatattgtccttcattctttgaccatggcaaagtgtacagtagattttcatgatcattgcatatttcttgtcattgaaatgtatcttttatgtttttaaatgcattcattttacacttgtgagtttatcattgactttaagaggtagaaatgaaaaatgaaaattaaagctaaagcctttttatctattaatgcagatatattagaataagaatattttgggtttgtgtttattttttaatgaatttatgtttacttgatatggaaaattacgctttataggtggaaaagtagcaaataaagattaagtaaaagtaagtgaaaatgatggggaatatagtattggaattttatagctagttaaaacagtaagtatcatctaatttgggtgtttattttgcagatgagaaaacagacctagaaccgtggcatgttttgcctgaaacatacagtgagttagagacagggcctaagatagcttctagcatcagatcaatcccaagaatccatcagcaacctcagaccaacccaagaagataatttaaatctatactgcttattggtcaatatatttggttctagtattaataaagaaaaatgttattaaaatagcatacatagtagtaaaataaaatacaaaaagtgtgttgatttatagctgtttgagatgataaaagtgaagcaaagcctgttaaatcattggaagacttggaaaattattttaaataaacaattacatgtaattaagca

SEQ ID NO: 171971 - DNA, 1287 bp, Homo sapiens
  Payload ID: 13787
  Gene Symbol: PCMTD1
  Gene Name: protein-L-isoaspartate (D-aspartate) O-methyltransferase domain containing 1
  Uniprot ID: Q96MG8
  ENST ID: ENST00000522514
  CDS Start-End: 203-1276
actcggcggtggcgtccgtgttgttattgtggtggtagcggcgtctggctgctgcggaccccgccgagtcctagcgcctggcctgcgcgccgctgcccgcgccacaggattaatttatttttggaaatcaagtgcaatattggaagccatttctactaattttatttcacttttaaatttatgatttgatttgaatactatcatgggaggagctgtgagtgctggggaagataatgatgacttaattgataatttaaaagaagctcagtatattcgtactgaaagagtggagcaagccttcagagcgattgatcgtggagattactatttggaaggctacagagacaatgcttacaaagacttagcctggaagcatggaaacatccacttgtcagcaccttgcatttattctgaagttatggaagcattgaaacttcaaccaggattgtcttttcttaacctgggaagtggaaccggatatttaagtacaatggtgggcttaattttaggtccttttggaataaatcatgggattgagcttcattcagatgtggtggaatatgccaaggaaaaactggagagcttcatcaaaaatagtgatagctttgataaatttgagttctgtgaacctgcatttgttgttggtaattgcctccagatagcttctgacagtcatcagtatgatcgaatttattgtggagctggagtgcagaaagaccatgaaaactacatgaaaatattactaaaagttggaggcatattagtcatgcctatagaggatcagttaacacagattatgcgaactggacagaacacttgggaaagtaaaaatatccttgctgtttcatttgctccacttgtgcaaccaagtaagaatgataatggcaaaccagattctgtgggactccctccctgtgctgtcaggaatctacaggacttggctcgtatttacattcgacgcacacttagaaatttcataaatgatgagatgcaggccaaggggattcctcaaagggctccacccaaaaggaaaagaaagagagttaaacagagaattaacacttacgtatttgtgggtaatcagcttattcctcagcctctagacagtgaagaggatgaaaaaatggaagaggataacaaagaagaggaggaaaaagatcacaatgaagcaatgaagccagaggagccacctcaaaatttactgagagaaaaaatcatgaagctgcccctccctgaatctttaaaagcttacttgacatattttagagacaaataacttagatcaag

SEQ ID NO: 171972 - DNA, 1712 bp, Homo sapiens
  Payload ID: 13787
  Gene Symbol: PCMTD1
  Gene Name: protein-L-isoaspartate (D-aspartate) O-methyltransferase domain containing 1
  ENST ID: ENST00000521344
  CDS Start-End: 280-597
gcatgcccggaccccggcggctccggagtccgggaggctctggctgctccagtcgcgggtccgggccccgcctctccactcggcggtggcgtccgtgttgttattgtggtggtagcggcgtctggctgctgcggaccccgccgagtcctagcgcctggcctgcgcgccgctgcccgcgccacaggattaatttatttttggaaatcaagtgcaatattggaagccatttctactaattttatttcacttttaaatttatgatttgatttgaatactatcatgggaggagctgtgagtgctggggaagataatgatgacttaattgataatttaaaagaagctcagtatattcgtactgaaagagtggagcaagccttcagagcgattgatcgtggagattactatttggaaggctacagagacaatgcttacaaagacttagcctggaagcatggaaacatccacttgtcagcaccttgcatttattctgaagttatggaagcattgaaacttcaaccaggattgtcttttcttaacctgggaagtggaaccggatatttaagtacaatgtattttgacctcagagtcctcaactgaaatgatggatcttgaattatttcatcttcagaactttatgtattgtgaagtactttttgcctgtggctatgttctgtaagttagctttacacaaaatactaaaggcacagtgaacttcattcaaatgcagtgtggaactctcaggtttccttggtctgcctcagtcttctactcatcagcaccacactgtcaaaatgttggacattacaaggggcgaacatagacataaataaaaaatattggtattgcatagacacttgatgcctaaacctaataattattaacttttatgtgcaagcttgggttcttgactaattggtaaatgataaatgaactagattagatccaattattagaaaagcactcttaagagtgcaatgaatgtgatttgaaaacttgaaagcagcctagattttactatatttgttattgttatcaatgggggtttgtcaaccttaaaaattattttttatgtaaagatacctaggaatttctaataactgtatttgttttaataaactttgactttgctgtatgtttctatgttctctttaatatttagctattaaaggtcaatattttctttttttaaaaaaaaagttacaaaaattaagcccttgtttcatagaaacatctttacattggcgaatacaaaataacattggaattcagagtcaaattcatgcctcagttggcctgttaatatcatcatcttttggataccatttcacttttttccattgacaacttgtacctattagctatatattacttgtttatttatttgaacatttatgttttttttaatctttcagtagcccattgttttttaattgaaaaagttatacacgcaaatggttaaaacaaattttatacaagagcatataatgataaaaatgtttccttaccaccctagatctcttagtcccctttctcagaagcagctatgtatgctttttcagttttctgttttattttcctgttgttctatttaatacagataccaaatgtgagttgtaataatcagcattgcattacatttttatacacttaatgcattcaaggtgtatatcacattctaaataaatgagatattggtgacattgctatttaaa

SEQ ID NO: 171973 - DNA, 814 bp, Homo sapiens
  Payload ID: 13787
  Gene Symbol: PCMTD1
  Gene Name: protein-L-isoaspartate (D-aspartate) O-methyltransferase domain containing 1
  ENST ID: ENST00000519554
  CDS Start-End: 1-392
atgggattgagcttcattcagatgtggtggaatatgccaaggaaaaactggagagcttcatcaaaaatagtgatagctttgataaatttgagttctgtgaacctgcatttgttgttggtaattgcctccagatagcttctgacagtcatcagtatgatcgaatttattgtggagctggagtgcagaaagaccatgaaaactacatgaaaatattactaaaagttggaggcatattagtcatgcctatagaggatcagttaacacagattatgcgaactggacagaacacttgggaaagtaaaaatatccttgctgtttcatttgctccacttgtgcaaccaagtaagaatgataatggcaaaccagattctgtgggactccaccttggttgaccatagaaagcggaaaccgtggaaagtgaaactgtgcataaagggagactactgtacttgaaattctacaataaggagaaaagtcatcagtaaccaacagtaacttataaaaataagtcaggaattatgtgaatttctaaaaaataaaagcttcatatagtaatattcagagcatgaaaatagttttgaaaattgatatttgccaaaatttaataggatgtatggagaataagtttttgtgggtgtgtagaagtaagttaaaatagctttctgttgagaggacattattccttaattgcaggaaattaaaatatgaaagaacgcgactccaaaaatcccaaaaataatatatatataaattatttgccaaatgtatcttgtagtaatcaagttgctcatattaaacaacttactaaagtgga

SEQ ID NO: 171974 - DNA, 3697 bp, Homo sapiens
  Payload ID: 13787
  Gene Symbol: PCMTD1
  Gene Name: protein-L-isoaspartate (D-aspartate) O-methyltransferase domain containing 1
  ENST ID: ENST00000544451
  CDS Start-End: 76-921
agatgggggcgtctcccggccttgttgactttggcgtccgcggggagctgcccctgtgcccgtggttctctgcgcatgcccggaccccggcggctccggagtccgggaggctctggctgctccagtcgcgggtccgggccccgcctctccactcggcggtggcgtccgtgttgttattgtggtggtagcggcgtctggctgctgcggaccccgccgagtcctagcgcctggcctgcgcgccgctgcccgcgccacagatttgagttctgtgaacctgcatttgttgttggtaattgcctccagatagcttctgacagtcatcagtatgatcgaatttattgtggagctggagtgcagaaagaccatgaaaactacatgaaaatattactaaaagttggaggcatattagtcatgcctatagaggatcagttaacacagattatgcgaactggacagaacacttgggaaagtaaaaatatccttgctgtttcatttgctccacttgtgcaaccaagtaagaatgataatggcaaaccagattctgtgggactccctccctgtgctgtcaggaatctacaggacttggctcgtatttacattcgacgcacacttagaaatttcataaatgatgagatgcaggccaaggggattcctcaaagggctccacccaaaaggaaaagaaagagagttaaacagagaattaacacttacgtatttgtgggtaatcagcttattcctcagcctctagacagtgaagaggatgaaaaaatggaagaggataacaaagaagaggaggaaaaagatcacaatgaagcaatgaagccagaggagccacctcaaaatttactgagagaaaaaatcatgaagctgcccctccctgaatctttaaaagcttacttgacatattttagagacaaataacttagatcaagaagaaaaatgcctactgataattcctttagtcttgaaaatgtagcatttgttaggagttaaaagagagaattatttctttcatcagagcaaattatagtggaaaaaaaatcacttgtttctgtcagtaacacaaatgatgtattcagtgaataaaagaatcccttttataaaatctatttttctttaaatcttggaaaaatgttgttttagctcagagtgatttcaaagtggaatgcaacagtagtcaagacttgtgtactataaatccttttctgattccttacagatttgtagtgatgaggtttagatttaattttatatatggtttaaataattgttaagcttatataacctgatctgaattgcagttgtttgcatttcctctatgaaaacttcatttatctaataaggaagtcaaatgctttgtagactatttaccttacttttgttgcaatcactgttgttgggttgctgtatatatattccgggcaatatatgagtgcaataacaatacaagatattgaataatttagctttaaaaaatcccacaaattttatgaaattttacagccctgctacttttgcttttgaatctcttgccaaaagacatgggtaaaatatctgcctctctcatagagattttaagagcacagcaagtgaattattaaaacaaagtctatacttaatacaactctttatatggaccctttacattttcagtatttaaaaaaatgaggttatcttaactctatagaattttaaaagtatatttagaattgttttttctgtagttcactgtataaagtatttggttttttaaaaaaagcaaaaccattgttatgtgtgactcttgataggacacagaacgagtgaatgagcatgagtgaggccactttcttggatggctgtaagtagcagggccagggtagacctggtcagcggatgcactttagcagatggaacttctagtttatctgaatatttatctttgacaaggtagggctgagcctacatttgcttttgatctatctagtataagaaatattcacagaaattgtatgtagataccctttgttttgaaaatgctgttcagaatcatagtgtaatctttgggacctatgccatgttcatttcactccttcccatattttttgtgtttcttttggtaaaactataatggttttcattttttacttaatatcacacagttaaactgtccatatttgagctttattttagcttatcagtgataaaaaacaggtagtaactgccattgtttgtttgttttcctaataaggcctgaaaacagccattccttgttaagaaagtgtacaatgtaacatatttgctagagttacatggattatatatttcttaaagggaaaaatttgagagtatcatggactaccaccagcattattattacagtagttactcagatttggttaaggaagcccaagcaatgtatagtgaaaggattattatctctctgctaagattcagatattgtttcagaaatctcagctccagtaattccacaacatctaaaaacaaatgtttgtgatcatgtgtaagcatgaaattgttccaagtaagtgaggatattttagttatgtgaaagacagtttcatggaaggtatttgttttataccagtggctgggatggtggaattggggttatttctacaattattcttagacgattactaaactgttaagaaatgccccatatcatttttgtatctaggaaagaaaaaaatcagtttcatactgttgtcatctgtcagaaatgctcattttattttgaattaaatgtggcttttgaagtacctagttaccttgaattcctggtgaccacatgtttttatctggaaaacctggagaaagttatctgtcccatctcccctgcttgtttttttttttttttttggttggagctgctgtttagatgatgcttttactatgcaggagagagtttttgttaaggatatatttgaagattggcttttccatattgtccttcattctttgaccatggcaaagtgtacagtagattttcatgatcattgcatatttcttgtcattgaaatgtatcttttatgtttttaaatgcattcattttacacttgtgagtttatcattgactttaagaggtagaaatgaaaaatgaaaattaaagctaaagcctttttatctattaatgcagatatattagaataagaatattttgggtttgtgtttattttttaatgaatttatgtttacttgatatggaaaattacgctttataggtggaaaagtagcaaataaagattaagtaaaagtaagtgaaaatgatggggaatatagtattggaattttatagctagttaaaacagtaagtatcatctaatttgggtgtttattttgcagatgagaaaacagacctagaaccgtggcatgttttgcctgaaacatacagtgagttagagacagggcctaagatagcttctagcatcagatcaatcccaagaatccatcagcaacctcagaccaacccaagaagataatttaaatctatactgcttattggtcaatatatttggttctagtattaataaagaaaaatgttattaaaatagcatacatagtagtaaaataaaatacaaaaagtgtgttgatttatagctgtttgagatgataaaagtgaagcaaagcctgttaaatcattggaagacttggaaaattattttaaataaacaattacatgtaattaagcattttt

SEQ ID NO: 171975 - DNA, 1049 bp, Homo sapiens
  Payload ID: 13788
  Gene Symbol: PCMTD2
  Gene Name: protein-L-isoaspartate (D-aspartate) O-methyltransferase domain containing 2
  ENST ID: ENST00000299468
  CDS Start-End: 201-1049
gcagtcaggccgttgtgcgcaggcgcagaggcggcggcggcggcggcggcggcggatgtttacggcggccgaggttggagcggcgctgctcggccgcggacacacgagggacgcgcccgaggagctgcaggtggcagcccaggcggtccgaacccgtcggccggccgagcctggagtattgcctaagtgtaatcttgaacatgggcggtgctgtgagtgctggtgaagacaatgatgagctgatagataatttgaaagaagcacagtatatccggactgagctggtagagcaggctttcagagctatcgatcgtgcagactattatcttgaagaatttaaagaaaatgcttataaagacttggcatggaagcatggaaacattcacctctcagccccgtgcatctactcggaggtgatggaagccctagatctgcagcctggactctcgtttctgaacctgggcagtggcactgggtatctcagctccatggtgggcctcattctaggtccttttggtgtgaaccatggggtggaacttcactcagatgtgatagagtatgcaaagcagaaactggacttcttcatcagaacaagtgatagttttgacaagtttgacttctgtgaaccttcctttgttactgggaattgcctggagatttctccggattgttctcagtatgatcgtgtatactgtggggctggcgtgcagaaagagcatgaagagtacatgaagaatcttctcaaagtgggagggatccttgtcatgccactggaagagaagttgactaagataacacgcacaggtccttcagcttgggaaaccaaaaagattcttgctgtttcttttgctcctctgatccagccctgccattcagagtcaggaaaatcaagacttgtccagttacggtctccctcttttgtccaaggctggagtgtggtagtgctatcacagctgactgcagcctcaaccttccaggctgaagcgatcctcccatctcaatctcctacgtggctgacactacaggtgcttgccactatgcccaactaa

SEQ ID NO: 171976 - DNA, 3843 bp, Homo sapiens
  Payload ID: 13788
  Gene Symbol: PCMTD2
  Gene Name: protein-L-isoaspartate (D-aspartate) O-methyltransferase domain containing 2
  Uniprot ID: Q9NV79
  ENST ID: ENST00000308824
  CDS Start-End: 128-1213
gttggagcggcgctgctcggccgcggacacacgagggacgcgcccgaggagctgcaggtggcagcccaggcggtccgaacccgtcggccggccgagcctggagtattgcctaagtgtaatcttgaacatgggcggtgctgtgagtgctggtgaagacaatgatgagctgatagataatttgaaagaagcacagtatatccggactgagctggtagagcaggctttcagagctatcgatcgtgcagactattatcttgaagaatttaaagaaaatgcttataaagacttggcatggaagcatggaaacattcacctctcagccccgtgcatctactcggaggtgatggaagccctagatctgcagcctggactctcgtttctgaacctgggcagtggcactgggtatctcagctccatggtgggcctcattctaggtccttttggtgtgaaccatggggtggaacttcactcagatgtgatagagtatgcaaagcagaaactggacttcttcatcagaacaagtgatagttttgacaagtttgacttctgtgaaccttcctttgttactgggaattgcctggagatttctccggattgttctcagtatgatcgtgtatactgtggggctggcgtgcagaaagagcatgaagagtacatgaagaatcttctcaaagtgggagggatccttgtcatgccactggaagagaagttgactaagataacacgcacaggtccttcagcttgggaaaccaaaaagattcttgctgtttcttttgctcctctgatccagccctgccattcagagtcaggaaaatcaagacttgtccagttaccaccagtggcagttcgcagcctccaggacttggctcgcatcgccatccggggcaccattaaaaagattattcatcaggaaactgtgagcaaaaacggaaacggactaaagaacacccccaggtttaaacgaaggagagttcgccgccgtcgaatggaaacgattgtctttttggacaaagaagtctttgccagtcggatttccaacccctcagatgacaacagctgtgaagacttggaagaggaacggagggaagaagaagagaagaccccgccggaaacaaagccagaccccccagtgaacttcctacgccagaaggtcctgagcctccctctgccagatcccctgaaatactacttgctttattacagagaaaaataagtctcctgtttgaaagggggaaataggaagagcagattgctgagtgtgaagttcgtgctgcctgtgtgctgttgaagggtcacctggaggcagacgttgtggggaagggaactgctgggctcatccacaccatggttttcttctagttcctgattgacctctaaaattctattcagttgtatgatttgtttacatagttccacaagaccttcattgcatagaagattgttttcccaaagtggagagaatcttcatagagaaaaagagaaggctgtttctttttcggctctgacgaaacactgaagtctgcgtaagagagactgtttgatgaccgtccctcatgcaacatgcacggtactcactaaaaatgaaaactgaagtggaaactaacctgtgttgcttataaagtgtgaaagcacaagcttataaatgtataaaatcttttctgggtgtgacgcacctgcgtccaagtttgaatttttatgatatgtaccacttaattactggcactgagtatcactgaatttcttagttttctagtggggaaacattattgagaagccctcccttattttaagtaagttgattaaatcttatgtgagttgccagttgtaatttttcaaaggaaaaattttgatggggtggaggaatgaattgccagataatctttctggaattccgagagaattccaaagagggtttttttttttttttttaggacatcttttgatacctttaaaagaaccactgtcaagtaatccttaaaagaatatcttggaaaaggaaacagattttttcctgtgtgtaagcaataagtgaagttacatttgccctaaccctagggatgattctttacccagttttaaagcccatcatggtattctaaggtgttgacaccctccatcctcagagcaggtcgaaaatattaaatagactggggactctatgatgggcagcctgtgctttttgacttcagtttgctatttttctgtgatcacattagtactgattcatagattctatcttttataattctggagaaaaagatttgttagttttgtaatttttttgtaagaccaaatgtatgtattttagtagctccattgcatgagaagagtgtaactcacactgacttgtgatatcagccttctctgggccttgtgtgtggagagctttctatcttaccaagtggtagggctaaaagaacaacagcctttttggtagtcacatagcagaatgatcagagttacattgcttattccaaaacattggttctttttaaaacatttttttttacccaaagaaaagaataatagaaattactaacaataaatataaattcagagtgttgatataggattcagtatccagagtttatttttaatcttaatcctcagcttcttgggagttgctgggcttcagtgtctctgtggtttcaccagcttagcttgagctctggttattttggatcttttctgctttttttaagtaactgagtcatttttaccacacagtccagtttgcatgtatagctaggaaacatgtattgctctagattgggcagtttaagtcattttaaagaaagttagttcatagttgttgccttttaactcatagtcaagcttcagtctttcaaagagaaatgtgtgattttcatttacttgctgatattttgtagtttggagatccttgtgggcattattctaactgatacgtagacacttacttggaaatttttggacattatattaaatgagtgctatctgtgaaattggttatattaggtggcttgactaatgttttttctataattgtatatggactgcatttttaaaaaaaccgcatttgcctttatgctagattgtaaaaaattatattagaatgcataagacatgtttttccttcatatgctagacttttcctagcatttcgtatttctgtgttgtcagtgtgtgatttttaaaccggaatttggtttaaaaaaaatctggtggtaatatatgtgagaaatactttggtgtttaccttatgaaaataaaggattgtaagtaaagtttcctgcgcaccttataccagaattcagtataatacactactttctgttttcaaacagataaatcataatatagtctgtattatctgtaagatctgtcttgtaaaccacattcttgacaactatttgcttttgagtagtttgtattttaatatgtgacttttgtcttgaaaagtagtaaagccatagacttgtgcaaaacaagtttcaagtttatagatattaagtttgtaatgtgagcatcaaatgtgtatgtaaaaatactttttaccagtctggaacttgggaaaatccagggaatttgaaacatagattttaatgagctggtaaacacaaatcatgtcaataaaggtagtcaggatattttatccttagcattgcttctgcatcctgtgtaggattccaattcttgaatatgttcttttcaaaatcttaagaaaagaaccttttttctttattaacatcatgtgtttactttcagcaaatatttgtattactgcttgattctgtgacagtcacaatagatgtagagaaggcattatttttcattaataaatgtgaaattggaatggacaaa

SEQ ID NO: 171977 - DNA, 3212 bp, Homo sapiens
  Payload ID: 13788
  Gene Symbol: PCMTD2
  Gene Name: protein-L-isoaspartate (D-aspartate) O-methyltransferase domain containing 2
  Uniprot ID: Q9NV79
  ENST ID: ENST00000369758
  CDS Start-End: 155-1159
cggcggcggatgtttacggcggccgaggttggagcggcgctgctcggccgcggacacacgagggacgcgcccgaggagctgcaggtggcagcccaggcggtccgaacccgtcggccggccgagcctggagtattgcctaagtgtaatcttgaacatgggcggtgctgtgagtgctggtgaagacaatgatgagctgatagataatttgaaagaagcacagtatatccggactgagctggtagagcaggctttcagagctatcgatcgtgcagactattatcttgaagaatttaaagaaaatgcttataaagacttggcatggaagcatggaaacattcacctctcagccccgtgcatctactcggaggtgatggaagccctagatctgcagcctggactctcgtttctgaacctgggcagtggcactgggtatctcagctccatggtgggcctcattctaggtccttttggtgtgaaccatggggtggaacttcactcagatgtgatagagtatgcaaagcagaaactggacttcttcatcagaacaagtgatagttttgacaagtttgacttctgtgaaccttcctttgttactgggaattgcctggagatttctccggattgttctcagtatgatcgtgtatactgtggggctggcgtgcagaaagagcatgaagagtacatgaagaatcttctcaaagtgggagggatccttgtcatgccactggaagagaagccctgccattcagagtcaggaaaatcaagacttgtccagttaccaccagtggcagttcgcagcctccaggacttggctcgcatcgccatccggggcaccattaaaaagattattcatcaggaaactgtgagcaaaaacggaaacggactaaagaacacccccaggtttaaacgaaggagagttcgccgccgtcgaatggaaacgattgtctttttggacaaagaagtctttgccagtcggatttccaacccctcagatgacaacagctgtgaagacttggaagaggaacggagggaagaagaagagaagaccccgccggaaacaaagccagaccccccagtgaacttcctacgccagaaggtcctgagcctccctctgccagatcccctgaaatactacttgctttattacagagaaaaataagtctcctgtttgaaagggggaaataggaagagcagattgctgagtgtgaagttcgtgctgcctgtgtgctgttgaagggtcacctggaggcagacgttgtggggaagggaactgctgggctcatccacaccatggttttcttctagttcctgattgacctctaaaattctattcagttgtatgatttgtttacatagttccacaagaccttcattgcatagaagattgttttcccaaagtggagagaatcttcatagagaaaaagagaaggctgtttctttttcggctctgacgaaacactgaagtctgcgtaagagagactgtttgatgaccgtccctcatgcaacatgcacggtactcactaaaaatgaaaactgaagtggaaactaacctgtgttgcttataaagtgtgaaagcacaagcttataaatgtataaaatcttttctgggtgtgacgcacctgcgtccaagtttgaatttttatgatatgtaccacttaattactggcactgagtatcactgaatttcttagttttctagtggggaaacattattgagaagccctcccttattttaagtaagttgattaaatcttatgtgagttgccagttgtaatttttcaaaggaaaaattttgatggggtggaggaatgaattgccagataatctttctggaattccgagagaattccaaagagggtttttttttttttttttaggacatcttttgatacctttaaaagaaccactgtcaagtaatccttaaaagaatatcttggaaaaggaaacagattttttcctgtgtgtaagcaataagtgaagttacatttgccctaaccctagggatgattctttacccagttttaaagcccatcatggtattctaaggtgttgacaccctccatcctcagagcaggtcgaaaatattaaatagactggggactctatgatgggcagcctgtgctttttgacttcagtttgctatttttctgtgatcacattagtactgattcatagattctatcttttataattctggagaaaaagatttgttagttttgtaatttttttgtaagaccaaatgtatgtattttagtagctccattgcatgagaagagtgtaactcacactgacttgtgatatcagccttctctgggccttgtgtgtggagagctttctatcttaccaagtggtagggctaaaagaacaacagcctttttggtagtcacatagcagaatgatcagagttacattgcttattccaaaacattggttctttttaaaacatttttttttacccaaagaaaagaataatagaaattactaacaataaatataaattcagagtgttgatataggattcagtatccagagtttatttttaatcttaatcctcagcttcttgggagttgctgggcttcagtgtctctgtggtttcaccagcttagcttgagctctggttattttggatcttttctgctttttttaagtaactgagtcatttttaccacacagtccagtttgcatgtatagctaggaaacatgtattgctctagattgggcagtttaagtcattttaaagaaagttagttcatagttgttgccttttaactcatagtcaagcttcagtctttcaaagagaaatgtgtgattttcatttacttgctgatattttgtagtttggagatccttgtgggcattattctaactgatacgtagacacttacttggaaatttttggacattatattaaatgagtgctatctgtgaaattggttatattaggtggcttgactaatgttttttctataattgtatatggactgcatttttaaaaaaaccgcatttgcctttatgctagattgtaaaaaattatattagaatgcataagacatgtttttccttcatatgctagacttttcctagcatttcgtatttctgtgttgtcagtgtgtgatttttaaaccggaatttggtttaaaaaaaatctggtggtaatatatgtgagaaatactttggtgtttaccttatgaaaataaaggattgtaagtaaa

SEQ ID NO: 171978 - DNA, 551 bp, Homo sapiens
  Payload ID: 13788
  Gene Symbol: PCMTD2
  Gene Name: protein-L-isoaspartate (D-aspartate) O-methyltransferase domain containing 2
  ENST ID: ENST00000609818
  CDS Start-End: 1-551
aacaatttcctgcatttcacaaatgaggaaacagaggcagggacaggtgagggagatgcagggtcacgcacatgccctagctggggccagaagctgactcagttgactaagataacacgcacaggtccttcagcttgggaaaccaaaaagattcttgctgtttcttttgctcctctgatccagccctgccattcagagtcaggaaaatcaagacttgtccagttaccaccagtggcagttcgcagcctccaggacttggctcgcatcgccatccggggcaccattaaaaagattattcatcaggaaactgtgagcaaaaacggaaacggactaaagaacacccccaggtttaaacgaaggagagttcgccgccgtcgaatggaaacgattgtctttttggacaaagaagtctttgccagtcggatttccaacccctcagatgacaacagctgtgaagacttggaagaggaacggagggaagaagaagagaagaccccgccggaaacaaagccagaccccccagtgaacttcctacgccagaaggtcctgag

SEQ ID NO: 171979 - DNA, 476 bp, Homo sapiens
  Payload ID: 13788
  Gene Symbol: PCMTD2
  Gene Name: protein-L-isoaspartate (D-aspartate) O-methyltransferase domain containing 2
  ENST ID: ENST00000610196
  CDS Start-End: 194-476
acggcggccgaggttggagcggcgctgctcggccgcggacacacgagggacgcgcccgaggagctgcaggtggcagcccaggcggtccgaacccgtcggccggccgagcctggaggtagagccgccgccgccgccgccgcccctcggtccggcctgcggcgagcgggtgtattgcctaagtgtaatcttgaacatgggcggtgctgtgagtgctggtgaagacaatgatgagctgatagataatttgaaagaagcacagtatatccggactgagctggtagagcaggctttcagagctatcgatcgtgcagactattatcttgaagaatttaaagaaaatgcttataaagacttggcatggaagcatggaaacattcacctctcagccccgtgcatctactcggaggtgatggaagccctagatctgcagcctggactctcgtttctgaacctgggcagtggcactgggtatctca

SEQ ID NO: 171980 - DNA, 541 bp, Homo sapiens
  Payload ID: 13788
  Gene Symbol: PCMTD2
  Gene Name: protein-L-isoaspartate (D-aspartate) O-methyltransferase domain containing 2
  ENST ID: ENST00000610074
  CDS Start-End: 136-541
aatctattattttcagaattcagaatttcaaattggtatctgtttagaacttctattgttctgctcttacctttaacataaatcgctctttttaaacatttttaattatagtattgcctaagtgtaatcttgaacatgggcggtgctgtgagtgctggtgaagacaatgatgagctgatagataatttgaaagaagcacagtatatccggactgagctggtagagcaggctttcagagctatcgatcgtgcagactattatcttgaagaatttaaagaaaatgcttataaagacttggcatggaagcatggaaacattcacctctcagccccgtgcatctactcggaggtgatggaagccctagatctgcagcctggactctcgtttctgaacctgggcagtggcactgggtatctcagctccatggtgggcctcattctaggtccttttggtgtgaaccatggggtggaacttcactcagatgtgatagagtatgcaaagcagaaactggacttcttcatcagaacaagtgatagttttg

SEQ ID NO: 171981 - DNA, 528 bp, Homo sapiens
  Payload ID: 13788
  Gene Symbol: PCMTD2
  Gene Name: protein-L-isoaspartate (D-aspartate) O-methyltransferase domain containing 2
  ENST ID: ENST00000608844
  CDS Start-End: 1-214
ctattatcttgaagaatttaaagaaaatgcttataaagacttggcatggaagcatggaaacattcacctctcagccccgtgcatctactcggaggtgatggaagccctagatctgcagcctggactctcgtttctgaacctgggcagtggcactgggtatctcagctccatggtgggcctcattctagatgctgcagcttttattcaagcttaatagcacttggtgcagagcactccagagtgaaacctcattggcttcccggcgcctgtggatgtgggtctctcatctgacggagttctttactgtgacccccgactgcctttcgcatggcctgagcggcatcctgggggagaatacagtagctactaagagatggtggctcataagtcacctacctgaaaagtgctgggtgattcggaagcagggcagacctaggagcggctctgccaggggggcctcgctgctctggtttcatgccgtgctccagtgctgagtcccaggtgccgtgttcctgacaccccccggcc

SEQ ID NO: 171982 - DNA, 572 bp, Homo sapiens
  Payload ID: 13788
  Gene Symbol: PCMTD2
  Gene Name: protein-L-isoaspartate (D-aspartate) O-methyltransferase domain containing 2
  ENST ID: ENST00000609764
  CDS Start-End: 168-572
gaacccgtcggccggccgagcctggagaaaatgtcttcatgaggtctggtggtctttttccctgacaatttgtatctggtgttttgtaaagcattaccattttatatgaagttaaagcagttactttgaaaaagttacatgggtattgcctaagtgtaatcttgaacatgggcggtgctgtgagtgctggtgaagacaatgatgagctgatagataatttgaaagaagcacagtatatccggactgagctggtagagcaggctttcagagctatcgatcgtgcagactattatcttgaagaatttaaagaaaatgcttataaagacttggcatggaagcatggaaacattcacctctcagccccgtgcatctactcggaggtgatggaagccctagatctgcagcctggactctcgtttctgaacctgggcagtggcactgggtatctcagctccatggtgggcctcattctaggtccttttggtgtgaaccatggggtggaacttcactcagatgtgatagagtatgcaaagcagaaactggacttcttcatcagaacaagtgatagtttt

SEQ ID NO: 171983 - DNA, 1321 bp, Homo sapiens
  Payload ID: 13788
  Gene Symbol: PCMTD2
  Gene Name: protein-L-isoaspartate (D-aspartate) O-methyltransferase domain containing 2
  ENST ID: ENST00000609372
  CDS Start-End: 147-782
gatgtttacggcggccgaggttggagcggcgctgctcggccgcggacacacgagggacgcgcccgaggagctgcaggtggcagcccaggcggtccgaacccgtcggccggccgagcctggagtattgcctaagtgtaatcttgaacatgggcggtgctgtgagtgctggtgaagacaatgatgagctgatagataatttgaaagaagcacagtatatccggactgagctggtagagcaggctttcagagctatcgatcgtgcagactattatcttgaagaatttaaagaaaatgcttataaagacttggcatggaagcatggaaacattcacctctcagccccgtgcatctactcggagccctgccattcagagtcaggaaaatcaagacttgtccagttaccaccagtggcagttcgcagcctccaggacttggctcgcatcgccatccggggcaccattaaaaagattattcatcaggaaactgtgagcaaaaacggaaacggactaaagaacacccccaggtttaaacgaaggagagttcgccgccgtcgaatggaaacgattgtctttttggacaaagaagtctttgccagtcggatttccaacccctcagatgacaacagctgtgaagacttggaagaggaacggagggaagaagaagagaagaccccgccggaaacaaagccagaccccccagtgaacttcctacgccagaaggtcctgagcctccctctgccagatcccctgaaatactacttgctttattacagagaaaaataagtctcctgtttgaaagggggaaataggaagagcagattgctgagtgtgaagttcgtgctgcctgtgtgctgttgaagggtcacctggaggcagacgttgtggggaagggaactgctgggctcatccacaccatggttttcttctagttcctgattgacctctaaaattctattcagttgtatgatttgtttacatagttccacaagaccttcattgcatagaagattgttttcccaaagtggagagaatcttcatagagaaaaagagaaggctgtttctttttcggctctgacgaaacactgaagtctgcgtaagagagactgtttgatgaccgtccctcatgcaacatgcacggtactcactaaaaatgaaaactgaagtggaaactaacctgtgttgcttataaagtgtgaaagcacaagcttataaatgtataaaatcttttctgggtgtgacgcacctgcgtccaagtttgaatttttatgatatgtaccacttaattactggcactgagtatcactgaatttcttagttttcta

SEQ ID NO: 171984 - DNA, 1534 bp, Homo sapiens
  Payload ID: 13788
  Gene Symbol: PCMTD2
  Gene Name: protein-L-isoaspartate (D-aspartate) O-methyltransferase domain containing 2
  ENST ID: ENST00000618274
  CDS Start-End: 292-1080
gttggagcggcgctgctcggccgcggacacacgagggacgcgcccgaggagctgcaggtggcagcccaggcggtccgaacccgtcggccggccgagcctggagtattgcctaagtgtaatcttgaacatgggcggtgctgtgagtgctggtgaagacaatgatgagctgatagataatttgaaagaagcacagtatatccggactgagctggtagagcaggctttcagagctatcgatcgtgcagactattatcttgaagaatttaaagaaaatgcttataaagacttggcatggaagcatggaaacattcacctctcagccccgtggaacttcactcagatgtgatagagtatgcaaagcagaaactggacttcttcatcagaacaagtgatagttttgacaagtttgacttctgtgaaccttcctttgttactgggaattgcctggagatttctccggattgttctcagtatgatcgtgtatactgtggggctggcgtgcagaaagagcatgaagagtacatgaagaatcttctcaaagtgggagggatccttgtcatgccactggaagagaagttgactaagataacacgcacaggtccttcagcttgggaaaccaaaaagattcttgctgtttcttttgctcctctgatccagccctgccattcagagtcaggaaaatcaagacttgtccagttaccaccagtggcagttcgcagcctccaggacttggctcgcatcgccatccggggcaccattaaaaagattattcatcaggaaactgtgagcaaaaacggaaacggactaaagaacacccccaggtttaaacgaaggagagttcgccgccgtcgaatggaaacgattgtctttttggacaaagaagtctttgccagtcggatttccaacccctcagatgacaacagctgtgaagacttggaagaggaacggagggaagaagaagagaagaccccgccggaaacaaagccagaccccccagtgaacttcctacgccagaaggtcctgagcctccctctgccagatcccctgaaatactacttgctttattacagagaaaaataagtctcctgtttgaaagggggaaataggaagagcagattgctgagtgtgaagttcgtgctgcctgtgtgctgttgaagggtcacctggaggcagacgttgtggggaagggaactgctgggctcatccacaccatggttttcttctagttcctgattgacctctaaaattctattcagttgtatgatttgtttacatagttccacaagaccttcattgcatagaagattgttttcccaaagtggagagaatcttcatagagaaaaagagaaggctgtttctttttcggctctgacgaaacactgaagtctgcgtaagagagactgtttgatgaccgtccctcatgcaacatgcacggtactcactaaaaatgaaaactgaagtggaaactaacctgtgttgcttataaagtgtgaaagcacaagcttataaatgtataaaatcttttctgggtgtg

SEQ ID NO: 171985 - DNA, 541 bp, Homo sapiens; identical to SEQ ID NO: 171980
  Payload ID: 13788
  Gene Symbol: PCMTD2
  Gene Name: protein-L-isoaspartate (D-aspartate) O-methyltransferase domain containing 2
  ENST ID: ENST00000629544
  CDS Start-End: 136-541

SEQ ID NO: 171986 - DNA, 2401 bp, Homo sapiens
  Payload ID: 13788
  Gene Symbol: PCMTD2
  Gene Name: protein-L-isoaspartate (D-aspartate) O-methyltransferase domain containing 2
  Uniprot ID: Q9NV79
  ENST ID: ENST00000631244
  CDS Start-End: 155-1159
cggcggcggatgtttacggcggccgaggttggagcggcgctgctcggccgcggacacacgagggacgcgcccgaggagctgcaggtggcagcccaggcggtccgaacccgtcggccggccgagcctggagtattgcctaagtgtaatcttgaacatgggcggtgctgtgagtgctggtgaagacaatgatgagctgatagataatttgaaagaagcacagtatatccggactgagctggtagagcaggctttcagagctatcgatcgtgcagactattatcttgaagaatttaaagaaaatgcttataaagacttggcatggaagcatggaaacattcacctctcagccccgtgcatctactcggaggtgatggaagccctagatctgcagcctggactctcgtttctgaacctgggcagtggcactgggtatctcagctccatggtgggcctcattctaggtccttttggtgtgaaccatggggtggaacttcactcagatgtgatagagtatgcaaagcagaaactggacttcttcatcagaacaagtgatagttttgacaagtttgacttctgtgaaccttcctttgttactgggaattgcctggagatttctccggattgttctcagtatgatcgtgtatactgtggggctggcgtgcagaaagagcatgaagagtacatgaagaatcttctcaaagtgggagggatccttgtcatgccactggaagagaagccctgccattcagagtcaggaaaatcaagacttgtccagttaccaccagtggcagttcgcagcctccaggacttggctcgcatcgccatccggggcaccattaaaaagattattcatcaggaaactgtgagcaaaaacggaaacggactaaagaacacccccaggtttaaacgaaggagagttcgccgccgtcgaatggaaacgattgtctttttggacaaagaagtctttgccagtcggatttccaacccctcagatgacaacagctgtgaagacttggaagaggaacggagggaagaagaagagaagaccccgccggaaacaaagccagaccccccagtgaacttcctacgccagaaggtcctgagcctccctctgccagatcccctgaaatactacttgctttattacagagaaaaataagtctcctgtttgaaagggggaaataggaagagcagattgctgagtgtgaagttcgtgctgcctgtgtgctgttgaagggtcacctggaggcagacgttgtggggaagggaactgctgggctcatccacaccatggttttcttctagttcctgattgacctctaaaattctattcagttgtatgatttgtttacatagttccacaagaccttcattgcatagaagattgttttcccaaagtggagagaatcttcatagagaaaaagagaaggctgtttctttttcggctctgacgaaacactgaagtctgcgtaagagagactgtttgatgaccgtccctcatgcaacatgcacggtactcactaaaaatgaaaactgaagtggaaactaacctgtgttgcttataaagtgtgaaagcacaagcttataaatgtataaaatcttttctgggtgtgacgcacctgcgtccaagtttgaatttttatgatatgtaccacttaattactggcactgagtatcactgaatttcttagttttctagtggggaaacattattgagaagccctcccttattttaagtaagttgattaaatcttatgtgagttgccagttgtaatttttcaaaggaaaaattttgatggggtggaggaatgaattgccagataatctttctggaattccgagagaattccaaagagggtttttttttttttttttaggacatcttttgatacctttaaaagaaccactgtcaagtaatccttaaaagaatatcttggaaaaggaaacagattttttcctgtgtgtaagcaataagtgaagttacatttgccctaaccctagggatgattctttacccagttttaaagcccatcatggtattctaaggtgttgacaccctccatcctcagagcaggtcgaaaatattaaatagactggggactctatgatgggcagcctgtgctttttgacttcagtttgctatttttctgtgatcacattagtactgattcatagattctatcttttataattctggagaaaaagatttgttagttttgtaatttttttgtaagaccaaatgtatgtattttagtagctccattgcatgagaagagtgtaactcacactgacttgtgatatcagccttctctgggccttgtgtgtggagagctttctatcttaccaagtggtagggctaaaagaacaacagcctttttggtagtcacatagcagaatgatc

SEQ ID NO: 171987 - DNA, 584 bp, Homo sapiens
  Payload ID: 13788
  Gene Symbol: PCMTD2
  Gene Name: protein-L-isoaspartate (D-aspartate) O-methyltransferase domain containing 2
  ENST ID: ENST00000628717
  CDS Start-End: 491-584
gactgtcattcaagaatgagtgaagttgaggtgcctataagcaactcagaaattgttgtggccacgcttgggggaaatagagccctacactcaggtgatgagaggagacctcagaggtgaccgatccagggccttgctccctgcgccaccccagctcgtacctccagtggaacttggctgggcttatcaagagctcctttcattcattgcaacttcatttgttagaaagcttctctgtgtatttagtaggcattgtctccaacatgtaccactggtctggcttttgttaggcccattaatagtgtacatgtgacagcctttcaagtataggtgctccccggcttacggtggggtcgcatcccagtaaacacatcgttaaacctgaagtcgaaccatccgaagtcggagaccatctgtatttgaaaaaagtccctttgcattgcttgtaagagttctggttttcaagtattgcctaagtgtaatcttgaacatgggcggtgctgtgagtgctggtgaagacaatgatgagctgatagataatttgaaagaagcacagtatatccggactgagctggtagagcagg

SEQ ID NO: 171988 - DNA, 572 bp, Homo sapiens; identical to SEQ ID NO: 171982
  Payload ID: 13788
  Gene Symbol: PCMTD2
  Gene Name: protein-L-isoaspartate (D-aspartate) O-methyltransferase domain containing 2
  ENST ID: ENST00000628846
  CDS Start-End: 168-572

SEQ ID NO: 171989 - DNA, 2455 bp, Homo sapiens
  Payload ID: 13788
  Gene Symbol: PCMTD2
  Gene Name: protein-L-isoaspartate (D-aspartate) O-methyltransferase domain containing 2
  Uniprot ID: Q9NV79
  ENST ID: ENST00000627415
  CDS Start-End: 128-1213
gttggagcggcgctgctcggccgcggacacacgagggacgcgcccgaggagctgcaggtggcagcccaggcggtccgaacccgtcggccggccgagcctggagtattgcctaagtgtaatcttgaacatgggcggtgctgtgagtgctggtgaagacaatgatgagctgatagataatttgaaagaagcacagtatatccggactgagctggtagagcaggctttcagagctatcgatcgtgcagactattatcttgaagaatttaaagaaaatgcttataaagacttggcatggaagcatggaaacattcacctctcagccccgtgcatctactcggaggtgatggaagccctagatctgcagcctggactctcgtttctgaacctgggcagtggcactgggtatctcagctccatggtgggcctcattctaggtccttttggtgtgaaccatggggtggaacttcactcagatgtgatagagtatgcaaagcagaaactggacttcttcatcagaacaagtgatagttttgacaagtttgacttctgtgaaccttcctttgttactgggaattgcctggagatttctccggattgttctcagtatgatcgtgtatactgtggggctggcgtgcagaaagagcatgaagagtacatgaagaatcttctcaaagtgggagggatccttgtcatgccactggaagagaagttgactaagataacacgcacaggtccttcagcttgggaaaccaaaaagattcttgctgtttcttttgctcctctgatccagccctgccattcagagtcaggaaaatcaagacttgtccagttaccaccagtggcagttcgcagcctccaggacttggctcgcatcgccatccggggcaccattaaaaagattattcatcaggaaactgtgagcaaaaacggaaacggactaaagaacacccccaggtttaaacgaaggagagttcgccgccgtcgaatggaaacgattgtctttttggacaaagaagtctttgccagtcggatttccaacccctcagatgacaacagctgtgaagacttggaagaggaacggagggaagaagaagagaagaccccgccggaaacaaagccagaccccccagtgaacttcctacgccagaaggtcctgagcctccctctgccagatcccctgaaatactacttgctttattacagagaaaaataagtctcctgtttgaaagggggaaataggaagagcagattgctgagtgtgaagttcgtgctgcctgtgtgctgttgaagggtcacctggaggcagacgttgtggggaagggaactgctgggctcatccacaccatggttttcttctagttcctgattgacctctaaaattctattcagttgtatgatttgtttacatagttccacaagaccttcattgcatagaagattgttttcccaaagtggagagaatcttcatagagaaaaagagaaggctgtttctttttcggctctgacgaaacactgaagtctgcgtaagagagactgtttgatgaccgtccctcatgcaacatgcacggtactcactaaaaatgaaaactgaagtggaaactaacctgtgttgcttataaagtgtgaaagcacaagcttataaatgtataaaatcttttctgggtgtgacgcacctgcgtccaagtttgaatttttatgatatgtaccacttaattactggcactgagtatcactgaatttcttagttttctagtggggaaacattattgagaagccctcccttattttaagtaagttgattaaatcttatgtgagttgccagttgtaatttttcaaaggaaaaattttgatggggtggaggaatgaattgccagataatctttctggaattccgagagaattccaaagagggtttttttttttttttttaggacatcttttgatacctttaaaagaaccactgtcaagtaatccttaaaagaatatcttggaaaaggaaacagattttttcctgtgtgtaagcaataagtgaagttacatttgccctaaccctagggatgattctttacccagttttaaagcccatcatggtattctaaggtgttgacaccctccatcctcagagcaggtcgaaaatattaaatagactggggactctatgatgggcagcctgtgctttttgacttcagtttgctatttttctgtgatcacattagtactgattcatagattctatcttttataattctggagaaaaagatttgttagttttgtaatttttttgtaagaccaaatgtatgtattttagtagctccattgcatgagaagagtgtaactcacactgacttgtgatatcagccttctctgggccttgtgtgtggagagctttctatcttaccaagtggtagggctaaaagaacaacagcctttttggtagtcacatagcagaatgatc

SEQ ID NO: 171990 - DNA, 476 bp, Homo sapiens; identical to SEQ ID NO: 171979
  Payload ID: 13788
  Gene Symbol: PCMTD2
  Gene Name: protein-L-isoaspartate (D-aspartate) O-methyltransferase domain containing 2
  ENST ID: ENST00000627852
  CDS Start-End: 194-476

SEQ ID NO: 171991 - DNA, 1321 bp, Homo sapiens; identical to SEQ ID NO: 171983
  Payload ID: 13788
  Gene Symbol: PCMTD2
  Gene Name: protein-L-isoaspartate (D-aspartate) O-methyltransferase domain containing 2
  ENST ID: ENST00000629502
  CDS Start-End: 147-782

SEQ ID NO: 171992 - DNA, 1540 bp, Homo sapiens
  Payload ID: 13789
  Gene Symbol:
  Gene Name: Protein-L-isoaspartate O-methyltransferase domain-containing protein 2  [Source:UniProtKB/Swiss-Prot
  Acc:Q9NV79]
  Uniprot ID: Q9NV79
  ENST ID: ENST00000615818
  CDS Start-End: 1-1086
atgggcggtgctgtgagtgctggtgaagacaatgatgagctgatagataatttgaaagaagcacagtatatccggactgagctggtagagcaggctttcagagctatcgatcgtgcagactattatcttgaagaatttaaagaaaatgcttataaagacttggcatggaagcatggaaacattcacctctcagccccgtgcatctactcggaggtgatggaagccctagatctgcagcctggactctcgtttctgaacctgggcagtggcactgggtatctcagctccatggtgggcctcattctaggtccttttggtgtgaaccatggggtggaacttcactcagatgtgatagagtatgcaaagcagaaactggacttcttcatcagaacaagtgatagttttgacaagtttgacttctgtgaaccttcctttgttactgggaattgcctggagatttctccggattgttctcagtatgatcgtgtatactgtggggctggcgtgcagaaagagcatgaagagtacatgaagaatcttctcaaagtgggagggatccttgtcatgccactggaagagaagttgactaagataacacgcacaggtccttcagcttgggaaaccaaaaagattcttgctgtttcttttgctcctctgatccagccctgccattcagagtcaggaaaatcaagacttgtccagttaccaccagtggcagttcgcagcctccaggacttggctcgcatcgccatccggggcaccattaaaaagattattcatcaggaaactgtgagcaaaaacggaaacggactaaagaacacccccaggtttaaacgaaggagagttcgccgccgtcgaatggaaacgattgtctttttggacaaagaagtctttgccagtcggatttccaacccctcagatgacaacagctgtgaagacttggaagaggaacggagggaagaagaagagaagaccccgccggaaacaaagccagaccccccagtgaacttcctacgccagaaggtcctgagcctccctctgccagatcccctgaaatactacttgctttattacagagaaaaataagtctcctgtttgaaagggggaaataggaagagcagattgctgagtgtgaagttcgtgctgcctgtgtgctgttgaagggtcacctggaggcagacgttgtggggaagggaactgctgggctcatccacaccatggttttcttctagttcctgattgacctctaaaattctattcagttgtatgatttgtttacatagttccacaagaccttcattgcatagaagattgttttcccaaagtggagagaatcttcatagagaaaaagagaaggctgtttctttttcggctctgacgaaacactgaagtctgcgtaagagagactgtttgatgaccgtccctcatgcaacatgcacggtactcactaaaaatgaaaactgaagtggaaactaacctgtgttgcttataaagtgtgaaagcacaagcttataaatgtataaaatcttttctgggtgtg

SEQ ID NO: 171993 - DNA, 5154 bp, Homo sapiens
  Payload ID: 13789
  Gene Symbol:
  Gene Name: Protein-L-isoaspartate O-methyltransferase domain-containing protein 2  [Source:UniProtKB/Swiss-Prot
  Acc:Q9NV79]
  ENST ID: ENST00000625658
  CDS Start-End: 1-2490
gaagaggaggaggaagaggaagaggaagaggaggaggaggaggcagctcctgatgtgatctttcaggaagacacctctcacacctctgcccagaaggcccctgagctccggggcccagaatcacccagtcccaagcctgagtactctgttattgtggaggtccgctcggatgatgacaaggacgaggacacccactcccggaagtcaacagtcactgacgagtcggagatgcaggacatgatgacccggggaaacctgggcctcctggagcaggccatcgccctgaaggctgaacaggtgcgcacagtctgcgagccgggctgcccgcctgccgagcagagccagctgggcctgggagagccagggaaggcagcaaagcccctggacactgtgcggaagagttactacagtaaagatccttcaagagctgagaagcgtgagatcaagtgtccaacaccaggctgtgatggcactggccacgttaccgggttgtaccctcaccaccgcagcctttctggctgtccccacaaggataggatccccccagagatcttagccatgcatgagaacgtgctgaagtgccccactcctggctgcacaggccagggtcacgtgaacagcaaccgcaacacgcacagaagtttgtctgggtgtcccattgctgccgccgaaaaattagccaaatcccatgagaagcagcagccgcagacaggagatccttccaagagtagctccaattccgatcggatcctcaggcccatgtgcttcgtgaagcagctcgaggtccctccatatgggagctaccggcccaacgtggcccccgccacacccagggccaacttggccaaggagctggagaagttctccaaggtcacctttgactacgcaagtttcgatgctcaggtttttggcaaacgcatgcttgccccaaagattcagaccagcgaaacctcacctaaagcctttcaatgctttgactactcgcaggacgccgaggctgcacacatggctgccactgccatcctgaacctctccacgcgctgctgggagatgcctgagaacctcagcacgaagccacaggacctccccagcaagtctgtggatatcgaggtagacgaaaatggaaccctggacttgagcatgcacaaacaccgcaaacgagaaaatgctttccccagcagcagcagctgcagcagcagccccggtgtgaagtctcccgacgcctcccagcgccacagcagcaccagcgcccccagcagctccatgacctctccccagtccagccaggcctcccgccaggacgagtgggaccggcccctggactacaccaagcctagccgcctgagagaggaggaacctgaggagtcagagccagcagcccattcttttgcttcttctgaagcagatgaccaggaagtgtcggaagagaattttgaggagcggaagtatccgggggaagtcaccctgaccaactttaagctgaagtttctctccaaggacataaagaaggagctgctcacctgtcccacccctggctgtgacggcagcggccacatcaccgggaactacgcctcccaccgcagcctctctggttgccctcttgctgacaagagcctcagaaacctcatggctgcccactctgctgacctcaagtgccccacgcccggctgtgacggctctggccacatcacagggaactacgcttcacaccggagcttgtccggctgccctcgtgcaaagaaaagtggagtcaaggtggcacccaccaaggacgacaaggaggaccccgagctgatgaagtgcccagttccaggctgtgtggggctcggtcacatcagcgggaaatacgcctctcacaggagcgcatccggctgcccactggccgcccgcaggcagaaggaagggtccctcaatggctcgtcattctcctggaagtccctgaagaatgaaggaccgacctgccccaccccgggctgtgacggctctggccacgccaatgggagtttcctcacccaccggagtttgtcaggctgtcccagagcaacctttgctggaaagaagggaaaactgtcaggggatgaggtcctcagtccaaagttcaagactagcgacgtgttggagaatgatgaggagatcaagcagctgaaccaggagatccgagacctgaacgagtccaactcggagatggaggctgccatggtgcagctgcagtcccagatctcctccatggagaagaacctgaagaacatcgaggaggagaacaagctcattgaggagcagaatgaagccctgtttctggagctgtccggcctgagccaggccctcatccaaagtctcgccaatatccgccttccgcacatggagccaatatgcgaacagaatttcgatgcctatgtgagcaccctcaccgacatgtactccaaccaggacccggagaacaaggacctcctggagagcatcaagcaggctgtgaggggcatccaggtctaggccgtgtggtacccagaagtgtcccagcccaccacaccgtttacctccctcgccctgccccgcaccgtggggatgcccaactcacagtgacttcccgtttggggcccggtgtggccgcgggcgggtttatccaaagggatggctggaaattggccgctcccacgaggctccctccaggcttggggccgtggtggccctatctgtgtgcataggggcactgaagaattacaaagtgatttatttttgttttctgaaagaaatctgaagagcagctcaaagtctccagtggaagctcatggacaaggttctcagtattgcctaagtgtaatcttgaacatgggcggtgctgtgagtgctggtgaagacaatgatgagctgatagataatttgaaagaagcacagtatatccggactgagctggtagagcaggctttcagagctatcgatcgtgcagactattatcttgaagaatttaaagaaaatgcttataaagacttggcatggaagcatggaaacattcacctctcagccccgtgcatctactcggaggtgatggaagccctagatctgcagcctggactctcgtttctgaacctgggcagtggcactgggtatctcagctccatggtgggcctcattctaggtccttttggtgtgaaccatggggtggaacttcactcagatgtgatagagtatgcaaagcagaaactggacttcttcatcagaacaagtgatagttttgacaagtttgacttctgtgaaccttcctttgttactgggaattgcctggagatttctccggattgttctcagtatgatcgtgtatactgtggggctggcgtgcagaaagagcatgaagagtacatgaagaatcttctcaaagtgggagggatccttgtcatgccactggaagagaagttgactaagataacacgcacaggtccttcagcttgggaaaccaaaaagattcttgctgtttcttttgctcctctgatccagccctgccattcagagtcaggaaaatcaagacttgtccagttaccaccagtggcagttcgcagcctccaggacttggctcgcatcgccatccggggcaccattaaaaagattattcatcaggaaactgtgagcaaaaacggaaacggactaaagaacacccccaggtttaaacgaaggagagttcgccgccgtcgaatggaaacgattgtctttttggacaaagaagtctttgccagtcggatttccaacccctcagatgacaacagctgtgaagacttggaagaggaacggagggaagaagaagagaagaccccgccggaaacaaagccagaccccccagtgaacttcctacgccagaaggtcctgagcctccctctgccagatcccctgaaatactacttgctttattacagagaaaaataagtctcctgtttgaaagggggaaataggaagagcagattgctgagtgtgaagttcgtgctgcctgtgtgctgttgaagggtcacctggaggcagacgttgtggggaagggaactgctgggctcatccacaccatggttttcttctagttcctgattgacctctaaaattctattcagttgtatgatttgtttacatagttccacaagaccttcattgcatagaagattgttttcccaaagtggagagaatcttcatagagaaaaagagaaggctgtttctttttcggctctgacgaaacactgaagtctgcgtaagagagactgtttgatgaccgtccctcatgcaacatgcacggtactcactaaaaatgaaaactgaagtggaaactaacctgtgttgcttataaagtgtgaaagcacaagcttataaatgtataaaatcttttctgggtgtgacgcacctgcgtccaagtttgaatttttatgatatgtaccacttaattactggcactgagtatcactgaatttcttagttttctagtggggaaacattattgagaagccctcccttattttaagtaagttgattaaatcttatgtgagttgccagttgtaatttttcaaaggaaaaattttgatggggtggaggaatgaattgccagataatctttctggaattccgagagaattccaaagagggtttttttttttttttttaggacatcttttgatacctttaaaagaaccactgtcaagtaatccttaaaagaatatcttggaaaaggaaacagattttttcctgtgtgtaagcaataagtgaagttacatttgccctaaccctagggatgattctttacccagttttaaagcccatcatggtattctaaggtgttgacaccctccatcctcagagcaggtcgaaaatattaaatagactggggactctatgatgggcagcctgtgctttttgacttcagtttgctatttttctgtgatcacattagtactgattcatagattctatcttttataattctggagaaaaagatttgttagttttgtaatttttttgtaagaccaaatgtatgtattttagtagctccattgcatgagaagagtgtaactcacactgacttgtgatatcagccttctctgggccttgtgtgtggagagctttctatcttaccaagtggtagggctaaaagaacaacagcctttttggtagtcacatagcagaatgatc

SEQ ID NO: 171994 - DNA, 1865 bp, Homo sapiens
  Payload ID: 13790
  Gene Symbol: POMK
  Gene Name: protein-O-mannose kinase
  Uniprot ID: Q9H5K3
  ENST ID: ENST00000331373
  CDS Start-End: 256-1308
gcgtgctggcccggggtggcaggagccgcagaggcttgggctgcagaaaaaggatcctgtttgctgtgtaatcctgagaatggactgcaagagaggaaaaactgggcgtctgcttgggaatctattgtggaaacccagggtgtttcccgaccagtccctgggcgccaactagagtatggactgaccaggtacctggatggagacctgagctggagaaggagatgcgcttgggaggaaattgcagaggccgtcaacatggaaaagcagccccagaacagcaggagaggcctcgccccccgagaggtgccgccagctgttgggctgctgctgatcatggccctgatgaatactctgctctacctctgcctcgaccacttcttcatcgctcctcgacaatccactgtggaccccacacactgtccctatggtcacttcaggataggacagatgaaaaactgctcaccttggctgtcctgcgaggagctgagaacagaagtgagacagctgaagcgtgttggggaaggagctgtaaagagagtctttctgtctgagtggaaggagcacaaagttgcactctcacagctcaccagcctggagatgaaagatgatttcctccatggactgcagatgctgaaatctctccaaggcacacatgttgtcacgctgcttggctattgtgaggatgacaacactatgcttactgaatatcaccctctaggttccttgagtaacctggaagaaacactaaacctttcaaagtaccaaaatgtgaacacgtggcagcacaggctggagctggccatggactatgtcagcatcattaattacctgcaccacagccctgtgggcacacgggtcatgtgcgactccaacgacctgccgaagacactgtcccagtatctgctaacaagcaacttcagcattttggcaaatgacttggacgccttacccctggtgaaccacagctccgggatgctggtgaagtgcggccacagggagctgcatggggatttcgtggctccagagcaactgtggccctatggagaggacgtgcctttccacgatgatctcatgccctcatatgatgagaagattgacatttggaagatcccagacatctccagtttccttctggggcacattgaagggagtgatatggtccgattccatttgtttgatattcacaaagcatgcaagagccagactccctcagaaagacccactgcccaggacgttctggagacctaccagaaggtcttggatacacttagagatgccatgatgtctcaggcaagagagatgctgtgaaaaccagtccagccaatgaaggtgggattgaagggctgaatggaagttacagcattctactctgatggtggagttttttgcctgagtttcgtgttttattgttttttttatggcttagccatgtggttcgttgtccacatccacatgtacgtttgtatgtagtccacattggttgttagatttttttttttttctttgagatgcggtcttgctctgttgctgaggctggagtgcagtgatgtgatcttggctcactgcagcctctgcctcccaggttcaagcaattctcccacctcagcctcctgagtagctgggattacaggcacaccaccacgcctggctaatttttgtatttttagtggaggtggggtttcaccatgttggccaggctggtcccgaactcctgacttcctcggcctcccaaagtgttgggattacaggcatgggccactatgcctggccagttgttagatttccatggatttgtagtttccaaagtttctcgttattgatttctacttttcttccattgtggtctgagaaggtacttgatatga

SEQ ID NO: 171995 - DNA, 564 bp, Homo sapiens
  Payload ID: 13790
  Gene Symbol: POMK
  Gene Name: protein-O-mannose kinase
  ENST ID: ENST00000518991
  CDS Start-End: 163-564
agtgcgtgctggcccggggtggcaggagccgcagaggcttgggctgcagaaaaaggatcctgtttgctgtgtaatcctgagaatggactgcaagagaggaaaaactgggcgtctgcttgggaatctattgtggaaacccaggaaattgcagaggccgtcaacatggaaaagcagccccagaacagcaggagaggcctcgccccccgagaggtgccgccagctgttgggctgctgctgatcatggccctgatgaatactctgctctacctctgcctcgaccacttcttcatcgctcctcgacaatccactgtggaccccacacactgtccctatggtcacttcaggataggacagatgaaaaactgctcaccttggctgtcctgcgaggagctgagaacagaagtgagacagctgaagcgtgttggggaaggagctgtaaagagagtctttctgtctgagtggaaggagcacaaagttgcactctcacagctcaccagcctggagatgaaagatgatttcctccatggactgcagatgctgaaatctctccaaggcacacatgtt

SEQ ID NO: 171996 - DNA, 1527 bp, Homo sapiens
  Payload ID: 13790
  Gene Symbol: POMK
  Gene Name: protein-O-mannose kinase
  Uniprot ID: Q9H5K3
  ENST ID: ENST00000614426
  CDS Start-End: 172-1224
agtaggcccagtgcgtgctggcccggggtggcaggagccgcagaggcttgggctgcagaaaaaggatcctgtttgctgtgtaatcctgagaatggactgcaagagaggaaaaactgggcgtctgcttgggaatctattgtggaaacccaggaaattgcagaggccgtcaacatggaaaagcagccccagaacagcaggagaggcctcgccccccgagaggtgccgccagctgttgggctgctgctgatcatggccctgatgaatactctgctctacctctgcctcgaccacttcttcatcgctcctcgacaatccactgtggaccccacacactgtccctatggtcacttcaggataggacagatgaaaaactgctcaccttggctgtcctgcgaggagctgagaacagaagtgagacagctgaagcgtgttggggaaggagctgtaaagagagtctttctgtctgagtggaaggagcacaaagttgcactctcacagctcaccagcctggagatgaaagatgatttcctccatggactgcagatgctgaaatctctccaaggcacacatgttgtcacgctgcttggctattgtgaggatgacaacactatgcttactgaatatcaccctctaggttccttgagtaacctggaagaaacactaaacctttcaaagtaccaaaatgtgaacacgtggcagcacaggctggagctggccatggactatgtcagcatcattaattacctgcaccacagccctgtgggcacacgggtcatgtgcgactccaacgacctgccgaagacactgtcccagtatctgctaacaagcaacttcagcattttggcaaatgacttggacgccttacccctggtgaaccacagctccgggatgctggtgaagtgcggccacagggagctgcatggggatttcgtggctccagagcaactgtggccctatggagaggacgtgcctttccacgatgatctcatgccctcatatgatgagaagattgacatttggaagatcccagacatctccagtttccttctggggcacattgaagggagtgatatggtccgattccatttgtttgatattcacaaagcatgcaagagccagactccctcagaaagacccactgcccaggacgttctggagacctaccagaaggtcttggatacacttagagatgccatgatgtctcaggcaagagagatgctgtgaaaaccagtccagccaatgaaggtgggattgaagggctgaatggaagttacagcattctactctgatggtggagttttttgcctgagtttcgtgttttattgttttttttatggcttagccatgtggttcgttgtccacatccacatgtacgtttgtatgtagtccacattggttgttagatttttttttttttctttgagatgcggtcttgctctgttgctgaggctggagtgcagtgatgtgatcttggctcactgcagcctctgcctcccaggttcaagcaattctcccacctcagcctcc

SEQ ID NO: 171997 - DNA, 2912 bp, Homo sapiens
  Payload ID: 13791
  Gene Symbol: POMT1
  Gene Name: protein-O-mannosyltransferase 1
  Uniprot ID: Q9Y6A1
  ENST ID: ENST00000341012
  CDS Start-End: 197-2212
gtctggccccgcaggctcggtgaatcgaacgttgagcagggcggtgggtggtgcggagtgccgagcggcctcacccccaaccgtcggcccagtcggacggttccgaggcgttgccgggagccgggcgcggctctgtgtggactcggagaaacgcggttttgacgaagtatattatgggcagtacatctctttttacatgaaacaaatcttcttcttggatgacagtgggccgccatttggccacatggtgctggccttgggaggttatttaggaggattcgatggcaattttttgtggaacagaattggagcagaatacagtagcaacgtgcctgtgtggtccctgcgcctgctgccagcactcgcgggggccttgtcggtccccatggcctaccagatagtgttggagctccacttttctcattgtgccgccatgggagctgctctgttgatgcttatcgagaatgctctcatcactcagtcaaggctaatgcttttggaatcagtgttaatatttttcaatctattggccgtgttgtcctacctgaagttcttcaactgccaaaagcacagccctttttctctgagctggtggttctggctaacactgacaggggtcgcttgttcctgtgcagtgggcatcaagtacatgggtgtgttcacgtacgtgctcgtgctgggtgttgcagctgtccatgcctggcacctgcttggagaccagactttgtccaatgtctgtgtgttctgtcacttgctcgcccgagcagtggctttgctggtcatcccggtcgtcctgtacttactgttcttctacgtccacttgattctagtcttccgctctgggccccacgaccaaatcatgtccagtgccttccaggccagcttagagggaggactagctcggatcactcagggtcagccactggaggtggcctttgggtcccaggtcactctgaggaacgtctttgggaaacctgtgccctgctggcttcattcccaccaggacacctaccccatgatatatgagaacggccgaggcagctcccaccagcaacaggtgacctgttaccccttcaaagatgtcaataactggtggattgtaaaggatcccaggaggcaccagctggtggtgagcagccctccgagacctgtgaggcacggggacatggtgcagctggtccacggcatgaccacccgctccctgaacacgcatgatgttgcagcccccctgagcccccattcacaggaggtctcctgctacattgactataacatctccatgcccgcccagaacctctggagactggaaattgtgaacagaggatctgacacagacgtctggaagaccatcctctcagaggtccgctttgtgcacgtgaacacttccgctgtcttaaagctgagcggggctcacctccctgactgggggtatcggcaactggagatcgtcggggagaagctgtcccggggctaccacgggagcacggtgtggaacgtggaggagcaccgatacggcgcgagccaggagcagagggagcgggaacgggagctgcactcacctgcgcaggtggacgtcagcaggaacctcagcttcatggcgagattctcggagctgcagtggaggatgctggcgctgagaagtgatgactcggaacacaagtacagctccagcccactggagtgggtcaccctggacaccaatattgcctactggctgcaccccaggaccagcgctcagatccacctacttggaaacatagtgatctgggtttcgggcagcctcgctctggccatctacgccctgctgtccttgtggtacctgctccgacggcgaagaaatgtccatgacctccctcaggatgcctggctgcgctgggtgctggctggggcgctgtgtgccggtggctgggcagtgaactacctcccgttcttcctgatggagaagacactcttcctctaccactacctgcccgcactcaccttccaaatccttctgctccctgtggtcctgcagcacatcagcgaccacctgtgcaggtcccagctccagaggagcatcttcagcgccctggtggtggcctggtactcctccgcgtgccacgtgtccaacacgctgcgcccactcacctacggggacaagtcactctcgccacatgaactcaaggcccttcgctggaaagacagctgggacatcttgatccgaaaacactagaacaagagtgtggcaaagaacacccgtgctggggtcgggatgaggttgaagggtcttggtcaatgtacgtaatgagcagggtgggccccacgctgggaggacacgggctgggctgagcagggcctctagtggaacacatgggggtctcattgaaaagctctctgatgagcacctccttttgtgcaaagttaattttttctcgacaataaagatattccgtgtctttacccctgaactaagacacagggagtatttcagaggccagcgtaggagtcattgacaacaaaaagccgagaacccagggccagcagtggagcctcagcagaccagggcctggtccttgctaactgctgcagggtggagtttgatctggcagacccgatcctccttcatgaacacccagcaacctgagcaagtcccggccctgccctcagcgagcccggcaggcgtcctgggacagctcagtgttggagggccacctgaaccacgagccagggctggggcttgcatgtcattgtctatgacagcgtcaagactggcccttggcaccgtgctgtgtggaaaccctcccctctgagactccactgagacgtggctgagtgaaatcttcctcgtcagtggtcaaggtgtgtcatccatacagctccatgcctttgtcttttttaaatgtaattaaaaaaggaaccaactggcgtttgta

SEQ ID NO: 171998 - DNA, 1741 bp, Homo sapiens
  Payload ID: 13791
  Gene Symbol: POMT1
  Gene Name: protein-O-mannosyltransferase 1
  ENST ID: ENST00000372220
  CDS Start-End: 1-1041
tggcgaggaggagggtgcacttccccagcgaccctcggagcagcccggggtgctgtgggcattgggaaggaaggccagtaccagccccttatagcttccctcacttggggacttgtccctttgtctcaggctcaagaaattgtgaacagaggatctgacacagacgtctggaagaccatcctctcagaggtccgctttgtgcacgtgaacacttccgctgtcttaaagctgagcggggctcacctccctgactgggggtatcggcaactggagatcgtcggggagaagctgtcccggggctaccacgggagcacggtgtggaacgtggaggagcaccgatacggcgcgagccaggagcagagggagcgggaacgggagctgcactcacctgcgcaggtggacgtcagcaggaacctcagcttcatggcgagattctcggagctgcagtggaggatgctggcgctgagaagtgatgactcggaacacaagtacagctccagcccactggagtgggtcaccctggacaccaatattgcctactggctgcaccccaggaccagcgctcagatccacctacttggaaacatagtgatctgggtttcgggcagcctcgctctggccatctacgccctgctgtccttgtggtacctgctccgacggcgaagaaatgtccatgacctccctcaggatgcctggctgcgctgggtgctggctggggcgctgtgtgccggtggctgggcagtgaactacctcccgttcttcctgatggagaagacactcttcctctaccactacctgcccgcactcaccttccaaatccttctgctccctgtggtcctgcagcacatcagcgaccacctgtgcaggtcccagctccagaggagcatcttcagcgccctggtggtggcctggtactcctccgcgtgccacgtgtccaacacgctgcgcccactcacctacggggacaagtcactctcgccacatgaactcaaggcccttcgctggaaagacagctgggacatcttgatccgaaaacactagaacaagagtgtggcaaagaacacccgtgctggggtcgggatgaggttgaagggtcttggtcaatgtacgtaatgagcagggtgggccccacgctgggaggacacgggctgggctgagcagggcctctagtggaacacatgggggtctcattgaaaagctctctgatgagcacctccttttgtgcaaagttaattttttctcgacaataaagatattccgtgtctttacccctgaactaagacacagggagtatttcagaggccagcgtaggagtcattgacaacaaaaagccgagaacccagggccagcagtggagcctcagcagaccagggcctggtccttgctaactgctgcagggtggagtttgatctggcagacccgatcctccttcatgaacacccagcaacctgagcaagtcccggccctgccctcagcgagcccggcaggcgtcctgggacagctcagtgttggagggccacctgaaccacgagccagggctggggcttgcatgtcattgtctatgacagcgtcaagactggcccttggcaccgtgctgtgtggaaaccctcccctctgagactccactgagacgtggctgagtgaaatcttcctcgtcagtggtcaaggtgtgtcatccatacagctccatgcctttgtcttttttaaatgtaattaaaaaaggaaccaactggcgtttgta

SEQ ID NO: 171999 - DNA, 3123 bp, Homo sapiens
  Payload ID: 13791
  Gene Symbol: POMT1
  Gene Name: protein-O-mannosyltransferase 1
  Uniprot ID: Q9Y6A1
  ENST ID: ENST00000372228
  CDS Start-End: 180-2423
cccgcaggctcggtgaatcgaacgttgagcagggcggtgggtggtgcggagtgccgagcggcctcacccccaaccgtcggcccagtcggacggttccgaggcgttgccgggagccgggcgcggctctgtgtggactcggagaaacgcggggcgtctgcctgagcccgcttttctacaagatgtggggatttttgaagcgccctgtagtggtgacggctgacatcaacttgagccttgtggccctgactgggatggggttactgagccggctgtggcgactcacctacccgcgggctgtggtttttgacgaagtatattatgggcagtacatctctttttacatgaaacaaatcttcttcttggatgacagtgggccgccatttggccacatggtgctggccttgggaggttatttaggaggattcgatggcaattttttgtggaacagaattggagcagaatacagtagcaacgtgcctgtgtggtccctgcgcctgctgccagcactcgcgggggccttgtcggtccccatggcctaccagatagtgttggagctccacttttctcattgtgccgccatgggagctgctctgttgatgcttatcgagaatgctctcatcactcagtcaaggctaatgcttttggaatcagtgttaatatttttcaatctattggccgtgttgtcctacctgaagttcttcaactgccaaaagcacagccctttttctctgagctggtggttctggctaacactgacaggggtcgcttgttcctgtgcagtgggcatcaagtacatgggtgtgttcacgtacgtgctcgtgctgggtgttgcagctgtccatgcctggcacctgcttggagaccagactttgtccaatgtaggtgctgatgtccagtgctgcatgaggccggcctgtatggggcagatgcagatgtcacagggggtctgtgtgttctgtcacttgctcgcccgagcagtggctttgctggtcatcccggtcgtcctgtacttactgttcttctacgtccacttgattctagtcttccgctctgggccccacgaccaaatcatgtccagtgccttccaggccagcttagagggaggactagctcggatcactcagggtcagccactggaggtggcctttgggtcccaggtcactctgaggaacgtctttgggaaacctgtgccctgctggcttcattcccaccaggacacctaccccatgatatatgagaacggccgaggcagctcccaccagcaacaggtgacctgttaccccttcaaagatgtcaataactggtggattgtaaaggatcccaggaggcaccagctggtggtgagcagccctccgagacctgtgaggcacggggacatggtgcagctggtccacggcatgaccacccgctccctgaacacgcatgatgttgcagcccccctgagcccccattcacaggaggtctcctgctacattgactataacatctccatgcccgcccagaacctctggagactggaaattgtgaacagaggatctgacacagacgtctggaagaccatcctctcagaggtccgctttgtgcacgtgaacacttccgctgtcttaaagctgagcggggctcacctccctgactgggggtatcggcaactggagatcgtcggggagaagctgtcccggggctaccacgggagcacggtgtggaacgtggaggagcaccgatacggcgcgagccaggagcagagggagcgggaacgggagctgcactcacctgcgcaggtggacgtcagcaggaacctcagcttcatggcgagattctcggagctgcagtggaggatgctggcgctgagaagtgatgactcggaacacaagtacagctccagcccactggagtgggtcaccctggacaccaatattgcctactggctgcaccccaggaccagcgctcagatccacctacttggaaacatagtgatctgggtttcgggcagcctcgctctggccatctacgccctgctgtccttgtggtacctgctccgacggcgaagaaatgtccatgacctccctcaggatgcctggctgcgctgggtgctggctggggcgctgtgtgccggtggctgggcagtgaactacctcccgttcttcctgatggagaagacactcttcctctaccactacctgcccgcactcaccttccaaatccttctgctccctgtggtcctgcagcacatcagcgaccacctgtgcaggtcccagctccagaggagcatcttcagcgccctggtggtggcctggtactcctccgcgtgccacgtgtccaacacgctgcgcccactcacctacggggacaagtcactctcgccacatgaactcaaggcccttcgctggaaagacagctgggacatcttgatccgaaaacactagaacaagagtgtggcaaagaacacccgtgctggggtcgggatgaggttgaagggtcttggtcaatgtacgtaatgagcagggtgggccccacgctgggaggacacgggctgggctgagcagggcctctagtggaacacatgggggtctcattgaaaagctctctgatgagcacctccttttgtgcaaagttaattttttctcgacaataaagatattccgtgtctttacccctgaactaagacacagggagtatttcagaggccagcgtaggagtcattgacaacaaaaagccgagaacccagggccagcagtggagcctcagcagaccagggcctggtccttgctaactgctgcagggtggagtttgatctggcagacccgatcctccttcatgaacacccagcaacctgagcaagtcccggccctgccctcagcgagcccggcaggcgtcctgggacagctcagtgttggagggccacctgaaccacgagccagggctggggcttgcatgtcattgtctatgacagcgtcaagactggcccttggcaccgtgctgtgtggaaaccctcccctctgagactccactgagacgtggctgagtgaaatcttcctcgtcagtggtcaaggtgtgtcatccatacagctccatgcctttgtcttttttaaatgtaattaaaaaaggaaccaactggcgtttgta

SEQ ID NO: 172000 - DNA, 2821 bp, Homo sapiens
  Payload ID: 13791
  Gene Symbol: POMT1
  Gene Name: protein-O-mannosyltransferase 1
  Uniprot ID: Q9Y6A1
  ENST ID: ENST00000404875
  CDS Start-End: 295-2121
acgcgcgctgctgcccgtctggccccgcaggctcggtgaatcgaacgttgagcagggcggtgggtggtgcggagtgccgagcggcctcacccccaaccgtcggcccagtcggacggttccgaggcgttgccgggagccgggcgcggctctgtgtggactcggagaaacgcgggttatttaggaggattcgatggcaattttttgtggaacagaattggagcagaatacagtagcaacgtgcctgtgtggtccctgcgcctgctgccagcactcgcgggggccttgtcggtccccatggcctaccagatagtgttggagctccacttttctcattgtgccgccatgggagctgctctgttgatgcttatcgagaatgctctcatcactcagtcaaggctaatgcttttggaatcagtgttaatatttttcaatctattggccgtgttgtcctacctgaagttcttcaactgccaaaagcacagccctttttctctgagctggtggttctggctaacactgacaggggtcgcttgttcctgtgcagtgggcatcaagtacatgggtgtgttcacgtacgtgctcgtgctgggtgttgcagctgtccatgcctggcacctgcttggagaccagactttgtccaatgtctgtgtgttctgtcacttgctcgcccgagcagtggctttgctggtcatcccggtcgtcctgtacttactgttcttctacgtccacttgattctagtcttccgctctgggccccacgaccaaatcatgtccagtgccttccaggccagcttagagggaggactagctcggatcactcagggtcagccactggaggtggcctttgggtcccaggtcactctgaggaacgtctttgggaaacctgtgccctgctggcttcattcccaccaggacacctaccccatgatatatgagaacggccgaggcagctcccaccagcaacaggtgacctgttaccccttcaaagatgtcaataactggtggattgtaaaggatcccaggaggcaccagctggtggtgagcagccctccgagacctgtgaggcacggggacatggtgcagctggtccacggcatgaccacccgctccctgaacacgcatgatgttgcagcccccctgagcccccattcacaggaggtctcctgctacattgactataacatctccatgcccgcccagaacctctggagactggaaattgtgaacagaggatctgacacagacgtctggaagaccatcctctcagaggtccgctttgtgcacgtgaacacttccgctgtcttaaagctgagcggggctcacctccctgactgggggtatcggcaactggagatcgtcggggagaagctgtcccggggctaccacgggagcacggtgtggaacgtggaggagcaccgatacggcgcgagccaggagcagagggagcgggaacgggagctgcactcacctgcgcaggtggacgtcagcaggaacctcagcttcatggcgagattctcggagctgcagtggaggatgctggcgctgagaagtgatgactcggaacacaagtacagctccagcccactggagtgggtcaccctggacaccaatattgcctactggctgcaccccaggaccagcgctcagatccacctacttggaaacatagtgatctgggtttcgggcagcctcgctctggccatctacgccctgctgtccttgtggtacctgctccgacggcgaagaaatgtccatgacctccctcaggatgcctggctgcgctgggtgctggctggggcgctgtgtgccggtggctgggcagtgaactacctcccgttcttcctgatggagaagacactcttcctctaccactacctgcccgcactcaccttccaaatccttctgctccctgtggtcctgcagcacatcagcgaccacctgtgcaggtcccagctccagaggagcatcttcagcgccctggtggtggcctggtactcctccgcgtgccacgtgtccaacacgctgcgcccactcacctacggggacaagtcactctcgccacatgaactcaaggcccttcgctggaaagacagctgggacatcttgatccgaaaacactagaacaagagtgtggcaaagaacacccgtgctggggtcgggatgaggttgaagggtcttggtcaatgtacgtaatgagcagggtgggccccacgctgggaggacacgggctgggctgagcagggcctctagtggaacacatgggggtctcattgaaaagctctctgatgagcacctccttttgtgcaaagttaattttttctcgacaataaagatattccgtgtctttacccctgaactaagacacagggagtatttcagaggccagcgtaggagtcattgacaacaaaaagccgagaacccagggccagcagtggagcctcagcagaccagggcctggtccttgctaactgctgcagggtggagtttgatctggcagacccgatcctccttcatgaacacccagcaacctgagcaagtcccggccctgccctcagcgagcccggcaggcgtcctgggacagctcagtgttggagggccacctgaaccacgagccagggctggggcttgcatgtcattgtctatgacagcgtcaagactggcccttggcaccgtgctgtgtggaaaccctcccctctgagactccactgagacgtggctgagtgaaatcttcctcgtcagtggtcaaggtgtgtcatccatacagctccatgcctttgtcttttttaaatgtaattaaaaaaggaaccaactggcgtttgta

SEQ ID NO: 172001 - DNA, 3038 bp, Homo sapiens
  Payload ID: 13791
  Gene Symbol: POMT1
  Gene Name: protein-O-mannosyltransferase 1
  Uniprot ID: Q9Y6A1
  ENST ID: ENST00000402686
  CDS Start-End: 161-2338
gaacgttgagcagggcggtgggtggtgcggagtgccgagcggcctcacccccaaccgtcggcccagtcggacggttccgaggcgttgccgggagccgggcgcggctctgtgtggactcggagaaacgcggggcgtctgcctgagcccgcttttctacaagatgtggggatttttgaagcgccctgtagtggtgacggctgacatcaacttgagccttgtggccctgactgggatggggttactgagccggctgtggcgactcacctacccgcgggctgtggtttttgacgaagtatattatgggcagtacatctctttttacatgaaacaaatcttcttcttggatgacagtgggccgccatttggccacatggtgctggccttgggaggttatttaggaggattcgatggcaattttttgtggaacagaattggagcagaatacagtagcaacgtgcctgtgtggtccctgcgcctgctgccagcactcgcgggggccttgtcggtccccatggcctaccagatagtgttggagctccacttttctcattgtgccgccatgggagctgctctgttgatgcttatcgagaatgctctcatcactcagtcaaggctaatgcttttggaatcagtgttaatatttttcaatctattggccgtgttgtcctacctgaagttcttcaactgccaaaagcacagccctttttctctgagctggtggttctggctaacactgacaggggtcgcttgttcctgtgcagtgggcatcaagtacatgggtgtgttcacgtacgtgctcgtgctgggtgttgcagctgtccatgcctggcacctgcttggagaccagactttgtccaatgtctgtgtgttctgtcacttgctcgcccgagcagtggctttgctggtcatcccggtcgtcctgtacttactgttcttctacgtccacttgattctagtcttccgctctgggccccacgaccaaatcatgtccagtgccttccaggccagcttagagggaggactagctcggatcactcagggtcagccactggaggtggcctttgggtcccaggtcactctgaggaacgtctttgggaaacctgtgccctgctggcttcattcccaccaggacacctaccccatgatatatgagaacggccgaggcagctcccaccagcaacaggtgacctgttaccccttcaaagatgtcaataactggtggattgtaaaggatcccaggaggcaccagctggtggtgagcagccctccgagacctgtgaggcacggggacatggtgcagctggtccacggcatgaccacccgctccctgaacacgcatgatgttgcagcccccctgagcccccattcacaggaggtctcctgctacattgactataacatctccatgcccgcccagaacctctggagactggaaattgtgaacagaggatctgacacagacgtctggaagaccatcctctcagaggtccgctttgtgcacgtgaacacttccgctgtcttaaagctgagcggggctcacctccctgactgggggtatcggcaactggagatcgtcggggagaagctgtcccggggctaccacgggagcacggtgtggaacgtggaggagcaccgatacggcgcgagccaggagcagagggagcgggaacgggagctgcactcacctgcgcaggtggacgtcagcaggaacctcagcttcatggcgagattctcggagctgcagtggaggatgctggcgctgagaagtgatgactcggaacacaagtacagctccagcccactggagtgggtcaccctggacaccaatattgcctactggctgcaccccaggaccagcgctcagatccacctacttggaaacatagtgatctgggtttcgggcagcctcgctctggccatctacgccctgctgtccttgtggtacctgctccgacggcgaagaaatgtccatgacctccctcaggatgcctggctgcgctgggtgctggctggggcgctgtgtgccggtggctgggcagtgaactacctcccgttcttcctgatggagaagacactcttcctctaccactacctgcccgcactcaccttccaaatccttctgctccctgtggtcctgcagcacatcagcgaccacctgtgcaggtcccagctccagaggagcatcttcagcgccctggtggtggcctggtactcctccgcgtgccacgtgtccaacacgctgcgcccactcacctacggggacaagtcactctcgccacatgaactcaaggcccttcgctggaaagacagctgggacatcttgatccgaaaacactagaacaagagtgtggcaaagaacacccgtgctggggtcgggatgaggttgaagggtcttggtcaatgtacgtaatgagcagggtgggccccacgctgggaggacacgggctgggctgagcagggcctctagtggaacacatgggggtctcattgaaaagctctctgatgagcacctccttttgtgcaaagttaattttttctcgacaataaagatattccgtgtctttacccctgaactaagacacagggagtatttcagaggccagcgtaggagtcattgacaacaaaaagccgagaacccagggccagcagtggagcctcagcagaccagggcctggtccttgctaactgctgcagggtggagtttgatctggcagacccgatcctccttcatgaacacccagcaacctgagcaagtcccggccctgccctcagcgagcccggcaggcgtcctgggacagctcagtgttggagggccacctgaaccacgagccagggctggggcttgcatgtcattgtctatgacagcgtcaagactggcccttggcaccgtgctgtgtggaaaccctcccctctgagactccactgagacgtggctgagtgaaatcttcctcgtcagtggtcaaggtgtgtcatccatacagctccatgcctttgtcttttttaaatgtaattaaaaaaggaaccaactggcgtttgta

SEQ ID NO: 172002 - DNA, 812 bp, Homo sapiens
  Payload ID: 13791
  Gene Symbol: POMT1
  Gene Name: protein-O-mannosyltransferase 1
  ENST ID: ENST00000418774
  CDS Start-End: 386-812
cggtgggtggtgcggagtgccgagcggcctcacccccaaccgtcggcccagtcggacggttccgaggcgttgccgggagccgggcgcggctctgtgtggactcggagaaacgcgggtacatttggggacaccggggacgagagcccagcccggacttgggggagtccgtcagtgccggacgcgggtccctggcttgcggacgggctggggccgggggcgtccccgtctttccggagctgggggcggggttcgggcccgggcagatgcggcgttcgggcggccgagccccgaagtaagaactccgtggcgcgtgcagccctagggaggaagggcgtgctgcgggtgcagtctcaggggcgtctgcctgagcccgcttttctacaagatgtggggatttttgaagcgccctgtagtggtgacggctgacatcaacttgagccttgtggccctgactgggatggggttactgagccggctgtggcgactcacctacccgcgggctgtggtttttgacgaagtatattatgggcagtacatctctttttacatgaaacaaatcttcttcttggatgacagtgggccgccatttggccacatggtgctggccttgggaggttatttaggaggattcgatggcaattttttgtggaacagaattggagcagaatacagtagcaacgtgcctgtgtggtccctgcgcctgctgccagcactcgcgggggccttgtcggtccccatggcctaccagatagtgttggagctccacttttctcattgtgccgccatgggagctgctctgttgatgcttatcg

SEQ ID NO: 172003 - DNA, 1168 bp, Homo sapiens
  Payload ID: 13791
  Gene Symbol: POMT1
  Gene Name: protein-O-mannosyltransferase 1
  ENST ID: ENST00000441334
  CDS Start-End: 279-1168
gtctggccccgcaggctcggtgaatcgaacgttgagcagggcggtgggtggtgcggagtgccgagcggcctcacccccaaccgtcggcccagtcggacggttccgaggcgttgccgggagccgggcgcggctctgtgtggactcggagaaacgcgggttatttaggaggattcgatggcaattttttgtggaacagaattggagcagaatacagtagcaacgtgcctgtgtggtccctgcgcctgctgccagcactcgcgggggccttgtcggtccccatggcctaccagatagtgttggagctccacttttctcattgtgccgccatgggagctgctctgttgatgcttatcgagaatgctctcatcactcagtcaaggctaatgcttttggaatcagtgttaatatttttcaatctattggccgtgttgtcctacctgaagttcttcaactgccaaaagcacagccctttttctctgagctggtggttctggctaacactgacaggggtcgcttgttcctgtgcagtgggcatcaagtacatgggtgtgttcacgtacgtgctcgtgctgggtgttgcagctgtccatgcctggcacctgcttggagaccagactttgtccaatgtaggtgctgatgtccagtgctgcatgaggccggcctgtatggggcagatgcagatgtcacagggggtctgtgtgttctgtcacttgctcgcccgagcagtggctttgctggtcatcccggtcgtcctgtacttactgttcttctacgtccacttgattctagtcttccgctctgggccccacgaccaaatcatgtccagtgccttccaggccagcttagagggaggactagctcggatcactcagggtcagccactggaggtggcctttgggtcccaggtcactctgaggaacgtctttgggaaacctgtgccctgctggcttcattcccaccaggacacctaccccatgatatatgagaacggccgaggcagctcccaccagcaacaggtgacctgttaccccttcaaagatgtcaataactggtggattgtaaaggatcccaggaggcaccagctggtggtgagcagccctccgagacctgtgaggcacggggacatggtgcagctggtccacggcatgaccacccgctccctgaacac

SEQ ID NO: 172004 - DNA, 691 bp, Homo sapiens
  Payload ID: 13791
  Gene Symbol: POMT1
  Gene Name: protein-O-mannosyltransferase 1
  ENST ID: ENST00000430619
  CDS Start-End: 188-691
gtcggacggttccgaggcgttgccgggagccgggcgcggctctgtgtggactcggagaaacgcgggttatttaggaggattcgatggcaattttttgtggaacagaattggagcagaatacagtagcaacgtgcctgtgtggtccctgcgcctgctgccagcactcgcgggggccttgtcggtccccatggcctaccagatagtgttggagctccacttttctcattgtgccgccatgggagctgctctgttgatgcttatcgagaatgctctcatcactcagtcaaggctaatgcttttggaatcagtgttaatatttttcaatctattggccgtgttgtcctacctgaagttcttcaactgccaaaagcacagccctttttctctgagctggtggttctggctaacactgacaggggtcgcttgttcctgtgcagtgggcatcaagtacatgggtgtgttcacgtacgtgctcgtgctgggtgttgcagctgtccatgcctggcacctgcttggagaccagactttgtccaatgtctgtgtgttctgtcacttgctcgcccgagcagtggctttgctggtcatcccggtcgtcctgtacttactgttcttctacgtccacttgattctagtcttccgctctgggccccacgaccaaatcatgtccagtgccttccaggccagcttagag

SEQ ID NO: 172005 - DNA, 791 bp, Homo sapiens
  Payload ID: 13791
  Gene Symbol: POMT1
  Gene Name: protein-O-mannosyltransferase 1
  ENST ID: ENST00000448212
  CDS Start-End: 137-791
ccgagcggcctcacccccaaccgtcggcccagtcggacggttccgaggcgttgccgggagccgggcgcggctctgtgtggactcggagaaacgcggttttgacgaagtatattatgggcagtacatctctttttacatgaaacaaatcttcttcttggatgacagtgggccgccatttggccacatggtgctggccttgggaggttatttaggaggattcgatggcaattttttgtggaacagaattggagcagaatacagtagcaacgtgcctgtgtggtccctgcgcctgctgccagcactcgcgggggccttgtcggtccccatggcctaccagatagtgttggagctccacttttctcattgtgccgccatgggagctgctctgttgatgcttatcgagaatgctctcatcactcagtcaaggctaatgcttttggaatcagtgttaatatttttcaatctattggccgtgttgtcctacctgaagttcttcaactgccaaaagcacagccctttttctctgagctggtggttctggctaacactgacaggggtcgcttgttcctgtgcagtgggcatcaagtacatgggtgtgttcacgtacgtgctcgtgctgggtgttgcagctgtccatgcctggcacctgcttggagaccagactttgtccaatgtaggtgctgatgtccagtgctgcatgaggccggcctgtatggggcagatgcagatgtcacagggggtctgtgtgttctgtcacttgctcgcccgagcagtggctttgctggtcatcc

SEQ ID NO: 172006 - DNA, 3320 bp, Homo sapiens
  Payload ID: 13791
  Gene Symbol: POMT1
  Gene Name: protein-O-mannosyltransferase 1
  Uniprot ID: Q9Y6A1
  ENST ID: ENST00000423007
  CDS Start-End: 443-2620
acgcgcgctgctgcccgtctggccccgcaggctcggtgaatcgaacgttgagcagggcggtgggtggtgcggagtgccgagcggcctcacccccaaccgtcggcccagtcggacggttccgaggcgttgccgggagccgggcgcggctctgtgtggactcggagaaacgcgggtacatttggggacaccggggacgagagcccagcccggacttgggggagtccgtcagtgccggacgcgggtccctggcttgcggacgggctggggccgggggcgtccccgtctttccggagctgggggcggggttcgggcccgggcagatgcggcgttcgggcggccgagccccgaagtaagaactccgtggcgcgtgcagccctagggaggaagggcgtgctgcgggtgcagtctcaggggcgtctgcctgagcccgcttttctacaagatgtggggatttttgaagcgccctgtagtggtgacggctgacatcaacttgagccttgtggccctgactgggatggggttactgagccggctgtggcgactcacctacccgcgggctgtggtttttgacgaagtatattatgggcagtacatctctttttacatgaaacaaatcttcttcttggatgacagtgggccgccatttggccacatggtgctggccttgggaggttatttaggaggattcgatggcaattttttgtggaacagaattggagcagaatacagtagcaacgtgcctgtgtggtccctgcgcctgctgccagcactcgcgggggccttgtcggtccccatggcctaccagatagtgttggagctccacttttctcattgtgccgccatgggagctgctctgttgatgcttatcgagaatgctctcatcactcagtcaaggctaatgcttttggaatcagtgttaatatttttcaatctattggccgtgttgtcctacctgaagttcttcaactgccaaaagcacagccctttttctctgagctggtggttctggctaacactgacaggggtcgcttgttcctgtgcagtgggcatcaagtacatgggtgtgttcacgtacgtgctcgtgctgggtgttgcagctgtccatgcctggcacctgcttggagaccagactttgtccaatgtctgtgtgttctgtcacttgctcgcccgagcagtggctttgctggtcatcccggtcgtcctgtacttactgttcttctacgtccacttgattctagtcttccgctctgggccccacgaccaaatcatgtccagtgccttccaggccagcttagagggaggactagctcggatcactcagggtcagccactggaggtggcctttgggtcccaggtcactctgaggaacgtctttgggaaacctgtgccctgctggcttcattcccaccaggacacctaccccatgatatatgagaacggccgaggcagctcccaccagcaacaggtgacctgttaccccttcaaagatgtcaataactggtggattgtaaaggatcccaggaggcaccagctggtggtgagcagccctccgagacctgtgaggcacggggacatggtgcagctggtccacggcatgaccacccgctccctgaacacgcatgatgttgcagcccccctgagcccccattcacaggaggtctcctgctacattgactataacatctccatgcccgcccagaacctctggagactggaaattgtgaacagaggatctgacacagacgtctggaagaccatcctctcagaggtccgctttgtgcacgtgaacacttccgctgtcttaaagctgagcggggctcacctccctgactgggggtatcggcaactggagatcgtcggggagaagctgtcccggggctaccacgggagcacggtgtggaacgtggaggagcaccgatacggcgcgagccaggagcagagggagcgggaacgggagctgcactcacctgcgcaggtggacgtcagcaggaacctcagcttcatggcgagattctcggagctgcagtggaggatgctggcgctgagaagtgatgactcggaacacaagtacagctccagcccactggagtgggtcaccctggacaccaatattgcctactggctgcaccccaggaccagcgctcagatccacctacttggaaacatagtgatctgggtttcgggcagcctcgctctggccatctacgccctgctgtccttgtggtacctgctccgacggcgaagaaatgtccatgacctccctcaggatgcctggctgcgctgggtgctggctggggcgctgtgtgccggtggctgggcagtgaactacctcccgttcttcctgatggagaagacactcttcctctaccactacctgcccgcactcaccttccaaatccttctgctccctgtggtcctgcagcacatcagcgaccacctgtgcaggtcccagctccagaggagcatcttcagcgccctggtggtggcctggtactcctccgcgtgccacgtgtccaacacgctgcgcccactcacctacggggacaagtcactctcgccacatgaactcaaggcccttcgctggaaagacagctgggacatcttgatccgaaaacactagaacaagagtgtggcaaagaacacccgtgctggggtcgggatgaggttgaagggtcttggtcaatgtacgtaatgagcagggtgggccccacgctgggaggacacgggctgggctgagcagggcctctagtggaacacatgggggtctcattgaaaagctctctgatgagcacctccttttgtgcaaagttaattttttctcgacaataaagatattccgtgtctttacccctgaactaagacacagggagtatttcagaggccagcgtaggagtcattgacaacaaaaagccgagaacccagggccagcagtggagcctcagcagaccagggcctggtccttgctaactgctgcagggtggagtttgatctggcagacccgatcctccttcatgaacacccagcaacctgagcaagtcccggccctgccctcagcgagcccggcaggcgtcctgggacagctcagtgttggagggccacctgaaccacgagccagggctggggcttgcatgtcattgtctatgacagcgtcaagactggcccttggcaccgtgctgtgtggaaaccctcccctctgagactccactgagacgtggctgagtgaaatcttcctcgtcagtggtcaaggtgtgtcatccatacagctccatgcctttgtcttttttaaatgtaattaaaaaaggaaccaactggcgtttgta

SEQ ID NO: 172007 - DNA, 847 bp, Homo sapiens
  Payload ID: 13791
  Gene Symbol: POMT1
  Gene Name: protein-O-mannosyltransferase 1
  ENST ID: ENST00000415075
  CDS Start-End: 378-847
cggagtgccgagcggcctcacccccaaccgtcggcccagtcggacggttccgaggcgttgccgggagccgggcgcggctctgtgtggactcggagaaacgcggggcgtctgcctgagcccgcttttctacaagatgtggggatttttgaagcgccctgtagtggtgacggctgacatcaacttgagccttgtggccctgactgggatggggttactgagccggctgtggcgactcacctacccgcgggctgtggtgttatttaggaggattcgatggcaattttttgtggaacagaattggagcagaatacagtagcaacgtgcctgtgtggtccctgcgcctgctgccagcactcgcgggggccttgtcggtccccatggcctaccagatagtgttggagctccacttttctcattgtgccgccatgggagctgctctgttgatgcttatcgagaatgctctcatcactcagtcaaggctaatgcttttggaatcagtgttaatatttttcaatctattggccgtgttgtcctacctgaagttcttcaactgccaaaagcacagtcttccgctctgggccccacgaccaaatcatgtccagtgccttccaggccagcttagagggaggactagctcggatcactcagggtcagccactggaggtggcctttgggtcccaggtcactctgaggaacgtctttgggaaacctgtgccctgctggcttcattcccaccaggacacctaccccatgatgtaagatatgagaacggccgaggcagctcccaccagcaacaggtgacctgttaccccttcaaagatgtcaataactggtggattgtaaagga

SEQ ID NO: 172008 - DNA, 4876 bp, Homo sapiens
  Payload ID: 13792
  Gene Symbol: POMT2
  Gene Name: protein-O-mannosyltransferase 2
  Uniprot ID: Q9UKY4
  ENST ID: ENST00000261534
  CDS Start-End: 204-2456
tgcgcctcctgccgcctcctagcggcccgggccgcgaccacgctgcccgccccgccccgagcccggggccccgcgctccgctgcagtgaagggcgttgcatttcccggggtaccccgagctgccctcttgtgactccttggcggggcggctggtcagacaaagtgtgcctccgggccggagggcgacccagaggagggggaagatgccgccggccacgggcggaggcctggcagagtccgagctgcgtccccggaggggccgctgtggcccccaggctgctagggccgcaggccgggacgtggccgctgaggctgtggcgcgaagccccaaacggcctgcttggggctcacggcgcttcgaggcggtcggctggtgggccctgctggccttggtgacgctgctgtccttcgccacccgcttccaccgcttggacgagccgccgcacatctgttgggatgagactcactttggaaaaatgggaagttactatatcaaccgtacatttttctttgatgtgcacccgcccctgggaaagatgctgataggtcttgctggctacctgagtggatatgatggtacctttttgttccagaagcctggggataaatatgagcatcacagctacatgggaatgagaggattctgtgcattccttggctcctggctggtcccctttgcctacctcactgtactggatctgtccaagtccctctcggcagcactgctcacagctgccctcctcacctttgacacgggatgcctcactctgtcccagtacatcctccttgaccccatcctgatgttcttcatcatggctgccatgctgagcatggtcaagtacaactcttgcgccgacaggcccttctctgccccctggtggttctggctcagcctgactggcgttagtcttgctggtgctttaggggtcaagtttgttggcctctttatcatccttcaagtggggctgaacaccattgcagacctttggtacctgttcggagacctcagtctttcattggtgactgtgggaaaacacctgactgctcgtgtcctgtgcctcatagtgctgcccctggctctctatacagccacctttgctgttcacttcatggtgctgagtaaaagtggccctggtgacggtttcttcagttctgccttccaggcccggctttcagggaacaacctgcacaatgcttccatccctgaacacctggcctacggctctgtgatcactgtgaagaacctccggatggccatcggctatctgcactcccacaggcacctctaccccgagggcattggtgcccgtcagcagcaggtcaccacctatttgcacaaggactacaacaacctgtggattatcaagaaacataacacaaactcagatcccctagacccttccttcccagtggagtttgtaagacatggagacattattcgactagaacacaaagaaacttcccggaacttgcacagtcactatcatgaggcccccatgacccggaagcactatcaggtcaccggctatggcataaatggaacaggggactcaaatgatttctggcggattgaggtcgtaaacaggaaatttggaaaccggatcaaagtgctgagaagtcgaattcgcttcatccatttggtcacaggttgtgtcctgggctcctcgggaaaggttctgcccaagtggggctgggagcagttggaagttacttgcaccccatacctgaaagaaaccctcaactccatctggaatgtggaggaccatatcaatcccaagttgccaaacatcagcctggatgtgctacagcccagttttcctgagatcttgctggaatcccacatggtcatgatccgggggaacagtggcctcaaacccaaggacaatgagttcacgtccaaaccctggcactggcctatcaactatcagggcctacgcttctcaggggtcaatgacacagatttccgagtctatctgcttggcaacccggtggtttggtggctgaatctgttgagcatcgccctctacctcctctcagggagcatcattgctgtagccatgcagagaggggcacggctgccagcggaggttgcagggttgtcccaggtcctgcttcgaggaggcggccaggtcctgctcggctggacactccattacttcccgtttttcctgatgggccgggtcctctacttccaccactacttcccagccatgctcttctcaagcatgttgacaggcattctgtgggacaccctcctgcggctctgtgcctggggcttggcctcatggcccctggcgaggggcatacatgtggcgggaatcctgagcctgctcctgggaactgcctacagcttctacctcttccaccctctggcttacgggatggttggtcccctggcccaggacccccaaagtccaatggcaggactaaggtggctggactcatgggacttttgaggccactgcaaagattccagcctgggtccaggaacttcccaggagagccagctgggaagcagtactggaccatccggccatgaggaagctgcctaaggagcccgaagaattctgctgctcaccaggacccagctctgggagtgcagctggaatggaacccagcattggagagagccgggagagagccgcagctccgtccacagcaccacggagaggacagcgcctcttgggctgctccctcgtgcacagcgcaggggaggatgggtgccagagggtgggagtgggtgcgcgtgtgtgtatgtgagggcatgttgtccatatccctgtggaatacagaccgtgtaactggacagctgagtgtcataaactctaaaatagtccaggctatagtaatattttctggtatttttttctgttggatttctttggttttggtttgtaagatccatcaaaaattctcagacctctgagagggccttgagggcagagaatactgacctcaccttgggatgtcaccaaaggcagagcagatgggactgtcaaagttgtgctgccctccctcccacaaacaaatgaatccagcgtggaggaaggcgcgccgccccgagctggagggcctggctcccaccatgccccccagtggctgcaggtagctggacttcctgcctgtgacgcacagagagcagcggactccggagcgtcagcctgccttagcccttggttcctcgttttttgggattgtcacactgtgacactcgggaggaacgatgtcctatcctgggctgctcagtgttcccaggccctgtgtgccagaggccaggtctctccaagtgcatctagcctggcctggagggcaaggcagatgcattctcctggctgctgggagagcccatgggaaccttgcttagcgcccaaggtagatgagagacagggcagggaatctgcgtggtgctgggatgtggggactctggcctctccagactaatgttcctgtcacctgctgagctttcccagtgtcacttctgcagtcctcctctgctcacccctccctcactccgtgggcaattccctttctctctgtcactgcttcagcagtgaagacccatggcacctagaaatgcatgccagcttcctgcgtctaccactctgcagctcaaacaagaagctcagagctgccccttccacttcctccccaaaagggatgaagaaaaccctgtggtagaaccaaaccacccaaggccagcccttaagcctgcctccaccttcctggtgcatgacaaaatatttcttttgtctcagaggactttgatgcttcaatatttaatgatgaatccgccacactccattttccctcctctgaagctcccaacaactctgacagggtcagatctctttaaagcatcttcaggaggcggttgccacggagactggatattggtcccagggacaggctgtgctacctactgggtggtggggagggaagcttctggccatgcttgggcattcagaccaaccatcattaatgttaatagaggaaatgcagcaacgtcaaaagcaaggcaggttggttaattagatctggggcccgatgacctccctttcccactgctacagcccttttgacttcccccagcaggaagcgctgtctgtgcggctgagtctgggccacttgcttaattgcatttctggcagggaaggagaggagggatggagaagctctgctcgctgcttccacctcaccgtgtgtcctcccctcccctcccttcctctcctccccacaggcggaattgctttcttctgagccgggtgggctctcctgcagggagaatgcaggggtctgtgcttggctcttagcaaagcaggtggcccacagtgacctccaggaggtggctgattttcctttgtgccttcttatttctcagtaggaacttggaagggaagagctctgaaggagccagaggggcagccaccttgcatgagggtgaggaaggagaagcccagccagcctctacccatccctccctcccaattaggctgcactggggccgaacgcttccctgggctcccactgccttctaaggagccaaggagaattccctgcccactttctgttcctccatgcccaaactggcagatgcttctctgggagcaaggccacatgggctgatgcagctttgagtgctcaggttctgttttctggaagttgctggagaagggctgtcagggtgcttctatgaatatgggcttcagctgtagcacttggcagaaacgtgatgtgtcccacaaactgctggtggaggaagaagatgttcgtcagccaattcaacctccagccagcttcttgagcctatttggtttaaaaaaaaaaagtcttctaatcagaagccactgattttataataaataacacttgttttgaa

SEQ ID NO: 172009 - DNA, 948 bp, Homo sapiens
  Payload ID: 13792
  Gene Symbol: POMT2
  Gene Name: protein-O-mannosyltransferase 2
  Uniprot ID: Q9UKY4
  ENST ID: ENST00000556326
  CDS Start-End: 180-428
gcccgggccgcgaccacgctgcccgccccgccccgagcccggggccccgcgctccgctgcagtgaagggcgttgcatttcccggggtaccccgagctgccctcttgtgactccttggcggggcggctggtcagacaaagtgtgcctccgggccggagggcgacccagaggagggggaagatgccgccggccacgggcggaggcctggcagagtccgagctgcgtccccggaggggccgctgtggcccccaggctgctagggccgcaggccgggacgtggccgctgaggctgtggcgcgaagccccaaacggcctgcttggggctcacggcgcttcgaggcggtcggctggtgggccctgctggccttggtgacgctgctgtccttcgccacccgcttccaccgcttggacgagccgccgcacatctgatgctgataggtcttgctggctacctgagtggatatgatggtacctttttgttccagaagcctggggataaatatgagcatcacagctacatgggaatgagaggattctgtgcattccttggctcctggctggtcccctttgcctacctcactgtactggatctgtccaagtccctctcggcagcactgctcacagctgccctcctcacctttgacacgggatgcctcactctgtcccagtacatcctccttgaccccatcctgatgttcttcatcatggctgccatgctgagcatggtcaagtacaactcttgcgccgacaggcccttctctgccccctggtggttctggctcagcctgactggcgttagtcttgctggtgctttaggggtcaagtttgttggcctctttatcatccttcaagtggggctgaacaccattgcagacctttggtacctgttcggagacctcagtctttcattggtgactgtgggaaaacacctgactgctcgtgtcctgtg

SEQ ID NO: 172010 - DNA, 355 bp, Homo sapiens
  Payload ID: 13792
  Gene Symbol: POMT2
  Gene Name: protein-O-mannosyltransferase 2
  ENST ID: ENST00000557289
  CDS Start-End: 1-159
gatctgtccaagtccctctcggcagcactgctcacagctgccctcctcacctttggtgactgtgggaaaacacctgactgctcgtgtcctgtgcctcatagtgctgcccctggctctctatacagccacctttgctgttcacttcatggtgctgagtaaaagtggccctggtgacggtttcttcagttctgccttccaggcccggctttcagggaacaacctgcacaatgcttccatccctgaacacctggcctacggctctgtgatcactgtgaagaacctccggatggccatcggctatctgcactcccacaggcacctctaccccgagggcattggtgcccgtcagcagcag

SEQ ID NO: 172011 - DNA, 580 bp, Homo sapiens
  Payload ID: 13792
  Gene Symbol: POMT2
  Gene Name: protein-O-mannosyltransferase 2
  ENST ID: ENST00000556171
  CDS Start-End: 1-580
tgctacagcccagttttcctgagatcttgctggaatcccacatggtcatgatccgggggaacagtggcctcaaacccaaggacaatgagttcacgtccaaaccctggcactggcctatcaactatcagggcctacgcttctcaggggtcaatgacacagatttccgagtctatctgcttggcaacccggtggtttggtggctgaatctgttgagcatcgccctctacctcctctcagggagcatcattgctgtagccatgcagagaggggcacggctgccagcggaggttgcaggtcaggtcctctgggctctccctcccctgacctggcggcagcagggcacctgcacccctggggagggccggctgcctgctgatgggccatcctttgcgtttaccaccccacaccttcccttatcctttgcttttgaaaggaaaccaaggaaccatgagattaagaaacttgccccaggacatacagctaggttgtcccaggtcctgcttcgaggaggcggccaggtcctgctcggctggacactccattacttcccgtttttcctgatgggccgggtcctctactt

SEQ ID NO: 172012 - DNA, 575 bp, Homo sapiens
  Payload ID: 13792
  Gene Symbol: POMT2
  Gene Name: protein-O-mannosyltransferase 2
  ENST ID: ENST00000555710
  CDS Start-End: 1-228
cgcttctcaggggtcaatgacacagatttccgagtctatctgcttggcaacccggtggtttggtggctgaatctgttgagcatcgccctctacctcctctcagggagcatcattgctgtagccatgcagagaggggcacggctgccagcggaggttgcaggtcacacagcaaggaaggggcagagctggaccagagcctggaatctctgcccgctccttgtcttctgactgggctgtgctgcttgggcccagggttgtcccaggtcctgcttcgaggaggcggccaggtcctgctcggctggacactccattacttcccgtttttcctgatgggccgggtcctctacttccaccactacttcccagccatgctcttctcaagcatgttgacaggcattctgtgggacaccctcctgcggctctgtgcctggggcttggcctcatggcccctggcgaggggcatacatgtggcgggaatcctgagcctgctcctgggaactgcctacagcttctacctcttccaccctctggcttacgggatggttggtcccctggcccaggacccccaaagtcca

SEQ ID NO: 172013 - DNA, 693 bp, Homo sapiens
  Payload ID: 13792
  Gene Symbol: POMT2
  Gene Name: protein-O-mannosyltransferase 2
  ENST ID: ENST00000556394
  CDS Start-End: 1-308
tgttgagcatcgccctctacctcctctcagggagcatcattgctgtagccatgcagagaggggcacggctgccagcggaggttgcaggcattctgtgggacaccctcctgcggctctgtgcctggggcttggcctcatggcccctggcgaggggcatacatgtggcgggaatcctgagcctgctcctgggaactgcctacagcttctacctcttccaccctctggcttacgggatggttggtcccctggcccaggacccccaaagtccaatggcaggactaaggtggctggactcatgggacttttgaggccactgcaaagattccagcctgggtccaggaacttcccaggagagccagctgggaagcagtactggaccatccggccatgaggaagctgcctaaggagcccgaagaattctgctgctcaccaggacccagctctgggagtgcagctggaatggaacccagcattggagagagccgggagagagccgcagctccgtccacagcaccacggagaggacagcgcctcttgggctgctccctcgtgcacagcgcaggggaggatgggtgccagagggtgggagtgggtgcgcgtgtgtgtatgtgagggcatgttgtccatatccctgtggaatacagaccgtgtaactggacagctgagtgtcataaactctaaaatagtccaggc

SEQ ID NO: 172014 - DNA, 565 bp, Homo sapiens
  Payload ID: 13792
  Gene Symbol: POMT2
  Gene Name: protein-O-mannosyltransferase 2
  ENST ID: ENST00000554948
  CDS Start-End: 155-565
taggaggagggccacggtggaggggaacttgagaaggcagtacgcagacctcctctttgtcctggagggagacactgcctcttctctcaaagttgcttgctgcaaacacaaccatgagaaatggcccagttgggatgagactcactttggaaaaatgggaagttactatatcaaccgtacatttttctttgatgtgcacccgcccctgggaaagatgctgataggtcttgctggctacctgagtggatatgatggtacctttttgttccagaagcctggggataaatatgagcatcacagctacatgggaatgagaggattctgtgcattccttggctcctggctggtcccctttgcctacctcactgtactggatctgtccaagtccctctcggcagcactgctcacagctgccctcctcacctttgacacgggatgcctcactctgtcccagtacatcctccttgaccccatcctgatgttcttcatcatggctgccatgctgagcatggtcaagtacaactcttgcgccgacaggcccttctctgccccctggtggttctgg

SEQ ID NO: 172015 - DNA, 658 bp, Homo sapiens
  Payload ID: 13792
  Gene Symbol: POMT2
  Gene Name: protein-O-mannosyltransferase 2
  ENST ID: ENST00000602717
  CDS Start-End: 1-658
gtggtttggtggctgaatctgttgagcatcgccctctacctcctctcagggagcatcattgctgtagccatgcagagaggggcacggctgccagcggaggttgcagggttgtcccaggtcctgcttcgaggaggcggccaggtcctgctcggctggacactccattacttcccgtttttcctgatgggccgggtcctctacttccaccactacttcccagccatgctcttctcaagcatgttgacaggcattctgtgggacaccctcctgcggctctgtgcctggggcttggcctcatggcccctggcgaggggcatacatgtggcgggaatcctgagcctgctcctgggaactgcctacaggagcccgaagaattctgctgctcaccaggacccagctctgggagtgcagctggaatggaacccagcattggagagagccgggagagagccgcagctccgtccacagcaccacggagaggacagcgcctcttgggctgctccctcgtgcacagcgcaggggaggatgggtgccagagggtgggagtgggtgcgcgtgtgtgtatgtgagggcatgttgtccatatccctgtggaatacagaccgtgtaactggacagctgagtgtcataaactctaaaatagtccaggctatagtaa

SEQ ID NO: 172016 - DNA, 1424 bp, Homo sapiens
  Payload ID: 13793
  Gene Symbol: PRG2
  Gene Name: proteoglycan 2, bone marrow (natural killer cell activator, eosinophil granule major basic protein)
  Uniprot ID: P13727
  ENST ID: ENST00000311862
  CDS Start-End: 75-743
aggaagcaaagaaggacctgggctttgggaagatctaaagacccaggaaggtctctgggtgggataaagccaagatgaaactccccttacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggtttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcatactgggctgctcaccagccctggtcccgcggtggtcactgcgtggccctgtgtacccgaggaggccactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactgaaatggatttattttctcctctgatcgcggatccactctgcttagccctcattgaaacttcttccttatcatctctccccacaccacaactttcatagaagtgtcagaagctactactccttgaggaggaggatggagggtggagttgggtctatggagccttttggagatggaggaatgggctcagctagttctcttcatagaacacctgattactgggcacctgcatagtgctgccaggacctttcaaggttgtaggtagactcccaatggcccagtttgcatctctgtaaccaaaggccttttctctctctctctccaaccccagaactgtggttggttttatatgtaaggaagttaacatgtccctgggaacagtccacaacattcaggaatgaatgtataagtaccgcaatccccggcccctcaagtggaataaatctaacatgtattgggcaccatttcccagtggcctgctgtggtagttggccttattccatgcatttttatgggctgccttcccttcctcaactgcattctctgctccttcctactctctgcaactcccaaataa

SEQ ID NO: 172017 - DNA, 1367 bp, Homo sapiens
  Payload ID: 13793
  Gene Symbol: PRG2
  Gene Name: proteoglycan 2, bone marrow (natural killer cell activator, eosinophil granule major basic protein)
  Uniprot ID: P13727
  ENST ID: ENST00000525955
  CDS Start-End: 167-835
gctttgggaagatctaaagacccaggaaggtctctgggtgggtgagtgctttctctgctgtggtggagctggtgacagtttattctcccaggaggtccctggctgtggctgacagtttctggagggctggcaggcgtctacctgtggctttcaggataaagccaagatgaaactccccttacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggtttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcatactgggctgctcaccagccctggtcccgcggtggtcactgcgtggccctgtgtacccgaggaggccactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactgaaatggatttattttctcctctgatcgcggatccactctgcttagccctcattgaaacttcttccttatcatctctccccacaccacaactttcatagaagtgtcagaagctactactccttgaggaggaggatggagggtggagttgggtctatggagccttttggagatggaggaatgggctcagctagttctcttcatagaacacctgattactgggcacctgcatagtgctgccaggacctttcaaggttgtaggtagactcccaatggcccagtttgcatctctgtaaccaaaggccttttctctctctctctccaaccccagaactgtggttggttttatatgtaaggaagttaacatgtccctgggaacagtccacaacattcaggaatgaatgtataagtaccgcaatccccggccc

SEQ ID NO: 172018 - DNA, 1350 bp, Homo sapiens
  Payload ID: 13793
  Gene Symbol: PRG2
  Gene Name: proteoglycan 2, bone marrow (natural killer cell activator, eosinophil granule major basic protein)
  Uniprot ID: P13727
  ENST ID: ENST00000533605
  CDS Start-End: 55-690
ggctttgggaagatctaaagacccaggaaggtctctgggtgggataaagccaagatgaaactccccttacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctgtttacttgccggaggtgctacaggggcaacctggtttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcatactgggctgctcaccagccctggtcccgcggtggtcactgcgtggccctgtgtacccgaggaggccactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactgaaatggatttattttctcctctgatcgcggatccactctgcttagccctcattgaaacttcttccttatcatctctccccacaccacaactttcatagaagtgtcagaagctactactccttgaggaggaggatggagggtggagttgggtctatggagccttttggagatggaggaatgggctcagctagttctcttcatagaacacctgattactgggcacctgcatagtgctgccaggacctttcaaggttgtaggtagactcccaatggcccagtttgcatctctgtaaccaaaggccttttctctctctctctccaaccccagaactgtggttggttttatatgtaaggaagttaacatgtccctgggaacagtccacaacattcaggaatgaatgtataagtaccgcaatccccggcccctcaagtggaataaatctaacatgtattgggcaccatttcccagtggcctgctgtggtagttggccttattccatgcatttttatgggctgccttcccttcctcaactgcattctctgctccttccta

SEQ ID NO: 172019 - DNA, 869 bp, Homo sapiens
  Payload ID: 13794
  Gene Symbol: PRG3
  Gene Name: proteoglycan 3
  Uniprot ID: Q9Y2Y8
  ENST ID: ENST00000287143
  CDS Start-End: 111-788
agaggcactgagagtggaggtctcagactcttggaaggggctatactagacacacaaagacagccccaagaaggacggtggagtagtgtcctcgctaaaagacagtagatatgcaatgcctcttgctcctgccctttctcctgctgggaacagtttctgctcttcatctggagaatgatgccccccatctggagagcctagagacacaggcagacctaggccaggatctggatagttcaaaggagcaggagagagacttggctctgacggaggaggtgattcaggcagagggagaggaggtcaaggcttctgcctgtcaagacaactttgaggatgaggaagccatggagtcggacccagctgccttagacaaggacttccagtgccccagggaagaagacattgttgaagtgcagggaagtccaaggtgcaagatctgccgctacctattggtgcggactcctaaaacttttgcagaagctcagaatgtctgcagcagatgctacggaggcaaccttgtctctatccatgacttcaacttcaactatcgcattcagtgctgcactagcacagtcaaccaagcccaggtctggattggaggcaacctcaggggctggttcctgtggaagcggttttgctggactgatgggagccactggaattttgcttactggtccccagggcaacctgggaatgggcaaggctcctgtgtggccctatgcaccaaaggaggttattggcgacgagctcaatgcgacaagcaactgcccttcgtctgctccttctaagccagcggcacggagaccctgccagcagctccctcccgtcccccaacctctcctgctcataaatccagacttcccacagca

SEQ ID NO: 172020 - DNA, 2606 bp, Homo sapiens
  Payload ID: 13795
  Gene Symbol: PRG4
  Gene Name: proteoglycan 4
  ENST ID: ENST00000367482
  CDS Start-End: 46-2606
atctatcctttacggcaagggtacctacggtacctgaaaacaacgatggcatggaaaacacttcccatttacctgttgttgctgctgtctgttttcgtgattcagcaagtttcatctcaagagctttcctgtaaaggccgctgctttgagtccttcgagagagggagggagtgtgactgcgacgcccaatgtaagaagtatgacaagtgctgtcccgattatgagagtttctgtgcagaagtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctcccaagatcacaacagcaaaaccaataaatcccagacccagtcttccacctaattctgatacatctaaagagacgtctttgacagtgaataaagagacaacagttgaaactaaagaaactactacaacaaataaacagacttcaactgatggaaaagagaagactacttccgctaaagagacacaaagtatagagaaaacatctgctaaagatttagcacccacatctaaagtgctggctaaacctacacccaaagctgaaactacaaccaaaggccctgctctcaccactcccaaggagcccacgcccaccactcccaaggagcctgcatctaccacacccaaagagcccacacctaccaccatcaagtctgcacccaccacccccaaggagcctgcacccaccaccaccaagtctgcacccaccactcccaaggagcctgcacccaccaccaccaaggagcctgcacccaccactcccaaggagcctgcacccaccaccaccaaggagcctgcacccaccaccaccaagtctgcacccaccactcccaaggagcctgcacccaccacccccaagaagcctgccccaactacccccaaggagcctgcacccaccactcccaaggagcctacacccaccactcccaaggagcctgcacccaccaccaaggagcctgcacccaccactcccaaagagcctgcacccactgcccccaagaagcctgccccaactacccccaaggagcctgcacccaccactcccaaggagcctgcacccaccaccaccaaggagccttcacccaccactcccaaggagcctgcacccaccaccaccaagtctgcacccaccactaccaaggagcctgcacccaccactaccaagtctgcacccaccactcccaaggagccttcacccaccaccaccaaggagcctgcacccaccactcccaaggagcctgcacccaccacccccaagaagcctgccccaactacccccaaggagcctgcacccaccactcccaaggaacctgcacccaccaccaccaagaagcctgcacccaccactcccaaagagcctgccccaactacccccaaggagactgcacccaccacccccaagaagctcacgcccaccacccccgagaagctcgcacccaccacccctgagaagcccgcacccaccacccctgaggagctcgcacccaccacccctgaggagcccacacccaccacccctgaggagcctgctcccaccactcccaaggcagcggctcccaacacccctaaggagcctgctccaactacccctaaggagcctgctccaactacccctaaggagcctgctccaactacccctaaggagactgctccaactacccctaaagggactgctccaactaccctcaaggaacctgcacccactactcccaagaagcctgcccccaaggagcttgcacccaccaccaccaaggagcccacatccaccacctctgacaagcccgctccaactacccctaaggggactgctccaactacccctaaggagcctgctccaactacccctaaggagcctgctccaactacccctaaggggactgctccaactaccctcaaggaacctgcacccactactcccaagaagcctgcccccaaggagcttgcacccaccaccaccaaggggcccacatccaccacctctgacaagcctgctccaactacacctaaggagactgctccaactacccccaaggagcctgcacccactacccccaagaagcctgctccaactactcctgagacacctcctccaaccacttcagaggtctctactccaactaccaccaaggagcctaccactatccacaaaagccctgatgaatcaactcctgagctttctgcagaacccacaccaaaagctcttgaaaacagtcccaaggaacctggtgtacctacaactaagactcctgcagcgactaaacctgaaatgactacaacagctaaagacaagacaacagaaagagacttacgtactacacctgaaactacaactgctgcacctaagatgacaaaagagacagcaactacaacagaaaaaactaccgaatccaaaataacagctacaaccacacaagtaacatctaccacaactcaagataccacaccattcaaaattactactcttaaaacaactactcttgcacccaaagtaactacaac

SEQ ID NO: 172021 - DNA, 4921 bp, Homo sapiens
  Payload ID: 13795
  Gene Symbol: PRG4
  Gene Name: proteoglycan 4
  Uniprot ID: Q92954
  ENST ID: ENST00000367483
  CDS Start-End: 46-4137
atctatcctttacggcaagggtacctacggtacctgaaaacaacgatggcatggaaaacacttcccatttacctgttgttgctgctgtctgttttcgtgattcagcaagtttcatctcaagagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaattcggaaaatcaagtcttccaaaaattcagctgctaatagagaattacagaagaaactcaaagtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctcccaagatcacaacagcaaaaccaataaatcccagacccagtcttccacctaattctgatacatctaaagagacgtctttgacagtgaataaagagacaacagttgaaactaaagaaactactacaacaaataaacagacttcaactgatggaaaagagaagactacttccgctaaagagacacaaagtatagagaaaacatctgctaaagatttagcacccacatctaaagtgctggctaaacctacacccaaagctgaaactacaaccaaaggccctgctctcaccactcccaaggagcccacgcccaccactcccaaggagcctgcatctaccacacccaaagagcccacacctaccaccatcaagtctgcacccaccacccccaaggagcctgcacccaccaccaccaagtctgcacccaccactcccaaggagcctgcacccaccaccaccaaggagcctgcacccaccactcccaaggagcctgcacccaccaccaccaaggagcctgcacccaccaccaccaagtctgcacccaccactcccaaggagcctgcacccaccacccccaagaagcctgccccaactacccccaaggagcctgcacccaccactcccaaggagcctacacccaccactcccaaggagcctgcacccaccaccaaggagcctgcacccaccactcccaaagagcctgcacccactgcccccaagaagcctgccccaactacccccaaggagcctgcacccaccactcccaaggagcctgcacccaccaccaccaaggagccttcacccaccactcccaaggagcctgcacccaccaccaccaagtctgcacccaccactaccaaggagcctgcacccaccactaccaagtctgcacccaccactcccaaggagccttcacccaccaccaccaaggagcctgcacccaccactcccaaggagcctgcacccaccacccccaagaagcctgccccaactacccccaaggagcctgcacccaccactcccaaggaacctgcacccaccaccaccaagaagcctgcacccaccactcccaaagagcctgccccaactacccccaaggagactgcacccaccacccccaagaagctcacgcccaccacccccgagaagctcgcacccaccacccctgagaagcccgcacccaccacccctgaggagctcgcacccaccacccctgaggagcccacacccaccacccctgaggagcctgctcccaccactcccaaggcagcggctcccaacacccctaaggagcctgctccaactacccctaaggagcctgctccaactacccctaaggagcctgctccaactacccctaaggagactgctccaactacccctaaagggactgctccaactaccctcaaggaacctgcacccactactcccaagaagcctgcccccaaggagcttgcacccaccaccaccaaggagcccacatccaccacctctgacaagcccgctccaactacccctaaggggactgctccaactacccctaaggagcctgctccaactacccctaaggagcctgctccaactacccctaaggggactgctccaactaccctcaaggaacctgcacccactactcccaagaagcctgcccccaaggagcttgcacccaccaccaccaaggggcccacatccaccacctctgacaagcctgctccaactacacctaaggagactgctccaactacccccaaggagcctgcacccactacccccaagaagcctgctccaactactcctgagacacctcctccaaccacttcagaggtctctactccaactaccaccaaggagcctaccactatccacaaaagccctgatgaatcaactcctgagctttctgcagaacccacaccaaaagctcttgaaaacagtcccaaggaacctggtgtacctacaactaagactcctgcagcgactaaacctgaaatgactacaacagctaaagacaagacaacagaaagagacttacgtactacacctgaaactacaactgctgcacctaagatgacaaaagagacagcaactacaacagaaaaaactaccgaatccaaaataacagctacaaccacacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacagagctactaattctaaagcgacaactcctaaacctcaaaagccaaccaaagcacccaaaaaacccacttctaccaaaaagccaaaaacaatgcctagagtgagaaaaccaaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtataccagtttatatataaaaatgtttttaaacttgacaatcattacactaaaacagatttgataatcttattcacagttgttattgtttacagaccatttaattaatatttcctctgtttattcctcctctccctcccattgcatggctcacacctgtaaaagaaaaaagaatcaaattgaatatatcttttaagaattcaaaactagtgtattcacttaccctagttcattataaaaaatatctaggcattgtggatataaaactgttgggtattctacaacttcaatggaaattattacaagcagattaatccctctttttgtgacacaagtacaatctaaaagttatattggaaaacatggaaatattaaaattttacacttttactagctaaaacataatcacaaagctttatcgtgttgtataaaaaaattaacaatataatggcaataggtagagatacaacaaatgaatataacactataacacttcatattttccaaatcttaatttggatttaaggaagaaatcaataaatataaaatataagcacatatttattatatatctaaggtatacaaatctgtctacatgaagtttacagattggtaaatatcacctgctcaacatgtaattatttaataaaactttggaacattaaaaaaataaattggaggcttaaggatta

SEQ ID NO: 172022 - DNA, 4765 bp, Homo sapiens
  Payload ID: 13795
  Gene Symbol: PRG4
  Gene Name: proteoglycan 4
  Uniprot ID: Q92954
  ENST ID: ENST00000367485
  CDS Start-End: 46-3981
atctatcctttacggcaagggtacctacggtacctgaaaacaacgatggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctcccaagatcacaacagcaaaaccaataaatcccagacccagtcttccacctaattctgatacatctaaagagacgtctttgacagtgaataaagagacaacagttgaaactaaagaaactactacaacaaataaacagacttcaactgatggaaaagagaagactacttccgctaaagagacacaaagtatagagaaaacatctgctaaagatttagcacccacatctaaagtgctggctaaacctacacccaaagctgaaactacaaccaaaggccctgctctcaccactcccaaggagcccacgcccaccactcccaaggagcctgcatctaccacacccaaagagcccacacctaccaccatcaagtctgcacccaccacccccaaggagcctgcacccaccaccaccaagtctgcacccaccactcccaaggagcctgcacccaccaccaccaaggagcctgcacccaccactcccaaggagcctgcacccaccaccaccaaggagcctgcacccaccaccaccaagtctgcacccaccactcccaaggagcctgcacccaccacccccaagaagcctgccccaactacccccaaggagcctgcacccaccactcccaaggagcctacacccaccactcccaaggagcctgcacccaccaccaaggagcctgcacccaccactcccaaagagcctgcacccactgcccccaagaagcctgccccaactacccccaaggagcctgcacccaccactcccaaggagcctgcacccaccaccaccaaggagccttcacccaccactcccaaggagcctgcacccaccaccaccaagtctgcacccaccactaccaaggagcctgcacccaccactaccaagtctgcacccaccactcccaaggagccttcacccaccaccaccaaggagcctgcacccaccactcccaaggagcctgcacccaccacccccaagaagcctgccccaactacccccaaggagcctgcacccaccactcccaaggaacctgcacccaccaccaccaagaagcctgcacccaccactcccaaagagcctgccccaactacccccaaggagactgcacccaccacccccaagaagctcacgcccaccacccccgagaagctcgcacccaccacccctgagaagcccgcacccaccacccctgaggagctcgcacccaccacccctgaggagcccacacccaccacccctgaggagcctgctcccaccactcccaaggcagcggctcccaacacccctaaggagcctgctccaactacccctaaggagcctgctccaactacccctaaggagcctgctccaactacccctaaggagactgctccaactacccctaaagggactgctccaactaccctcaaggaacctgcacccactactcccaagaagcctgcccccaaggagcttgcacccaccaccaccaaggagcccacatccaccacctctgacaagcccgctccaactacccctaaggggactgctccaactacccctaaggagcctgctccaactacccctaaggagcctgctccaactacccctaaggggactgctccaactaccctcaaggaacctgcacccactactcccaagaagcctgcccccaaggagcttgcacccaccaccaccaaggggcccacatccaccacctctgacaagcctgctccaactacacctaaggagactgctccaactacccccaaggagcctgcacccactacccccaagaagcctgctccaactactcctgagacacctcctccaaccacttcagaggtctctactccaactaccaccaaggagcctaccactatccacaaaagccctgatgaatcaactcctgagctttctgcagaacccacaccaaaagctcttgaaaacagtcccaaggaacctggtgtacctacaactaagactcctgcagcgactaaacctgaaatgactacaacagctaaagacaagacaacagaaagagacttacgtactacacctgaaactacaactgctgcacctaagatgacaaaagagacagcaactacaacagaaaaaactaccgaatccaaaataacagctacaaccacacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacagagctactaattctaaagcgacaactcctaaacctcaaaagccaaccaaagcacccaaaaaacccacttctaccaaaaagccaaaaacaatgcctagagtgagaaaaccaaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtataccagtttatatataaaaatgtttttaaacttgacaatcattacactaaaacagatttgataatcttattcacagttgttattgtttacagaccatttaattaatatttcctctgtttattcctcctctccctcccattgcatggctcacacctgtaaaagaaaaaagaatcaaattgaatatatcttttaagaattcaaaactagtgtattcacttaccctagttcattataaaaaatatctaggcattgtggatataaaactgttgggtattctacaacttcaatggaaattattacaagcagattaatccctctttttgtgacacaagtacaatctaaaagttatattggaaaacatggaaatattaaaattttacacttttactagctaaaacataatcacaaagctttatcgtgttgtataaaaaaattaacaatataatggcaataggtagagatacaacaaatgaatataacactataacacttcatattttccaaatcttaatttggatttaaggaagaaatcaataaatataaaatataagcacatatttattatatatctaaggtatacaaatctgtctacatgaagtttacagattggtaaatatcacctgctcaacatgtaattatttaataaaactttggaacattaaaaaaataaattggaggcttaaggatta

SEQ ID NO: 172023 - DNA, 5044 bp, Homo sapiens
  Payload ID: 13795
  Gene Symbol: PRG4
  Gene Name: proteoglycan 4
  Uniprot ID: Q92954
  ENST ID: ENST00000445192
  CDS Start-End: 46-4260
atctatcctttacggcaagggtacctacggtacctgaaaacaacgatggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaattcggaaaatcaagtcttccaaaaattcagctgctaatagagaattacagaagaaactcaaagtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctcccaagatcacaacagcaaaaccaataaatcccagacccagtcttccacctaattctgatacatctaaagagacgtctttgacagtgaataaagagacaacagttgaaactaaagaaactactacaacaaataaacagacttcaactgatggaaaagagaagactacttccgctaaagagacacaaagtatagagaaaacatctgctaaagatttagcacccacatctaaagtgctggctaaacctacacccaaagctgaaactacaaccaaaggccctgctctcaccactcccaaggagcccacgcccaccactcccaaggagcctgcatctaccacacccaaagagcccacacctaccaccatcaagtctgcacccaccacccccaaggagcctgcacccaccaccaccaagtctgcacccaccactcccaaggagcctgcacccaccaccaccaaggagcctgcacccaccactcccaaggagcctgcacccaccaccaccaaggagcctgcacccaccaccaccaagtctgcacccaccactcccaaggagcctgcacccaccacccccaagaagcctgccccaactacccccaaggagcctgcacccaccactcccaaggagcctacacccaccactcccaaggagcctgcacccaccaccaaggagcctgcacccaccactcccaaagagcctgcacccactgcccccaagaagcctgccccaactacccccaaggagcctgcacccaccactcccaaggagcctgcacccaccaccaccaaggagccttcacccaccactcccaaggagcctgcacccaccaccaccaagtctgcacccaccactaccaaggagcctgcacccaccactaccaagtctgcacccaccactcccaaggagccttcacccaccaccaccaaggagcctgcacccaccactcccaaggagcctgcacccaccacccccaagaagcctgccccaactacccccaaggagcctgcacccaccactcccaaggaacctgcacccaccaccaccaagaagcctgcacccaccactcccaaagagcctgccccaactacccccaaggagactgcacccaccacccccaagaagctcacgcccaccacccccgagaagctcgcacccaccacccctgagaagcccgcacccaccacccctgaggagctcgcacccaccacccctgaggagcccacacccaccacccctgaggagcctgctcccaccactcccaaggcagcggctcccaacacccctaaggagcctgctccaactacccctaaggagcctgctccaactacccctaaggagcctgctccaactacccctaaggagactgctccaactacccctaaagggactgctccaactaccctcaaggaacctgcacccactactcccaagaagcctgcccccaaggagcttgcacccaccaccaccaaggagcccacatccaccacctctgacaagcccgctccaactacccctaaggggactgctccaactacccctaaggagcctgctccaactacccctaaggagcctgctccaactacccctaaggggactgctccaactaccctcaaggaacctgcacccactactcccaagaagcctgcccccaaggagcttgcacccaccaccaccaaggggcccacatccaccacctctgacaagcctgctccaactacacctaaggagactgctccaactacccccaaggagcctgcacccactacccccaagaagcctgctccaactactcctgagacacctcctccaaccacttcagaggtctctactccaactaccaccaaggagcctaccactatccacaaaagccctgatgaatcaactcctgagctttctgcagaacccacaccaaaagctcttgaaaacagtcccaaggaacctggtgtacctacaactaagactcctgcagcgactaaacctgaaatgactacaacagctaaagacaagacaacagaaagagacttacgtactacacctgaaactacaactgctgcacctaagatgacaaaagagacagcaactacaacagaaaaaactaccgaatccaaaataacagctacaaccacacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacagagctactaattctaaagcgacaactcctaaacctcaaaagccaaccaaagcacccaaaaaacccacttctaccaaaaagccaaaaacaatgcctagagtgagaaaaccaaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtataccagtttatatataaaaatgtttttaaacttgacaatcattacactaaaacagatttgataatcttattcacagttgttattgtttacagaccatttaattaatatttcctctgtttattcctcctctccctcccattgcatggctcacacctgtaaaagaaaaaagaatcaaattgaatatatcttttaagaattcaaaactagtgtattcacttaccctagttcattataaaaaatatctaggcattgtggatataaaactgttgggtattctacaacttcaatggaaattattacaagcagattaatccctctttttgtgacacaagtacaatctaaaagttatattggaaaacatggaaatattaaaattttacacttttactagctaaaacataatcacaaagctttatcgtgttgtataaaaaaattaacaatataatggcaataggtagagatacaacaaatgaatataacactataacacttcatattttccaaatcttaatttggatttaaggaagaaatcaataaatataaaatataagcacatatttattatatatctaaggtatacaaatctgtctacatgaagtttacagattggtaaatatcacctgctcaacatgtaattatttaataaaactttggaacattaaaaaaataaattggaggcttaaggatta

SEQ ID NO: 172024 - DNA, 531 bp, Homo sapiens
  Payload ID: 13795
  Gene Symbol: PRG4
  Gene Name: proteoglycan 4
  ENST ID: ENST00000533951
  CDS Start-End: 46-531
atctatcctttacggcaagggtacctacggtacctgaaaacaacgatggcatggaaaacacttcccatttacctgttgttgctgctgtctgttttcgtgattcagcaagtttcatctcaagagctttcctgtaaaggccgctgctttgagtccttcgagagagggagggagtgtgactgcgacgcccaatgtaagaagtatgacaagtgctgtcccgattatgagagtttctgtgcagaagaacattctgtttctgaaaatcaagagtcctcctcctcctcctcctcttcctcttcttcttcaacaattcggaaaatcaagtcttccaaaaattcagctgctaatagagaattacagaagaaactcaaagtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctcccaagatcaca

SEQ ID NO: 172025 - DNA, 4915 bp, Homo sapiens
  Payload ID: 13795
  Gene Symbol: PRG4
  Gene Name: proteoglycan 4
  ENST ID: ENST00000635041
  CDS Start-End: 46-4131
atctatcctttacggcaagggtacctacggtacctgaaaacaacgatggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagtaaaagataacaagaagaacagaactaaaaagaaacctacccccaaaccaccagttgtagatgaagctggaagtggattggacaatggtgacttcaaggtcacaactcctgacacgtctaccacccaacacaataaagtcagcacatctcccaagatcacaacagcaaaaccaataaatcccagacccagtcttccacctaattctgatacatctaaagagacgtctttgacagtgaataaagagacaacagttgaaactaaagaaactactacaacaaataaacagacttcaactgatggaaaagagaagactacttccgctaaagagacacaaagtatagagaaaacatctgctaaagatttagcacccacatctaaagtgctggctaaacctacacccaaagctgaaactacaaccaaaggccctgctctcaccactcccaaggagcccacgcccaccactcccaaggagcctgcatctaccacacccaaagagcccacacctaccaccatcaagtctgcacccaccacccccaaggagcctgcacccaccaccaccaagtctgcacccaccactcccaaggagcctgcacccaccaccaccaaggagcctgcacccaccactcccaaggagcctgcacccaccaccaccaaggagcctgcacccaccaccaccaagtctgcacccaccactcccaaggagcctgcacccaccacccccaagaagcctgccccaactacccccaaggagcctgcacccaccactcccaaggagcctacacccaccactcccaaggagcctgcacccaccaccaaggagcctgcacccaccactcccaaagagcctgcacccactgcccccaagaagcctgccccaactacccccaaggagcctgcacccaccactcccaaggagcctgcacccaccaccaccaaggagccttcacccaccactcccaaggagcctgcacccaccaccaccaagtctgcacccaccactaccaaggagcctgcacccaccactaccaagtctgcacccaccactcccaaggagccttcacccaccaccaccaaggagcctgcacccaccactcccaaggagcctgcacccaccacccccaagaagcctgccccaactacccccaaggagcctgcacccaccactcccaaggaacctgcacccaccaccaccaagaagcctgcacccaccactcccaaagagcctgccccaactacccccaaggagactgcacccaccacccccaagaagctcacgcccaccacccccgagaagctcgcacccaccacccctgagaagcccgcacccaccacccctgaggagctcgcacccaccacccctgaggagcccacacccaccacccctgaggagcctgctcccaccactcccaaggcagcggctcccaacacccctaaggagcctgctccaactacccctaaggagcctgctccaactacccctaaggagcctgctccaactacccctaaggagactgctccaactacccctaaagggactgctccaactaccctcaaggaacctgcacccactactcccaagaagcctgcccccaaggagcttgcacccaccaccaccaaggagcccacatccaccacctctgacaagcccgctccaactacccctaaggggactgctccaactacccctaaggagcctgctccaactacccctaaggagcctgctccaactacccctaaggggactgctccaactaccctcaaggaacctgcacccactactcccaagaagcctgcccccaaggagcttgcacccaccaccaccaaggggcccacatccaccacctctgacaagcctgctccaactacacctaaggagactgctccaactacccccaaggagcctgcacccactacccccaagaagcctgctccaactactcctgagacacctcctccaaccacttcagaggtctctactccaactaccaccaaggagcctaccactatccacaaaagccctgatgaatcaactcctgagctttctgcagaacccacaccaaaagctcttgaaaacagtcccaaggaacctggtgtacctacaactaagactcctgcagcgactaaacctgaaatgactacaacagctaaagacaagacaacagaaagagacttacgtactacacctgaaactacaactgctgcacctaagatgacaaaagagacagcaactacaacagaaaaaactaccgaatccaaaataacagctacaaccacacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacagagctactaattctaaagcgacaactcctaaacctcaaaagccaaccaaagcacccaaaaaacccacttctaccaaaaagccaaaaacaatgcctagagtgagaaaaccaaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtataccagtttatatataaaaatgtttttaaacttgacaatcattacactaaaacagatttgataatcttattcacagttgttattgtttacagaccatttaattaatatttcctctgtttattcctcctctccctcccattgcatggctcacacctgtaaaagaaaaaagaatcaaattgaatatatcttttaagaattcaaaactagtgtattcacttaccctagttcattataaaaaatatctaggcattgtggatataaaactgttgggtattctacaacttcaatggaaattattacaagcagattaatccctctttttgtgacacaagtacaatctaaaagttatattggaaaacatggaaatattaaaattttacacttttactagctaaaacataatcacaaagctttatcgtgttgtataaaaaaattaacaatataatggcaataggtagagatacaacaaatgaatataacactataacacttcatattttccaaatcttaatttggatttaaggaagaaatcaataaatataaaatataagcacatatttattatatatctaaggtatacaaatctgtctacatgaagtttacagattggtaaatatcacctgctcaacatgtaattatttaataaaactttggaacattaaaaaaataaattggaggcttaaggatta

SEQ ID NO: 172026 - DNA, 608 bp, Homo sapiens
  Payload ID: 13796
  Gene Symbol: PLP1
  Gene Name: proteolipid protein 1
  ENST ID: ENST00000443502
  CDS Start-End: 274-608
agatgtctctgcagcaaagcgaaattccaggcaagccttagggaaaaaaggaaaaacaaagaaaatgaaacaattggcagtgaaaggcagaaagagaagatggagcccttagagaagggagtatccctgagagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaaggg

SEQ ID NO: 172027 - DNA, 587 bp, Homo sapiens
  Payload ID: 13796
  Gene Symbol: PLP1
  Gene Name: proteolipid protein 1
  ENST ID: ENST00000433491
  CDS Start-End: 286-587
acttcatggcttctcacgcttgtgctgcatatcccacaccaattagacccaaggatcagttggaagtttccaggacatcttcattttatttccaccctcaatccacatttccagatgtctctgcagcaaagcgaaattccaggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctt

SEQ ID NO: 172028 - DNA, 786 bp, Homo sapiens
  Payload ID: 13796
  Gene Symbol: PLP1
  Gene Name: proteolipid protein 1
  ENST ID: ENST00000434483
  CDS Start-End: 419-786
agtcttctatgccagggctaggaaagctgccttccaaaatttggtctgggaagacattatcctgggaatgagaagcaaagcctcagctctagaagcccaaataatagcagatgacccaggctttcactggcacccagtacaggcagcaggctgcaccaagaaggctggcagtgcctcttgaggaatcccttggcagtgcaggagcctagctggactcaagaatattttgccaagggcacccagcagaaccaatggaagcagaatcacagaaataggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggg

SEQ ID NO: 172029 - DNA, 580 bp, Homo sapiens
  Payload ID: 13796
  Gene Symbol: PLP1
  Gene Name: proteolipid protein 1
  ENST ID: ENST00000455268
  CDS Start-End: 172-580
aatcttgcctttctcccaccccaggaaggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggggaggggttccagaggccaacatcaagctcattctttggagc

SEQ ID NO: 172030 - DNA, 588 bp, Homo sapiens
  Payload ID: 13796
  Gene Symbol: PLP1
  Gene Name: proteolipid protein 1
  ENST ID: ENST00000422393
  CDS Start-End: 207-588
aaggcaaaatcacaggaaaagttccaggagaccataccttccttctccggagtcttccaacaggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggggaggggttccagag

SEQ ID NO: 172031 - DNA, 2896 bp, Homo sapiens
  Payload ID: 13796
  Gene Symbol: PLP1
  Gene Name: proteolipid protein 1
  Uniprot ID: P60201
  ENST ID: ENST00000619236
  CDS Start-End: 147-875
caggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacgtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgagttccaaatgaccttccacctgtttattgctgcatttgtgggggctgcagctacactggtttccctgctcaccttcatgattgctgccacttacaactttgccgtccttaaactcatgggccgaggcaccaagttctgatcccccgtagaaatccccctttctctaatagcgaggctctaaccacacagcctacaatgctgcgtctcccatcttaactctttgcctttgccaccaactggccctcttcttacttgatgagtgtaacaagaaaggagagtcttgcagtgattaaggtctctctttggactctcccctcttatgtacctcttttagtcattttgcttcatagctggttcctgctagaaatgggaaatgcctaagaagatgacttcccaactgcaagtcacaaaggaatggaggctctaattgaattttcaagcatctcctgaggatcagaaagtaatttcttctcaaagggtacttccactgatggaaacaaagtggaaggaaagatgctcaggtacagagaaggaatgtctttggtcctcttgccatctataggggccaaatatattctctttggtgtacaaaatggaattcattctggtctctctattaccactgaagatagaagaaaaaagaatgtcagaaaaacaataagagcgtttgcccaaatctgcctattgcagctgggagaagggggtcaaagcaaggatctttcacccacagaaagagagcactgaccccgatggcgatggactactgaagccctaactcagccaaccttacttacagcataagggagcgtagaatctgtgtagacgaagggggcatctggccttacacctcgttagggaagagaaacagggtgttgtcagcatcttctcactcccttctccttgataacagctaccatgacaaccctgtggtttccaaggagctgagaatagaaggaaactagcttacatgagaacagactggcctgaggagcagcagttgctggtggctaatggtgtaacctgagatggccctctggtagacacaggatagataactctttggatagcatgtctttttttctgttaattagttgtgtactctggcctctgtcatatcttcacaatggtgctcatttcatggggtattatccattcagtcatcgtaggtgatttgaaggtcttgatttgttttagaatgatgcacatttcatgtattccagtttgtttattacttatttggggttgcatcagaaatgtctggagaataattctttgattatgactgttttttaaactaggaaaattggacattaagcatcacaaatgatattaaaaattggctagttgaatctattgggattttctacaagtattctgcctttgcagaaacagatttggtgaatttgaatctcaatttgagtaatctgatcgttctttctagctaatggaaaatgattttacttagcaatgttatcttggtgtgttaagagttaggtttaacataaaggttattttctcctgatatagatcacataacagaatgcaccagtcatcagctattcagttggtaagcttccaggaaaaaggacaggcagaaagagtttgagacctgaatagctcccagatttcagtcttttcctgtttttgttaactttgggttaaaaaaaaaaaaagtctgattggttttaattgaaggaaagatttgtactacagttcttttgttgtaaagagttgtgttgttcttttcccccaaagtggtttcagcaatatttaaggagatgtaagagctttacaaaaagacacttgatacttgttttcaaaccagtatacaagataagcttccaggctgcatagaaggaggagagggaaaatgttttgtaagaaaccaatcaagataaaggacagtgaagtaatccgtaccttgtgttttgttttgatttaataacataacaaataaccaacccttccctgaaaacctcacatgcatacatacacatatatacacacacaaagagagttaatcaactgaaagtgtttccttcatttctgatatagaattgcaattttaacacacataaaggataaacttttagaaacttatcttacaaagtgtattttataaaattaaagaaaataaaattaagaatgttctcaatcaaa

SEQ ID NO: 172032 - DNA, 624 bp, Homo sapiens
  Payload ID: 13796
  Gene Symbol: PLP1
  Gene Name: proteolipid protein 1
  ENST ID: ENST00000494475
  CDS Start-End: 215-624
gggctctggaggacctgggaagataccctatgaggtctgtagggagccctcaggaaaggtctgctgacgaggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggggaggggttccagaggccaacatcaagctcattctttggagcg

SEQ ID NO: 172033 - DNA, 3132 bp, Homo sapiens
  Payload ID: 13796
  Gene Symbol: PLP1
  Gene Name: proteolipid protein 1
  Uniprot ID: P60201
  ENST ID: ENST00000612423
  CDS Start-End: 281-1114
atggcttctcacgcttgtgctgcatatcccacaccaattagacccaaggatcagttggaagtttccaggacatcttcattttatttccaccctcaatccacatttccagatgtctctgcagcaaagcgaaattccaggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggggaggggttccagaggccaacatcaagctcattctttggagcgggtgtgtcattgtttgggaaaatggctaggacatcccgacaagtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgagttccaaatgaccttccacctgtttattgctgcatttgtgggggctgcagctacactggtttccctgctcaccttcatgattgctgccacttacaactttgccgtccttaaactcatgggccgaggcaccaagttctgatcccccgtagaaatccccctttctctaatagcgaggctctaaccacacagcctacaatgctgcgtctcccatcttaactctttgcctttgccaccaactggccctcttcttacttgatgagtgtaacaagaaaggagagtcttgcagtgattaaggtctctctttggactctcccctcttatgtacctcttttagtcattttgcttcatagctggttcctgctagaaatgggaaatgcctaagaagatgacttcccaactgcaagtcacaaaggaatggaggctctaattgaattttcaagcatctcctgaggatcagaaagtaatttcttctcaaagggtacttccactgatggaaacaaagtggaaggaaagatgctcaggtacagagaaggaatgtctttggtcctcttgccatctataggggccaaatatattctctttggtgtacaaaatggaattcattctggtctctctattaccactgaagatagaagaaaaaagaatgtcagaaaaacaataagagcgtttgcccaaatctgcctattgcagctgggagaagggggtcaaagcaaggatctttcacccacagaaagagagcactgaccccgatggcgatggactactgaagccctaactcagccaaccttacttacagcataagggagcgtagaatctgtgtagacgaagggggcatctggccttacacctcgttagggaagagaaacagggtgttgtcagcatcttctcactcccttctccttgataacagctaccatgacaaccctgtggtttccaaggagctgagaatagaaggaaactagcttacatgagaacagactggcctgaggagcagcagttgctggtggctaatggtgtaacctgagatggccctctggtagacacaggatagataactctttggatagcatgtctttttttctgttaattagttgtgtactctggcctctgtcatatcttcacaatggtgctcatttcatggggtattatccattcagtcatcgtaggtgatttgaaggtcttgatttgttttagaatgatgcacatttcatgtattccagtttgtttattacttatttggggttgcatcagaaatgtctggagaataattctttgattatgactgttttttaaactaggaaaattggacattaagcatcacaaatgatattaaaaattggctagttgaatctattgggattttctacaagtattctgcctttgcagaaacagatttggtgaatttgaatctcaatttgagtaatctgatcgttctttctagctaatggaaaatgattttacttagcaatgttatcttggtgtgttaagagttaggtttaacataaaggttattttctcctgatatagatcacataacagaatgcaccagtcatcagctattcagttggtaagcttccaggaaaaaggacaggcagaaagagtttgagacctgaatagctcccagatttcagtcttttcctgtttttgttaactttgggttaaaaaaaaaaaaagtctgattggttttaattgaaggaaagatttgtactacagttcttttgttgtaaagagttgtgttgttcttttcccccaaagtggtttcagcaatatttaaggagatgtaagagctttacaaaaagacacttgatacttgttttcaaaccagtatacaagataagcttccaggctgcatagaaggaggagagggaaaatgttttgtaagaaaccaatcaagataaaggacagtgaagtaatccgtaccttgtgttttgttttgatttaataacataacaaataaccaacccttccctgaaaacctcacatgcatacatacacatatatacacacacaaagagagttaatcaactgaaagtgtttccttcatttctgatatagaattgcaattttaacacacataaaggataaacttttagaaacttatcttacaaagtgtattttataaaattaaagaaaataaaattaagaatgttctcaatc

SEQ ID NO: 172034 - DNA, 3001 bp, Homo sapiens
  Payload ID: 13796
  Gene Symbol: PLP1
  Gene Name: proteolipid protein 1
  Uniprot ID: P60201
  ENST ID: ENST00000621218
  CDS Start-End: 147-980
caggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggggaggggttccagaggccaacatcaagctcattctttggagcgggtgtgtcattgtttgggaaaatggctaggacatcccgacaagtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgagttccaaatgaccttccacctgtttattgctgcatttgtgggggctgcagctacactggtttccctgctcaccttcatgattgctgccacttacaactttgccgtccttaaactcatgggccgaggcaccaagttctgatcccccgtagaaatccccctttctctaatagcgaggctctaaccacacagcctacaatgctgcgtctcccatcttaactctttgcctttgccaccaactggccctcttcttacttgatgagtgtaacaagaaaggagagtcttgcagtgattaaggtctctctttggactctcccctcttatgtacctcttttagtcattttgcttcatagctggttcctgctagaaatgggaaatgcctaagaagatgacttcccaactgcaagtcacaaaggaatggaggctctaattgaattttcaagcatctcctgaggatcagaaagtaatttcttctcaaagggtacttccactgatggaaacaaagtggaaggaaagatgctcaggtacagagaaggaatgtctttggtcctcttgccatctataggggccaaatatattctctttggtgtacaaaatggaattcattctggtctctctattaccactgaagatagaagaaaaaagaatgtcagaaaaacaataagagcgtttgcccaaatctgcctattgcagctgggagaagggggtcaaagcaaggatctttcacccacagaaagagagcactgaccccgatggcgatggactactgaagccctaactcagccaaccttacttacagcataagggagcgtagaatctgtgtagacgaagggggcatctggccttacacctcgttagggaagagaaacagggtgttgtcagcatcttctcactcccttctccttgataacagctaccatgacaaccctgtggtttccaaggagctgagaatagaaggaaactagcttacatgagaacagactggcctgaggagcagcagttgctggtggctaatggtgtaacctgagatggccctctggtagacacaggatagataactctttggatagcatgtctttttttctgttaattagttgtgtactctggcctctgtcatatcttcacaatggtgctcatttcatggggtattatccattcagtcatcgtaggtgatttgaaggtcttgatttgttttagaatgatgcacatttcatgtattccagtttgtttattacttatttggggttgcatcagaaatgtctggagaataattctttgattatgactgttttttaaactaggaaaattggacattaagcatcacaaatgatattaaaaattggctagttgaatctattgggattttctacaagtattctgcctttgcagaaacagatttggtgaatttgaatctcaatttgagtaatctgatcgttctttctagctaatggaaaatgattttacttagcaatgttatcttggtgtgttaagagttaggtttaacataaaggttattttctcctgatatagatcacataacagaatgcaccagtcatcagctattcagttggtaagcttccaggaaaaaggacaggcagaaagagtttgagacctgaatagctcccagatttcagtcttttcctgtttttgttaactttgggttaaaaaaaaaaaaagtctgattggttttaattgaaggaaagatttgtactacagttcttttgttgtaaagagttgtgttgttcttttcccccaaagtggtttcagcaatatttaaggagatgtaagagctttacaaaaagacacttgatacttgttttcaaaccagtatacaagataagcttccaggctgcatagaaggaggagagggaaaatgttttgtaagaaaccaatcaagataaaggacagtgaagtaatccgtaccttgtgttttgttttgatttaataacataacaaataaccaacccttccctgaaaacctcacatgcatacatacacatatatacacacacaaagagagttaatcaactgaaagtgtttccttcatttctgatatagaattgcaattttaacacacataaaggataaacttttagaaacttatcttacaaagtgtattttataaaattaaagaaaataaaattaagaatgttctcaatcaaa

SEQ ID NO: 172035 - DNA, 620 bp, Homo sapiens
  Payload ID: 13797
  Gene Symbol: PLP2
  Gene Name: proteolipid protein 2 (colonic epithelium-enriched)
  Uniprot ID: Q04941
  ENST ID: ENST00000376322
  CDS Start-End: 76-513
ctgggtgtacagcgtcctcgaaaccacgagcaagtgagcagatcctccgaggcaccagggactccagcccatgccatggcggattctgagcgcctctcggctcctggctgctgggccgcctgcaccaacttctcgcgcactcgaaagggaatcctcctgtttgctgagattatattatgcctggtgatcctgatctgcttcagtgcctccacaccaggctactcctccctgtcggtgattgagatgatccttgctgctattttctttgttgtctacatgtgtgacctgcacaccaagataccattcatcaactggccctggagtgatttcttccgaaccctcatagcggcaatcctctacctgatcacctccattgttgtccttgttgagagaggaaaccactccaaaatcgtcgcaggggtaaaggccatgggagcagctctgaagcacagagcgaagggtttgaggagccagggaccatttctgcctttgcttctggcagaaatcgtgtgacccacagcaagtcacacttgtcctcagacatggaggaaagtctggcccaggacttggttttgcctcccaaggtcttcatttgctgtgaagggaagtcccttgtcaga

SEQ ID NO: 172036 - DNA, 1079 bp, Homo sapiens
  Payload ID: 13797
  Gene Symbol: PLP2
  Gene Name: proteolipid protein 2 (colonic epithelium-enriched)
  Uniprot ID: Q04941
  ENST ID: ENST00000376327
  CDS Start-End: 76-534
ctgggtgtacagcgtcctcgaaaccacgagcaagtgagcagatcctccgaggcaccagggactccagcccatgccatggcggattctgagcgcctctcggctcctggctgctgggccgcctgcaccaacttctcgcgcactcgaaagggaatcctcctgtttgctgagattatattatgcctggtgatcctgatctgcttcagtgcctccacaccaggctactcctccctgtcggtgattgagatgatccttgctgctattttctttgttgtctacatgtgtgacctgcacaccaagataccattcatcaactggccctggagtgatttcttccgaaccctcatagcggcaatcctctacctgatcacctccattgttgtccttgttgagagaggaaaccactccaaaatcgtcgcaggggtactgggcctaatcgctacgtgcctctttggctatgatgcctatgtcaccttccccgttcggcagccaagacatacagcagcccccactgaccccgcagatggcccggtgtaggcgaacttccctcatttctctctgcaatctgcaaataactcctccattgaaataactcctccccaccccaacaacaacattcccagcagaccaactcccaccccctctttgaggtaaaagtgcctttattgggagacttttgtcttccagcctgccaatcaaccctcctgggtgtggccaccatatgtgtgtgcctaggtcctccttctgcacgatccaataggagacaccagttctgactgaaccatgcccccacctaagtcacaaaatgagggaagtggggagttagatttcagagtccaggccctaggttgggacccactccaaataatctcctcggtgtgggtggtggttctatagagggataaatgaataataaacattgttaaaatatacgataatgaataaagtaatcctttcatcaaatgtgggtaaatttcaagcatcaggagggggaaatggagtggaaacagctggggcaaggaggcaaagaagccaggcctgttttacaacaaatattaaattacttcaataatacaaacgag

SEQ ID NO: 172037 - DNA, 1212 bp, Homo sapiens
  Payload ID: 13798
  Gene Symbol: PTMA
  Gene Name: prothymosin, alpha
  Uniprot ID: P06454
  ENST ID: ENST00000341369
  CDS Start-End: 192-527
cgcgtgagtcccccactggctgctctgaaaagccatctttgcattgttcctcatccgcctccttgctcgccgcagccgcctccgccgcgcgcctcctccgccgccgcggactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaagaggcagaaaatggaagagacgcccctgctaacgggaatgctgagaatgaggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactagacagcaaaaaaggaaaagttaaactaaaaaaaaaaaggccgccgtgacctattcaccctccacttcccgtctcagaatctaaacgtggtcaccttcgagtagagaggcccgcccgcccaccgtgggcagtgccacccgcagatgacacgcgctctccaccacccaacccaaaccatgagaatttgcaacaggggaggaaaaaagaaccaaaacttccaaggccctgctttttttcttaaaagtactttaaaaaggaaatttgtttgtattttttatttacattttatatttttgtacatattgttagggtcagccatttttaatgatctcggatgaccaaaccagccttcggagcgttctctgtcctacttctgactttacttgtggtgtgaccatgttcattataatctcaaaggagaaaaaaaaccttgtaaaaaaagcaaaaatgacaacagaaaaacaatcttattccgagcattccagtaacttttttgtgtatgtacttagctgtactataagtagttggtttgtatgagatggttaaaaaggccaaagataaaaggtttctttttttttccttttttgtctatgaagttgctgtttattttttttggcctgtttgatgtatgtgtgaaacaatgttgtccaacaataaacaggaattttattttgctgagttgttcta

SEQ ID NO: 172038 - DNA, 933 bp, Homo sapiens
  Payload ID: 13798
  Gene Symbol: PTMA
  Gene Name: prothymosin, alpha
  ENST ID: ENST00000409683
  CDS Start-End: 172-495
tgctctgaaaagccatctttgcattgttcctcatccgcctccttgctcgccgcagccgcctccgccgcgcgcctcctccgccgccgcggactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaagaggcagaaaatggaagagacgcccctgctaacgggaatgctaatgaggaaaatggggagcaggaggctgacaatgaggtagacgaagaagaggaagaaggtggggaggaagaggaggaggaagaagaaggtgatgaggatggagatgaagatgaggaagctgagtcagctacgggcaagcgggcagctgaagatgatgaggatgacgatgtcgataccaagaagcagaagaccgacgaggatgactagacagcaaaaaaggaaaagttaaactaaaaaaaaaaaggccgccgtgacctattcaccctccacttcccgtctcagaatctaaacgtggtcaccttcgagtagagaggcccgcccgcccaccgtgggcagtgccacccgcagatgacacgcgctctccaccacccaacccaaaccatgagaatttgcaacaggggaggaaaaaagaaccaaaacttccaaggccctgctttttttcttaaaagtactttaaaaaggaaatttgtttgtattttttatttacattttatatttttgtacatattgttagggtcagccatttttaatgatctcggatgaccaaaccagccttcggagcgttctctgtcctacttctgactttacttgtggtgtgaccatgttcattataatctcaaaggagaaaaaaaaccttgtaaaaaa

SEQ ID NO: 172039 - DNA, 735 bp, Homo sapiens
  Payload ID: 13798
  Gene Symbol: PTMA
  Gene Name: prothymosin, alpha
  ENST ID: ENST00000409321
  CDS Start-End: 83-478
gggaccgctatgccgtgcggggcccgcgggctgtcccactcgagggctggagccggcatcgcgcatcgagtccgcttgatacatgaatccgtgtgtgcttgggacggtgcccgcttgtcgactgacttggccgacggacgccggacctgatgacgcagccgtagacaccagctccgaaatcaccaccaaggacttaaaggagaagaaggaagttgtggaagaggcagaaaatggaagagacgcccctgctaacgggaatgctaatgaggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactagacagcaaaaaaggaaaagttaaactaaaaaaaaaaaggccgccgtgacctattcaccctccacttcccgtctcagaatctaaacgtggtcaccttcgagtagagaggcccgcccgcccaccgtgggcagtgccacccgcagatgacacgcgctctccaccacccaacccaaaccatgagaatttgcaacaggggaggaaaaaagaaccaaaacttccaaggccctgctttttttcttaaaagtactttaaaaaggaa

SEQ ID NO: 172040 - DNA, 1221 bp, Homo sapiens
  Payload ID: 13798
  Gene Symbol: PTMA
  Gene Name: prothymosin, alpha
  Uniprot ID: P06454
  ENST ID: ENST00000409115
  CDS Start-End: 199-531
ctggcgccgcgtgagtcccccactggctgctctgaaaagccatctttgcattgttcctcatccgcctccttgctcgccgcagccgcctccgccgcgcgcctcctccgccgccgcggactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaagaggcagaaaatggaagagacgcccctgctaacgggaatgctaatgaggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactagacagcaaaaaaggaaaagttaaactaaaaaaaaaaaggccgccgtgacctattcaccctccacttcccgtctcagaatctaaacgtggtcaccttcgagtagagaggcccgcccgcccaccgtgggcagtgccacccgcagatgacacgcgctctccaccacccaacccaaaccatgagaatttgcaacaggggaggaaaaaagaaccaaaacttccaaggccctgctttttttcttaaaagtactttaaaaaggaaatttgtttgtattttttatttacattttatatttttgtacatattgttagggtcagccatttttaatgatctcggatgaccaaaccagccttcggagcgttctctgtcctacttctgactttacttgtggtgtgaccatgttcattataatctcaaaggagaaaaaaaaccttgtaaaaaaagcaaaaatgacaacagaaaaacaatcttattccgagcattccagtaacttttttgtgtatgtacttagctgtactataagtagttggtttgtatgagatggttaaaaaggccaaagataaaaggtttctttttttttccttttttgtctatgaagttgctgtttattttttttggcctgtttgatgtatgtgtgaaacaatgttgtccaacaataaacaggaattttattttgctgagttgttctaacaaa

SEQ ID NO: 172041 - DNA, 814 bp, Homo sapiens
  Payload ID: 13798
  Gene Symbol: PTMA
  Gene Name: prothymosin, alpha
  ENST ID: ENST00000410064
  CDS Start-End: 399-809
agactgactggctctttcttaatatttcggccctcgtccgcgcccgtcgtgcccctgcagggattggcgcgagtcaccttggcgtctccttaacccttgtgtccctggcgtcatctctgactctcccaggggcgacttcttggcagagcggagctcggggcccggatctccacaggggctctcagtgaccccttctggactcagtccgggaatgagtttgtggggtgagaacaccgtccccagtgcggggcctggctgttcgattttctccgaagcaccaaaaggtgacttcccgcgagggcgatgagtagtagcccgagaggcgcatccccgacagtctcggacctacgcagcccggtggactttggggcgacctcccgtgggacttggcccgccgaatgcagacattcgggcctgccggggtggcggcagtggggcgtcgagtcgagagcccggccgaccgacgcgcgacccgcgcgcgtgccactgcaagctctgcctgccggccgggagtctccaaggacttaaaggagaagaaggaagttgtggaagaggcagaaaatggaagagacgcccctgctaacgggaatgctaatgaggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactagacagc

SEQ ID NO: 172042 - DNA, 222 bp, Homo sapiens
  Payload ID: 13798
  Gene Symbol: PTMA
  Gene Name: prothymosin, alpha
  ENST ID: ENST00000440384
  CDS Start-End: 1-222
ggggcgggccggactgagagggccgacaggtggcccggagccgctcgccggacagcggccgaggggttcccgcaggcccggacgccggacctctgttggtattggtggccgtgtcgtgtggaaaaagttaccgggcgcccggggccgcgctgccttttggatcccgggcggagtcccacccccgaggacttaaaggagaagaaggaagttgtggaagaggca

SEQ ID NO: 172043 - DNA, 1108 bp, Homo sapiens
  Payload ID: 13798
  Gene Symbol: PTMA
  Gene Name: prothymosin, alpha
  ENST ID: ENST00000448874
  CDS Start-End: 137-268
gtcgcgacggcagtgaccgctcgggacagaccctaactagaaacctagaatgaggggaccgctatgccgtgcggggcccgcgggctgtcccactcgagggctggagccggcatcgcgcatcgagtccgcttgatacatgaatccgtgtgtgcttgggacggtgcccgcttgtcgactgacttggccgacggacgccggacctgatggacttaaaggagaagaaggaagttgtggaagaggcagaaaatggaagagacgcccctgctaacgggaatgctaatgaggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactagacagcaaaaaaggaaaagttaaactaaaaaaaaaaaggccgccgtgacctattcaccctccacttcccgtctcagaatctaaacgtggtcaccttcgagtagagaggcccgcccgcccaccgtgggcagtgccacccgcagatgacacgcgctctccaccacccaacccaaaccatgagaatttgcaacaggggaggaaaaaagaaccaaaacttccaaggccctgctttttttcttaaaagtactttaaaaaggaaatttgtttgtattttttatttacattttatatttttgtacatattgttagggtcagccatttttaatgatctcggatgaccaaaccagccttcggagcgttctctgtcctacttctgactttacttgtggtgtgaccatgttcattataatctcaaaggagaaaaaaaaccttgtaaaaaaagcaaaaatgacaacagaaaaacaatcttattccgagcattccagtaacttttttgtgtatgtacttagctgtactataagtagttggtttgtatgagatggttaaaaaggccaaagataaaaggtttctttttttttccttttttgtctatgaagttgctgtttattttttttgg

SEQ ID NO: 172044 - DNA, 863 bp, Homo sapiens
  Payload ID: 13798
  Gene Symbol: PTMA
  Gene Name: prothymosin, alpha
  ENST ID: ENST00000412128
  CDS Start-End: 1-446
gctccccggggcttcggccgccagggggcgagagcgggcggagccggggtccgcggagcggagcggggcgggccggactgagagggccgacaggtggcccggagccgctcgccggacagcggccgaggggttcccgcaggcccggacgccggacctctgacttaaaggagaagaaggaagttgtggaagaggcagaaaatggaagagacgcccctgctaacgggaatgctaatgaggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactagacagcaaaaaaggaaaagttaaactaaaaaaaaaaaggccgccgtgacctattcaccctccacttcccgtctcagaatctaaacgtggtcaccttcgagtagagaggcccgcccgcccaccgtgggcagtgccacccgcagatgacacgcgctctccaccacccaacccaaaccatgagaatttgcaacaggggaggaaaaaagaaccaaaacttccaaggccctgctttttttcttaaaagtactttaaaaaggaaatttgtttgtattttttatttacattttatatttttgtacatattgttagggtcagccatttttaatgatctcggatgaccaaaccagccttcggagcgttctctgtcctacttctgactttacttgtggtgtgaccatgttcattataatctcaaagga

SEQ ID NO: 172045 - DNA, 1096 bp, Homo sapiens
  Payload ID: 13798
  Gene Symbol: PTMA
  Gene Name: prothymosin, alpha
  ENST ID: ENST00000612829
  CDS Start-End: 1-408
atgcagacattcgggcctgccggggtggcggcagtggggcgtcgagtcgagagcccggccgaccgacgcgcgacccgcgcgcgtgcctgcaagctctgcctgccggccgggagtctccaaggacttaaaggagaagaaggaagtgtggaagaggcagaaaatggaagagacgcccctgctaacgggaatgctaatgaggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactagacagcaaaaaaggaaaagttaaactaaaaaaaaaaaggccgccgtgacctattcaccctccacttcccgtctcagaatctaaacgtggtcaccttcgagtagagaggcccgcccgcccaccgtgggcagtgccacccgcagatgacacgcgctctccaccacccaacccaaaccatgagaatttgcaacaggggaggaaaaaagaaccaaaacttccaaggccctgctttttttcttaaaagtactttaaaaaggaaatttgtttgtattttttatttacattttatatttttgtacatattgttagggtcagccatttttaatgatctcggatgaccaaaccagccttcggagcgttctctgtcctacttctgactttacttgtggtgtgaccatgttcattataatctcaaaggagaaaaaaaaccttgtaaaaaaagcaaaaatgacaacagaaaaacaatcttattccgagcattccagtaacttttttgtgtatgtacttagctgtactataagtagttggtttgtatgagatggttaaaaaggccaaagataaaaggtttctttttttttccttttttgtctatgaagttgctgtttattttttttggcctgtttgatgtatgtgtgaaacaatgttgtccaacaataaacaggaattttattttgctgagttgttctaaca

SEQ ID NO: 172046 - DNA, 4793 bp, Homo sapiens
  Payload ID: 13799
  Gene Symbol: PCDH1
  Gene Name: protocadherin 1
  Uniprot ID: Q08174
  ENST ID: ENST00000287008
  CDS Start-End: 149-3862
acacactcggggagcgggagcgcggcgcggacgcaaagccgccgggctgctgcgcccagagccagccggagccggagccggagcccgaactgcagctccagccccagccgtgcggagccgcagcccaggccggggccggcggcggctcatggacagcggggcgggcggccggcgctgcccggaggcggccctcctgattctggggcctcccaggatggagcacctgaggcacagcccaggccctggggggcaacggctactgctgccctccatgctgctagcactgctgctcctgctggctccatccccaggccacgccactcgggtagtgtacaaggtgccggaggaacagccacccaacaccctcattgggagcctcgcagccgactatggttttccagatgtggggcacctgtacaagctagaggtgggtgccccgtaccttcgcgtggatggcaagacaggtgacattttcaccaccgagacctccatcgaccgtgaggggctccgtgaatgccagaaccagctccctggtgatccctgcatcctggagtttgaggtatctatcacagacctcgtgcagaatggcagcccccggctgctagagggccagatagaagtacaagacatcaatgacaacacacccaacttcgcctcaccagtcatcactctggccatccctgagaacaccaacatcggctcactcttccccatcccgctggcttcagaccgtgatgctggtcccaacggtgtggcatcctatgagctgcaggctgggcctgaggcccaggagctatttgggctgcaggtggcagaggaccaggaggagaagcaaccacagctcattgtgatgggcaacctggaccgtgagcgctgggactcctatgacctcaccatcaaggtgcaggatggcggcagccccccacgcgccagcagtgccctgctgcgtgtcaccgtgcttgacaccaatgacaacgcccccaagtttgagcggccctcctatgaggccgaactatctgagaatagccccataggccactcggtcatccaggtgaaggccaatgactcagaccaaggtgccaatgcagaaatcgaatacacattccaccaggcgcccgaagttgtgaggcgtcttcttcgactggacaggaacactggacttatcactgttcagggcccggtggaccgtgaggacctaagcaccctgcgcttctcagtgcttgctaaggaccgaggcaccaaccccaagagtgcccgtgcccaggtggttgtgaccgtgaaggacatgaatgacaatgcccccaccattgagatccggggcatagggctagtgactcatcaagatgggatggctaacatctcagaggatgtggcagaggagacagctgtggccctggtgcaggtgtctgaccgagatgagggagagaatgcagctgtcacctgtgtggtggcaggtgatgtgcccttccagctgcgccaggccagtgagacaggcagtgacagcaagaagaagtatttcctgcagactaccaccccgctagactacgagaaggtcaaagactacaccattgagattgtggctgtggactctggcaaccccccactctccagcactaactccctcaaggtgcaggtggtggacgtcaatgacaacgcacctgtcttcactcagagtgtcactgaggtcgccttcccggaaaacaacaagcctggtgaagtgattgctgagatcactgccagtgatgctgactctggctctaatgctgagctggtttactctctggagcctgagccggctgctaagggcctcttcaccatctcacccgagactggagagatccaggtgaagacatctctggatcgggaacagcgggagagctatgagttgaaggtggtggcagctgaccggggcagtcctagcctccagggcacagccactgtccttgtcaatgtgctggactgcaatgacaatgaccccaaatttatgctgagtggctacaacttctcagtgatggagaacatgccagcactgagtccagtgggcatggtgactgtcattgatggagacaagggggagaatgcccaggtgcagctctcagtggagcaggacaacggtgactttgttatccagaatggcacaggcaccatcctatccagcctgagctttgatcgagagcaacaaagcacctacaccttccagctgaaggcagtggatggtggcgtcccacctcgctcagcttacgttggtgtcaccatcaatgtgctggacgagaatgacaacgcaccctatatcactgccccttctaacacctctcacaagctgctgaccccccagacacgtcttggtgagacggtcagccaggtggcagccgaggactttgactctggtgtcaatgctgagctgatctacagcattgcaggtggcaacccttatggactcttccagattgggtcacattcaggtgccatcaccctggagaaggagattgagcggcgccaccatgggctacaccgcctggtggtgaaggtcagtgaccgcggcaagcccccacgctatggcacagccttggtccatctttatgtcaatgagactctggccaaccgcacgctgctggagaccctcctgggccacagcctggacacgccgctggatattgacattgctggggatccagaatatgagcgctccaagcagcgtggcaacattctctttggtgtggtggctggtgtggtggccgtggccttgctcatcgccctggcggttcttgtgcgctactgcagacagcgggaggccaaaagtggttaccaggctggtaagaaggagaccaaggacctgtatgcccccaagcccagtggcaaggcctccaagggaaacaaaagcaaaggcaagaagagcaagtccccaaagcccgtgaagccagtggaggacgaggatgaggccgggctgcagaagtccctcaagttcaacctgatgagcgatgcccctggggacagtccccgcatccacctgcccctcaactacccaccaggcagccctgacctgggccgccactatcgctctaactccccactgccttccatccagctgcagccccagtcaccctcagcctccaagaagcaccaggtggtacaggacctgccacctgcaaacacattcgtgggcaccggggacaccacgtccacgggctctgagcagtactccgactacagctaccgcaccaacccccccaaataccccagcaagcagttacctcaccgccgcgtcaccttctcggccaccagccaggcccaggagctgcaggacccatcccagcacagttactatgacagtggcctggaggagtctgagacgccgtccagcaagtcatcctcagggcctcgactcggtcccctggccctgcctgaggatcactatgagcgcaccacccctgatggcagcataggagagatggagcaccccgagaatgaccttcgccctttgcctgatgtcgccatgacaggcacatgtacccgggagtgcagtgagtttggccactctgacacatgctggatgcctggccagtcatctcccagccgccggaccaagagcagcgccctcaaactctccaccttcgtgccttaccaggaccgaggagggcaggagcctgcgggcgccggcagccccagccccccggaagaccggaacaccaaaacggcccccgtgcgcctcctgccctcctacagtgccttctcccacagtagccatgattcctgcaaggactcggccaccttggaggaaatccccctgacccagacctcggacttcccacccgcagccacaccggcatctgcccagacggccaagcgcgagatctacctgtgagccccctactggccggccggcccccctcccccagccgccggccagctcccaaatggcccattccagggcctcactctccaccccttcagcgtggacttcctggccagggccccaagtgggggtatcactgacctcatgaccacgctggcccttctcccatgcagggtccaggtcctctcccctcatttccatctcccagcccccaggggccccttcccctttatggggcttcccccatctgatgcccaagagggctcctctgcaatgactgggctccttcccttgacttccagggagcaccccctcgatttgggcagatggtggagtcaagggtgggcagcgtacttctaactcattgtttccctcatggccgaccagggcggggatagcatgcccaattttagccctgaagcagggctgaactggggagcccctttccctgggagctcccagaggaaactcttgaccaccagtggctccctgaagggcttttgttaccaaaggtggggtagggacgggggtgggagtggagcggaggccttgttttcccgtgctgctcctggactggcccacctgcctgccacatgcccacgcctagtcccatctgggcccccattccctgctggtcatgcagtgtctgtatataaggaccttggaatgacgtccccatttctgcctgatttgcaacttttcttgttgatgtcgtgttgtcttgggggacccctctggggggggacctgccctgtgccccctcctccctgccgcagtgccccccaacccaggcctctattgttccatgttgtaaatacccctggggccatggtgggatgggggtgcaggccagggaaacaacgggtgggtgggggtggggacgggggtaacatttgcctatcagcagagctgggcttttatttaatttttcttaaaaata

SEQ ID NO: 172047 - DNA, 3827 bp, Homo sapiens
  Payload ID: 13799
  Gene Symbol: PCDH1
  Gene Name: protocadherin 1
  Uniprot ID: Q08174
  ENST ID: ENST00000394536
  CDS Start-End: 149-3331
acacactcggggagcgggagcgcggcgcggacgcaaagccgccgggctgctgcgcccagagccagccggagccggagccggagcccgaactgcagctccagccccagccgtgcggagccgcagcccaggccggggccggcggcggctcatggacagcggggcgggcggccggcgctgcccggaggcggccctcctgattctggggcctcccaggatggagcacctgaggcacagcccaggccctggggggcaacggctactgctgccctccatgctgctagcactgctgctcctgctggctccatccccaggccacgccactcgggtagtgtacaaggtgccggaggaacagccacccaacaccctcattgggagcctcgcagccgactatggttttccagatgtggggcacctgtacaagctagaggtgggtgccccgtaccttcgcgtggatggcaagacaggtgacattttcaccaccgagacctccatcgaccgtgaggggctccgtgaatgccagaaccagctccctggtgatccctgcatcctggagtttgaggtatctatcacagacctcgtgcagaatggcagcccccggctgctagagggccagatagaagtacaagacatcaatgacaacacacccaacttcgcctcaccagtcatcactctggccatccctgagaacaccaacatcggctcactcttccccatcccgctggcttcagaccgtgatgctggtcccaacggtgtggcatcctatgagctgcaggctgggcctgaggcccaggagctatttgggctgcaggtggcagaggaccaggaggagaagcaaccacagctcattgtgatgggcaacctggaccgtgagcgctgggactcctatgacctcaccatcaaggtgcaggatggcggcagccccccacgcgccagcagtgccctgctgcgtgtcaccgtgcttgacaccaatgacaacgcccccaagtttgagcggccctcctatgaggccgaactatctgagaatagccccataggccactcggtcatccaggtgaaggccaatgactcagaccaaggtgccaatgcagaaatcgaatacacattccaccaggcgcccgaagttgtgaggcgtcttcttcgactggacaggaacactggacttatcactgttcagggcccggtggaccgtgaggacctaagcaccctgcgcttctcagtgcttgctaaggaccgaggcaccaaccccaagagtgcccgtgcccaggtggttgtgaccgtgaaggacatgaatgacaatgcccccaccattgagatccggggcatagggctagtgactcatcaagatgggatggctaacatctcagaggatgtggcagaggagacagctgtggccctggtgcaggtgtctgaccgagatgagggagagaatgcagctgtcacctgtgtggtggcaggtgatgtgcccttccagctgcgccaggccagtgagacaggcagtgacagcaagaagaagtatttcctgcagactaccaccccgctagactacgagaaggtcaaagactacaccattgagattgtggctgtggactctggcaaccccccactctccagcactaactccctcaaggtgcaggtggtggacgtcaatgacaacgcacctgtcttcactcagagtgtcactgaggtcgccttcccggaaaacaacaagcctggtgaagtgattgctgagatcactgccagtgatgctgactctggctctaatgctgagctggtttactctctggagcctgagccggctgctaagggcctcttcaccatctcacccgagactggagagatccaggtgaagacatctctggatcgggaacagcgggagagctatgagttgaaggtggtggcagctgaccggggcagtcctagcctccagggcacagccactgtccttgtcaatgtgctggactgcaatgacaatgaccccaaatttatgctgagtggctacaacttctcagtgatggagaacatgccagcactgagtccagtgggcatggtgactgtcattgatggagacaagggggagaatgcccaggtgcagctctcagtggagcaggacaacggtgactttgttatccagaatggcacaggcaccatcctatccagcctgagctttgatcgagagcaacaaagcacctacaccttccagctgaaggcagtggatggtggcgtcccacctcgctcagcttacgttggtgtcaccatcaatgtgctggacgagaatgacaacgcaccctatatcactgccccttctaacacctctcacaagctgctgaccccccagacacgtcttggtgagacggtcagccaggtggcagccgaggactttgactctggtgtcaatgctgagctgatctacagcattgcaggtggcaacccttatggactcttccagattgggtcacattcaggtgccatcaccctggagaaggagattgagcggcgccaccatgggctacaccgcctggtggtgaaggtcagtgaccgcggcaagcccccacgctatggcacagccttggtccatctttatgtcaatgagactctggccaaccgcacgctgctggagaccctcctgggccacagcctggacacgccgctggatattgacattgctggggatccagaatatgagcgctccaagcagcgtggcaacattctctttggtgtggtggctggtgtggtggccgtggccttgctcatcgccctggcggttcttgtgcgctactgcagacagcgggaggccaaaagtggttaccaggctggtaagaaggagaccaaggacctgtatgcccccaagcccagtggcaaggcctccaagggaaacaaaagcaaaggcaagaagagcaagtccccaaagcccgtgaagccagtggaggacgaggatgaggccgggctgcagaagtccctcaagttcaacctgatgagcgatgcccctggggacagtccccgcatccacctgcccctcaactacccaccaggcagccctgacctgggccgccactatcgctctaactccccactgccttccatccagctgcagccccagtcaccctcagcctccaagaagcaccaggtggtacaggacctgccacctgcaaacacattcgtgggcaccggggacaccacgtccacgggctctgagcagtactccgactacagctaccgcaccaacccccccaaataccccagcaagcaggtaggccagccctttcagctcagcacaccccagcccctaccccacccctaccacggagccatctggaccgaggtgtgggagtgatggagcaggtttactgtgcctgcccgtgttgggggccagcctgagccagcagtgggaggtggggccttagtgcctcaccgggcacacggattaggctgagtgaagattaagggagggtgtgctctgtggtctcctccctgccctctccccactggggagagacctgtgatttgccaagtccctggaccctggaccagctactgggccttatgggttgggggtggtaggcaggtgagcgtaagtggggagggaaatgggtaagaagtctactccaaacctaggtctctatgtcagaccagacctaggtgcttctctaggagggaaacagggagacctggggtcctgtggataactgagtggggagtctgccaggggagggcaccttcccattgtgccttctgtgtgtattgtgcattaacctcttcctcaccactaggcttctggggctgggtcccacatgcccttgaccctgacaataaagttctctatttttgga

SEQ ID NO: 172048 - DNA, 825 bp, Homo sapiens
  Payload ID: 13799
  Gene Symbol: PCDH1
  Gene Name: protocadherin 1
  ENST ID: ENST00000505937
  CDS Start-End: 1-380
ctggtcccaacggtgtggcatcctatgagctgcaggctgggcctgaggcccaggagctatttgggctgcaggtggcagaggaccaggaggagaagcaaccacagctcattgtgatgggcaacctggaccgtgagcgctgggactcctatgacctcaccatcaaggtgcaggatggcggcagccccccacgcgccagcagtgccctgctgcgtgtcaccgtgcttgacaccaatgacaacgcccccaagtttgagcggccctcctatgaggccgaactatctgagaatagccccataggccactcggtcatccagagcctggtggactgggacctggaaaagagactgagaaagaaaagggagacagacagtcggggatagcaaataataatagcctaggtgccaggcaccgttctaaacacatgatgtgtattatatcatttaatccttacagtacaaggtgaaggccaatgactcagaccaaggtgccaatgcagaaatcgaatacacattccaccaggcgcccgaagttgtgaggcgtcttcttcgactggacaggaacactggacttatcactgttcagggcccggtggaccgtgaggacctaagcaccctgcgcttctcagtgcttgctaaggaccgaggcaccaaccccaagagtgcccgtgcccaggtggttgtgaccgtgaaggacatgaatgacaatgcccccaccattgagatccggggcatagggctagtgactcatcaagatgggatggctaacatctcagaggatgtggcagaggagacagctgtggccctggtgcaggtgtctgaccgagat

SEQ ID NO: 172049 - DNA, 553 bp, Homo sapiens
  Payload ID: 13799
  Gene Symbol: PCDH1
  Gene Name: protocadherin 1
  ENST ID: ENST00000514773
  CDS Start-End: 102-553
ggcactgcgagggcgtgtgacacaggccgtgacactgcgcggcctcgcggggcagggacccggtgactgtataatccctcctgattctggggcctcccaggatggagcacctgaggcacagcccaggccctggggggcaacggctactgctgccctccatgctgctagcactgctgctcctgctggctccatccccaggccacgccactcgggtagtgtacaaggtgccggaggaacagccacccaacaccctcattgggagcctcgcagccgactatggttttccagatgtggggcacctgtacaagctagaggtgggtgccccgtaccttcgcgtggatggcaagacaggtgacattttcaccaccgagacctccatcgaccgtgaggggctccgtgaatgccagaaccagctccctggtgatccctgcatcctggagtttgaggtatctatcacagacctcgtgcagaatggcagcccccggctgctagagggccagatagaagtacaagacatcaatgacaacacacccaacttcgcctcaccagtcat

SEQ ID NO: 172050 - DNA, 2489 bp, Homo sapiens
  Payload ID: 13799
  Gene Symbol: PCDH1
  Gene Name: protocadherin 1
  ENST ID: ENST00000515351
  CDS Start-End: 1-52
catccaggtgagaggccccctccgtataactgtcagggtgacccaccactagaaatgggagcccacccaaccaggtgaaggccaatgactcagaccaaggtgccaatgcagaaatcgaatacacattccaccaggcgcccgaagttgtgaggcgtcttcttcgactggacaggaacactggacttatcactgttcagggcccggtggaccgtgaggacctaagcaccctgcgcttctcagtgcttgctaaggaccgaggcaccaaccccaagagtgcccgtgcccaggtggttgtgaccgtgaaggacatgaatgacaatgcccccaccattgagatccggggcatagggctagtgactcatcaagatgggatggctaacatctcagaggatgtggcagaggagacagctgtggccctggtgcaggtgtctgaccgagatgagggagagaatgcagctgtcacctgtgtggtggcaggtgatgtgcccttccagctgcgccaggccagtgagacaggcagtgacagcaagaagaagtatttcctgcagactaccaccccgctagactacgagaaggtcaaagactacaccattgagattgtggctgtggactctggcaaccccccactctccagcactaactccctcaaggtgcaggtggtggacgtcaatgacaacgcacctgtcttcactcagagtgtcactgaggtcgccttcccggaaaacaacaagcctggtgaagtgattgctgagatcactgccagtgatgctgactctggctctaatgctgagctggtttactctctggagcctgagccggctgctaagggcctcttcaccatctcacccgagactggagagatccaggtgaagacatctctggatcgggaacagcgggagagctatgagttgaaggtggtggcagctgaccggggcagtcctagcctccagggcacagccactgtccttgtcaatgtgctggactgcaatgacaatgaccccaaatttatgctgagtggctacaacttctcagtgatggagaacatgccagcactgagtccagtgggcatggtgactgtcattgatggagacaagggggagaatgcccaggtgcagctctcagtggagcaggacaacggtgactttgttatccagaatggcacaggcaccatcctatccagcctgagctttgatcgagagcaacaaagcacctacaccttccagctgaaggcagtggatggtggcgtcccacctcgctcagcttacgttggtgtcaccatcaatgtgctggacgagaatgacaacgcaccctatatcactgccccttctaacacctctcacaagctgctgaccccccagacacgtcttggtgagacggtcagccaggtggcagccgaggactttgactctggtgtcaatgctgagctgatctacagcattgcaggtggcaacccttatggactcttccagattgggtcacattcaggtgccatcaccctggagaaggagattgagcggcgccaccatgggctacaccgcctggtggtgaaggtcagtgaccgcggcaagcccccacgctatggcacagccttggtccatctttatgtcaatgagactctggccaaccgcacgctgctggagaccctcctgggccacagcctggacacgccgctggatattgacattgctggggatccagaatatgagcgctccaagcagcgtggcaacattctctttggtgtggtggctggtgtggtggccgtggccttgctcatcgccctggcggttcttgtgcgctactgcagacagcgggaggccaaaagtggttaccaggctggtaagaaggagaccaaggacctgtatgcccccaagcccagtggcaaggcctccaagggaaacaaaagcaaaggcaagaagagcaagtccccaaagcccgtgaagccagtggaggacgaggatgaggccgggctgcagaagtccctcaagttcaacctgatgagcgatgcccctggggacagtccccgcatccacctgcccctcaactacccaccaggcagccctgacctgggccgccactatcgctctaactccccactgccttccatccagctgcagccccagtcaccctcagcctccaagaagcaccaggtggtacaggacctgccacctgcaaacacattcgtgggcaccggggacaccacgtccacgggctctgagcagtactccgactacagctaccgcaccaacccccccaaataccccagcaagcaggtaggccagccctttcagctcagcacaccccagcccctaccccacccctaccacggagccatctggaccgaggtgtgggagtgatggagcaggtttactgtgcctgcccgtgttgggggccagcctgagccagcagtgggaggtggggccttagtgcctcaccgggcacacggattaggctgagtgaagattaagggagggtgtgctctgtggtctcct

SEQ ID NO: 172051 - DNA, 2373 bp, Homo sapiens
  Payload ID: 13799
  Gene Symbol: PCDH1
  Gene Name: protocadherin 1
  ENST ID: ENST00000503492
  CDS Start-End: 148-1296
cacactcggggagcgggagcgcggcgcggacgcaaagccgccgggctgctgcgcccagagccagccggagccggagccggagcccgaactgcagctccagccccagccgtgcggagccgcagcccaggccggggccggcggcggctcatggacagcggggcgggcggccggcgctgcccggaggcggccctcctgattctggggcctcccaggatggagcacctgaggcacagcccaggccctggggggcaacggctactgctgccctccatgctgctagcactgctgctcctgctggctccatccccaggccacgccactcgggtagtgtacaaggtgccggaggaacagccacccaacaccctcattgggagcctcgcagccgactatggttttccagatgtggggcacctgtacaagctagaggtgggtgccccgtaccttcgcgtggatggcaagacaggtgacattttcaccaccgagacctccatcgaccgtgaggggctccgtgaatgccagaaccagctccctggtgatccctgcatcctggagtttgaggtatctatcacagacctcgtgcagaatggcagcccccggctgctagagggccagatagaagtacaagacatcaatgacaacacacccaacttcgcctcaccagtcatcactctggccatccctgagaacaccaacatcggctcactcttccccatcccgctggcttcagaccgtgatgctggtcccaacggtgtggcatcctatgagctgcaggctgggcctgaggcccaggagctatttgggctgcaggtggcagaggaccaggaggagaagcaaccacagctcattgtgatgggcaacctggaccgtgagcgctgggactcctatgacctcaccatcaaggtgcaggatggcggcagccccccacgcgccagcagtgccctgctgcgtgtcaccgtgcttgacaccaatgacaacgcccccaagtttgagcggccctcctatgaggccgaactatctgagaatagccccataggccactcggtcatccagttacctcaccgccgcgtcaccttctcggccaccagccaggcccaggagctgcaggacccatcccagcacagttactatgacagtggcctggaggagtctgagacgccgtccagcaagtcatcctcagggcctcgactcggtcccctggccctgcctgaggatcactatgagcgcaccacccctgatggcagcataggagagatggagcaccccgagaatgagccggctggccggagcaggccctgaggcagagtgccagaccttcgccctttgcctgatgtcgccatgacaggcacatgtacccgggagtgcagtgagtttggccactctgacacatgctggatgcctggccagtcatctcccagccgccggaccaagagcagcgccctcaaactctccaccttcgtgccttaccaggaccgaggagggcaggagcctgcgggcgccggcagccccagccccccggaagaccggaacaccaaaacggcccccgtgcgcctcctgccctcctacagtgccttctcccacagtagccatgattcctgcaaggactcggccaccttggaggaaatccccctgacccagacctcggacttcccacccgcagccacaccggcatctgcccagacggccaagcgcgagatctacctgtgagccccctactggccggccggcccccctcccccagccgccggccagctcccaaatggcccattccagggcctcactctccaccccttcagcgtggacttcctggccagggccccaagtgggggtatcactgacctcatgaccacgctggcccttctcccatgcagggtccaggtcctctcccctcatttccatctcccagcccccaggggccccttcccctttatggggcttcccccatctgatgcccaagagggctcctctgcaatgactgggctccttcccttgacttccagggagcaccccctcgatttgggcagatggtggagtcaagggtgggcagcgtacttctaactcattgtttccctcatggccgaccagggcggggatagcatgcccaattttagccctgaagcagggctgaactggggagcccctttccctgggagctcccagaggaaactcttgaccaccagtggctccctgaagggcttttgttaccaaaggtggggtagggacgggggtgggagtggagcggaggccttgttttcccgtgctgctcctggactggcccacctgcctgccacatgcccacgcctagtcccatctgggcccccattccctgctggtcatgcagtgtctgtatataaggaccttggaatgacgtcccca

SEQ ID NO: 172052 - DNA, 8489 bp, Homo sapiens
  Payload ID: 13800
  Gene Symbol: PCDH10
  Gene Name: protocadherin 10
  Uniprot ID: Q9P2E7
  ENST ID: ENST00000264360
  CDS Start-End: 827-3949
caggctcagaggctgaagcaggaggaaggaaggactggaaggaaaaagagacaggttagagggaaagaggcttgggaagaaaacagcagaaaagaaactgctcattacacttacagagaggcaagtaacggtggagatgaggacagagggaaccaagactctgaaagacaaaaaatacaaatagagcgaaagaggaaaaaaatgtcaagaagaacatccatccggagaaatgaagagaatgaaagttttaagctgcagagccgttctgtgcttttccggcacaaaattatatcgctgattttaagcccttttgcatttgccagccgttgacattaagaggcatgtttaacggtgccaacagcatctccttttccttctcctcttcctcttcttcttcttcctcctcctcctcctctttttcctcctcctcgttctcctcccatcagcaagaagacaaaccgaggacagtcttgaaatatcgaaatttcctctttgggatttgccagcgccaagactgtcggaataaaggacgctgactattgtattattgttattttattaattagtcagtggaaagattacagatgaggaaaggggacgcctgtcacccttcctgtgctaagatttaaaaaaaaatgaggctggattgcgggaagctctaaaatgaagcaaaaggagtaagatttttaaagacagaaagccacaggagcccccacgtagcgcacttttatttgtattttttcagatttttttttgtttcgtggtggtgggggaggtgattgggtggctgactggctgcgggaagctacttcctttccttttggagatgattgtgctattattgtttgccttgctctggatggtggaaggagtcttttcccagcttcactacacggtacaggaggagcaggaacatggcactttcgtggggaatatcgctgaagatctgggtctggacattacaaaactttcggctcgcgggtttcagacggtgcccaactcaaggaccccttacttagacctcaacctggagacaggggtgctgtacgtgaacgagaaaatagaccgcgaacaaatctgcaaacagagcccctcctgtgtcctgcacctggaggtctttctggagaaccccctggagctgttccaggtggagatcgaggtgctggacattaatgacaaccccccctctttcccggagccagacctgacggtggaaatctctgagagcgccacgccaggcactcgcttccccttggagagcgcattcgacccagacgtgggcaccaactccttgcgcgactacgagatcacccccaacagctacttctccctggacgtgcagacccagggggatggcaaccgattcgctgagctggtgctggagaagccactggaccgagagcagcaagcggtgcaccgctacgtgctgaccgcggtggacggaggaggtgggggaggagtaggagaaggagggggaggtggcgggggagcaggcctgcccccccagcagcagcgcaccggcacggccctactcaccatccgagtgctggactccaatgacaatgtgcccgctttcgaccaacccgtctacactgtgtccctaccagagaactctcccccaggcactctcgtgatccagctcaacgccaccgacccggacgagggccagaacggtgaggtcgtgtactccttcagcagccacatttcgccccgggcgcgggagcttttcggactctcgccgcgcactggcagactggaggtaagcggcgagttggactatgaagagagcccagtgtaccaagtgtacgtgcaagccaaggacctgggccccaacgccgtgcctgcgcactgcaaggtgctagtgcgagtactggatgctaatgacaacgcgccagagatcagcttcagcaccgtgaaggaagcggtgagtgagggcgcggcgcccggcactgtggtggcccttttcagcgtgactgaccgcgactcagaggagaatgggcaggtgcagtgcgagctactgggagacgtgcctttccgcctcaagtcttcctttaagaattactacaccatcgttaccgaagcccccctggaccgagaggcgggggactcctacaccctgactgtagtggctcgggaccggggcgagcctgcgctctccaccagtaagtcgatccaggtacaagtgtcggatgtgaacgacaacgcgccgcgtttcagccagccggtctacgacgtgtatgtgactgaaaacaacgtgcctggcgcctacatctacgcggtgagcgccaccgaccgggatgagggcgccaacgcccagcttgcctactctatcctcgagtgccagatccagggcatgagcgtcttcacctacgtttctatcaactctgagaacggctacttgtacgccctgcgctccttcgactatgagcagctgaaggacttcagttttcaggtggaagcccgggacgctggcagcccccaggcgctggctggtaacgccactgtcaacatcctcatagtggatcaaaatgacaacgcccctgccatcgtggcgcctctaccagggcgcaacgggactccagcgcgtgaggtgctgccccgctcggcggagccgggttacctgctcacccgcgtggccgccgtggacgcggacgacggcgagaacgcccggctcacttacagcatcgtgcgtggcaacgaaatgaacctctttcgcatggactggcgcaccggggagctgcgcacagcacgccgagtcccggccaagcgcgacccccagcggccttatgagctggtgatcgaggtgcgcgaccatgggcagccgcccctttcctccaccgccaccctggtggttcagctggtggatggcgccgtggagccccagggcgggggcgggagcggaggcggagggtcaggagagcaccagcgccccagtcgctctggcggcggggaaacctcgctagacctcaccctcatcctcatcatcgcgttgggctcggtgtccttcatcttcctgctggccatgatcgtgctggccgtgcgttgccaaaaagagaagaagctcaacatctatacttgtctggccagcgattgctgcctctgctgctgctgctgcggtggcggaggttcgacctgctgtggccgccaagcccgggcgcgcaagaagaaactcagcaagtcagacatcatgctggtgcagagctccaatgtacccagtaacccggcccaggtgccgatagaggagtccgggggctttggctcccaccaccacaaccagaattactgctatcaggtatgcctgacccctgagtccgccaagaccgacctgatgtttcttaagccctgcagcccttcgcggagtacggacactgagcacaacccctgcggggccatcgtcaccggttacaccgaccagcagcctgatatcatctccaacggaagcattttgtccaacgagactaaacaccagcgagcagagctcagctatctagttgacagacctcgccgagttaacagttctgcattccaggaagccgacatagtaagctctaaggacagtggtcatggagacagtgaacagggagatagtgatcatgatgccaccaaccgtgcccagtcagctggtatggatctcttctccaattgcactgaggaatgtaaagctctgggccactcagatcggtgctggatgccttcttttgtcccttctgatggacgccaggctgctgattatcgcagcaatctgcatgttcctggcatggactctgttccagacactgaggtgtttgaaactccagaagcccagcctggggcagagcggtccttttccacctttggcaaagagaaggcccttcacagcactctggagaggaaggagctggatggactgctgactaatacgcgagcgccttacaaaccaccatatttgacacggaaaaggatatgctagtcaattctacaggacttacctgaagcagcatgatttgcacaaagtcgaccaacaaaagcatcaacttttcaacttcattatcttggccatccagttagtcatgtgtaactgagtattagatttcggatggagtcatcatggccaattataggacctaattgctctcagcaggcctgagaaatgagttgaaatgtgcagaactgtagaaactttagaggcaacagattttgcctccccgatcagtgtgtgcctgtttacagcactatctatctttctctctccaaatgtcactgagccctttagatgtttatattcaccacgagaagccagtcataaagataaaggaaatttgtgcattataaatgcaatatcactgttttaaacttgactgttttatattatttttgtgtgatcaagtgttccgcaagctattccaactttacaagagaaattgtgattatgttcttttcacctgtgggttataaaaaatgttgtattctgaagacccacaaaatatcaaagacattctgtagtttatacaccgtgttgcaaagtgtttactgtactatttcaaagcttctaaataaatataaaatatatatattatattatataattttcctaaaatgtggtacaactcagttggtttttaaatggatgcatacagtccacatcatacaataaaataaaaggtaattcagggtcccaaagacaaacttactaagaaaaaatcattaatagttttctcccaatttccatatcttactcaaccgtgtttttccttgtttaaaagaaaatgatgctctaagctacaaaattttgtcaaaaactcatattgaattttcaatgccaaagatgtagctattgatgttatcagacagagcactgactatgtactatcaaactatctaacaatctgcataagtctgattctatttctatgactttgaatttagaatcacttaaagcttttataaagaatcgataaattcacctgtatttgttgttagaaaaaaactgggtgtctgtacattttgtggtgtaaaatatgtaattgaagattactattttaagaagtcatcagtcatatcactcacacagaattttattttacatagttttgtgacttaattacacatgaatataaaatctataattctatatgaatatatagagatatagaaacatctgaactggtaaagaataactataaaatatgaaagctctaaatttaaaataaatttagagatagaatcatggtacattattgtttcagtattccatgtgaaaattttatagcttaaatgtagtcagtgtttgattaatgaaaaaattcttcatgagtcagccttcaaaagttaagcttgccttttacttttatgtcaacaatattaattattaaatttagtaagacgcactttcctttcttttatatattttttctactgttgtgtatgccttgttagaacacattcgagagaggaaaaaaatcagagaatataagataatctttcaagcaaaaaacagaattgtcacagctcccctcgccctctaaactatgatatcaaaacatcatatcaaagcttcaacattatatcaaaatgtttgcccagttcaaattagaaacctgttttgaaatactttccttaatttttaactgatcttatattcaatgacagtttgagctgcactgtgttattaaagaatagactaaaacttaacatttgacaaatgttcttcatcaaattttatgtaacttaagtggaaatttttccctagatttaactttaaaatacatatatatacacacacacacacacacacacacacacacacttaggtcctgatatgtacatttagagtgatatattggtatcactcatttgactgttatcaaattagatattaatatatcatattccaatcagttcatatatcaaaataatgtatgtaatgttccagccttttgaagtctctttaaacatatatgaagctaacagatcatatgtaatacaaaaagcacataaattcactaagtgcagcagtaacattttcttaaactttggcattactacattaatattttgaatgatagactattttagtaaggaaatgtttatacataatttaactggaaaaaagtctgtttgttccaactcttttttttagcaagaaaatgattttcttgttgagtcactctgctttaattaaaatgtttcacgcatcattttgcaatcatgggtgaatatccacatccatcttccttactgcatgcattgaaaataagattatactcacttcatgtatagtaattatattgtcatttacctcaaagacattttctttaattatttaaccttttatatcattgtatataatctcctttgaaccaacttttttattatatatttgtgtattagttattttcatatatcctaggaactagttatactaacttacattttagttatcatcaatctacaaaaccaaaaccagaacttcttcctaatttgcgggacaaatagaattgtttaaggataaaatgctacattattaggtcattaatcaacttatctgttgcatccaaagtaaattagaagttacaacagagtaaggatatgattcttgtaagttggttaaaatgttttcttccaatgagggggactataaaatggaaagtgcaaccaacaaataatgaaggtttctaattaagcatttactagattaatatatcaaggaattttaggataggttttctctttaatctggtcattctaatatccaatcttacataattttatatacatcaaagaataatatccatcgtattagacagtatttcgtcaataaattatttcagaaaaaaaaatcatgtcatttactccttgttaacatggttagttttagagcagtcaaagtcaaaaaaaatttcctgtggaaacagtgtcttaatgtttcaaaggtatgtcaaaagacaatttttagaaaatatttcatccacatgtagaattctaatttttaacgtgtgaacatagtttggtgaaatcatcttaaatcaaatttaaatatcacatcagaattacttcacagatataatagcgtcaatgatatatgtatcatcttttcttggcaaatattaaggaaatatgtgtattttattttttaaagatattaaatgcactgcctttatcaaacattgcaaattaagaactatagtagaatatttaaatattttaatttctcattgttttatttgttaattggattgtaatttgccatcagattctctgtattatagaagctatcttgcttcttcaataagaggaggaaaaagaatctcacaattcccaatataatctttaacaactgtacgttaattgtaccattttaccttctaaacattatttactggagctcagttagtctttaaaacaattactcaggcagagtgtggcaaaagttcagcaagatcaagaaaagtatttaagttattgactgatcatagcactgttatttgtcattgcatgtgtttttccccctcatgtttctatgtgtgctattgatacccaaggaactcaaaaatacttaaaatattggtatacttgatgatttttctgaaaatcttatatttttcatattacaaattcttgagttctttatctttttcaagtctaattttgtagtggtaaaggctttgcacttaacatccttttgtgttcctttttaacaaggaaaaacagaaaataatggaattccatattttttacaccatggagtagtaaaattattttatatattgttagtacttcaacaaacatccctctgctaagtcagacaaaatccttatacagtaatttgtgaaactgttcagtagagtattcttttcttcaaatcttggcataggttttagattatagcattctgtatgaatgcaggtagatgggtgccgccagagtattgcaggcaataatacgactaaaattctaatacttttagtgtgcatgcgtgtatttctaatcactgttattttttaagtatttgtaaaattagaaaaattgcttttatttcttgaaaagttgtcacatgcttagtttgaagttttactctccagatgtttttgagttgcataaaaatcttgcattcatcattcaaaaaatactaaatttcacatgagactcaaaaatttctgaatgatggaactcagacttccaatacattcatacatgctagagctgaaagtaagcagggaatttcagctctaaacacatttttgagacagttatctgtgagtgaaaacagggtattataacaaaagatgagtttcaatcttaactacagtgtttgttactgtgaatgctataataatacataagtaaaatgagtgtaaatgtaataaattattttatactgctgtatacatatgaaataaataaaactaggatacatattatgccatttttccatgcatggatcttccactgacgcctgtgggagctttgaataaaaatcagtggcaaatatggctctaagtttaaaaaca

SEQ ID NO: 172053 - DNA, 4574 bp, Homo sapiens
  Payload ID: 13800
  Gene Symbol: PCDH10
  Gene Name: protocadherin 10
  Uniprot ID: Q9P2E7
  ENST ID: ENST00000618019
  CDS Start-End: 827-3517
caggctcagaggctgaagcaggaggaaggaaggactggaaggaaaaagagacaggttagagggaaagaggcttgggaagaaaacagcagaaaagaaactgctcattacacttacagagaggcaagtaacggtggagatgaggacagagggaaccaagactctgaaagacaaaaaatacaaatagagcgaaagaggaaaaaaatgtcaagaagaacatccatccggagaaatgaagagaatgaaagttttaagctgcagagccgttctgtgcttttccggcacaaaattatatcgctgattttaagcccttttgcatttgccagccgttgacattaagaggcatgtttaacggtgccaacagcatctccttttccttctcctcttcctcttcttcttcttcctcctcctcctcctctttttcctcctcctcgttctcctcccatcagcaagaagacaaaccgaggacagtcttgaaatatcgaaatttcctctttgggatttgccagcgccaagactgtcggaataaaggacgctgactattgtattattgttattttattaattagtcagtggaaagattacagatgaggaaaggggacgcctgtcacccttcctgtgctaagatttaaaaaaaaatgaggctggattgcgggaagctctaaaatgaagcaaaaggagtaagatttttaaagacagaaagccacaggagcccccacgtagcgcacttttatttgtattttttcagatttttttttgtttcgtggtggtgggggaggtgattgggtggctgactggctgcgggaagctacttcctttccttttggagatgattgtgctattattgtttgccttgctctggatggtggaaggagtcttttcccagcttcactacacggtacaggaggagcaggaacatggcactttcgtggggaatatcgctgaagatctgggtctggacattacaaaactttcggctcgcgggtttcagacggtgcccaactcaaggaccccttacttagacctcaacctggagacaggggtgctgtacgtgaacgagaaaatagaccgcgaacaaatctgcaaacagagcccctcctgtgtcctgcacctggaggtctttctggagaaccccctggagctgttccaggtggagatcgaggtgctggacattaatgacaaccccccctctttcccggagccagacctgacggtggaaatctctgagagcgccacgccaggcactcgcttccccttggagagcgcattcgacccagacgtgggcaccaactccttgcgcgactacgagatcacccccaacagctacttctccctggacgtgcagacccagggggatggcaaccgattcgctgagctggtgctggagaagccactggaccgagagcagcaagcggtgcaccgctacgtgctgaccgcggtggacggaggaggtgggggaggagtaggagaaggagggggaggtggcgggggagcaggcctgcccccccagcagcagcgcaccggcacggccctactcaccatccgagtgctggactccaatgacaatgtgcccgctttcgaccaacccgtctacactgtgtccctaccagagaactctcccccaggcactctcgtgatccagctcaacgccaccgacccggacgagggccagaacggtgaggtcgtgtactccttcagcagccacatttcgccccgggcgcgggagcttttcggactctcgccgcgcactggcagactggaggtaagcggcgagttggactatgaagagagcccagtgtaccaagtgtacgtgcaagccaaggacctgggccccaacgccgtgcctgcgcactgcaaggtgctagtgcgagtactggatgctaatgacaacgcgccagagatcagcttcagcaccgtgaaggaagcggtgagtgagggcgcggcgcccggcactgtggtggcccttttcagcgtgactgaccgcgactcagaggagaatgggcaggtgcagtgcgagctactgggagacgtgcctttccgcctcaagtcttcctttaagaattactacaccatcgttaccgaagcccccctggaccgagaggcgggggactcctacaccctgactgtagtggctcgggaccggggcgagcctgcgctctccaccagtaagtcgatccaggtacaagtgtcggatgtgaacgacaacgcgccgcgtttcagccagccggtctacgacgtgtatgtgactgaaaacaacgtgcctggcgcctacatctacgcggtgagcgccaccgaccgggatgagggcgccaacgcccagcttgcctactctatcctcgagtgccagatccagggcatgagcgtcttcacctacgtttctatcaactctgagaacggctacttgtacgccctgcgctccttcgactatgagcagctgaaggacttcagttttcaggtggaagcccgggacgctggcagcccccaggcgctggctggtaacgccactgtcaacatcctcatagtggatcaaaatgacaacgcccctgccatcgtggcgcctctaccagggcgcaacgggactccagcgcgtgaggtgctgccccgctcggcggagccgggttacctgctcacccgcgtggccgccgtggacgcggacgacggcgagaacgcccggctcacttacagcatcgtgcgtggcaacgaaatgaacctctttcgcatggactggcgcaccggggagctgcgcacagcacgccgagtcccggccaagcgcgacccccagcggccttatgagctggtgatcgaggtgcgcgaccatgggcagccgcccctttcctccaccgccaccctggtggttcagctggtggatggcgccgtggagccccagggcgggggcgggagcggaggcggagggtcaggagagcaccagcgccccagtcgctctggcggcggggaaacctcgctagacctcaccctcatcctcatcatcgcgttgggctcggtgtccttcatcttcctgctggccatgatcgtgctggccgtgcgttgccaaaaagagaagaagctcaacatctatacttgtctggccagcgattgctgcctctgctgctgctgctgcggtggcggaggttcgacctgctgtggccgccaagcccgggcgcgcaagaagaaactcagcaagtcagacatcatgctggtgcagagctccaatgtacccagtaacccggcccaggtgccgatagaggagtccgggggctttggctcccaccaccacaaccagaattactgctatcaggtatgcctgacccctgagtccgccaagaccgacctgatgtttcttaagccctgcagcccttcgcggagtacggacactgagcacaacccctgcggggccatcgtcaccggttacaccgaccagcagcctgatatcatctccaacggaagcattttgtccaacgaggtaaggctgaagcgaaaggaccaccatctctcatctcctccatcagaaagcctcctctagcccggcccttgtatctctggtgcactgtatctatttttaggatattagcttatgtgtatcgttgtgggagcagagatgggcggtcaccttctcccactccttcgtgtgtaacctaactttcgcgttgttccaccctttcacatttattttcattccgtccccttggtactttgccaccttggagctccctcctttgctcttccatcctgtcagtcctttcccttctcagtaacctgggcatgaagggaaactgcgtgaagggagagggaaatgtggaggagggacttactttctagcactggcaaaggtcttttttctttgcgtctgtcccaggcattaataaagttggctctattttgctttgtttaacgatgcttttagtcgcgtgtacaagtaagctatagattgtttaactttacacagttgtctaacctcgaattcatgttttagtgaacaagttaccagatccttctcctctgaactcgggttgcaaaaaaagccttcagttcggctctggacagcatttacagacgctcttgaagccgagcgcccacacagtgtgaatttgaatgaagctgcgttggcacaaacccctgttaagagtaaactaacgaaaggcttaaacaattgttgtcttaaatatatctttttagctaataatcaccttcttgccactgttttggataaatcacgctgttggctttcttcataaaagaatttggcttgtcaattctgacttctttttaaaaggatggagaagtgacaaagtcggagggtgggggttggggggagaacaaagttggtttatgtgaaagaaagcttggaccggaaaggtgtgtgggtggtagaggtggggaggcgaatgcagagggcctttggaggggaaaagaatgggggtggtggggggcgggcaggattatgaactcctttcctggcaggttattttatttgagtcttagatattattaattgactttcatgaatatttgtacagctcatttgtatcttaagcacattttgaaaataaacaacaacataattccatgaaatatccaaa

SEQ ID NO: 172054 - DNA, 4126 bp, Homo sapiens
  Payload ID: 13801
  Gene Symbol: PCDH11X
  Gene Name: protocadherin 11 X-linked
  Uniprot ID: Q9BZA7
  ENST ID: ENST00000361655
  CDS Start-End: 1-3990
atggacttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccgccaatgaaggaggttgtgcgatcttgcacccccatgaaagagtctacaactatggagatctggattcatccccaaccacagtcccagcggcgtgtcacatttcacctgccagaaggctctcaggaaagcagcagtgatggtggactgggagaccatgatgcaggcagccttaccagcacatctcatggcctgccccttggctatcctcaggaggagtactttgatcgtgctacacccagcaatcgcactgaaggggatggcaactccgatcctgaatctactgcagaaataactgttcaaccaactgtggaagaggcctctgacaactgcactcaagaatgtctcatctatggccattctgatgcctgctggatgccggcatctctggatcattccagctcttcgcaagcacaggcctctgctctatgccacagcccaccactgtcacaggcctctactcagcaccacagcccacgagtgacacagaccattgctctctgccacagccctccagtgacacagaccatcgcattgtgccacagcccaccaccgatacaggtgtctgctctccaccacagtcctcctctagtgcaggctactgcacttcaccacagcccaccatcagcacaggcctcagccctctgctacagccctcctttagcacaggctgctgcaatcagccacagctctcctctgccacaggttattgccctccatcgtagtcaggcccaatcatcagtcagtttgcagcaaggttgggtgcaaggtgctgatgggctatgctctgttgatcagggagtgcaaggtagtgcaacatctcagttttacaccatgtctgaaagacttcatcccagtgatgattcaattaaagtcattcctttgacaaccttcactccacgccaacaggccagaccgtccagaggtgattcccccattatggaagaacatcccttgtaaagctaaaatagttacttcaaattttcagaaaagatgtatatagtcaaaatttaagatacaattccaatgagtattctgattatcagatttgtaaataactatgtaaatagaaacagataccagaataaatctacag

SEQ ID NO: 172055 - DNA, 4069 bp, Homo sapiens
  Payload ID: 13801
  Gene Symbol: PCDH11X
  Gene Name: protocadherin 11 X-linked
  Uniprot ID: Q9BZA7
  ENST ID: ENST00000373088
  CDS Start-End: 1-3933
atggacttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccgtcccagcggcgtgtcacatttcacctgccagaaggctctcaggaaagcagcagtgatggtggactgggagaccatgatgcaggcagccttaccagcacatctcatggcctgccccttggctatcctcaggaggagtactttgatcgtgctacacccagcaatcgcactgaaggggatggcaactccgatcctgaatctactttcatacctggactaaagaaagctgcagaaataactgttcaaccaactgtggaagaggcctctgacaactgcactcaagaatgtctcatctatggccattctgatgcctgctggatgccggcatctctggatcattccagctcttcgcaagcacaggcctctgctctatgccacagcccaccactgtcacaggcctctactcagcaccacagcccacgagtgacacagaccattgctctctgccacagccctccagtgacacagaccatcgcattgtgccacagcccaccaccgatacaggtgtctgctctccaccacagtcctcctctagtgcaggctactgcacttcaccacagcccaccatcagcacaggcctcagccctctgctacagccctcctttagcacaggctgctgcaatcagccacagctctcctctgccacaggttattgccctccatcgtagtcaggcccaatcatcagtcagtttgcagcaaggttgggtgcaaggtgctgatgggctatgctctgttgatcagggagtgcaaggtagtgcaacatctcagttttacaccatgtctgaaagacttcatcccagtgatgattcaattaaagtcattcctttgacaaccttcactccacgccaacaggccagaccgtccagaggtgattcccccattatggaagaacatcccttgtaaagctaaaatagttacttcaaattttcagaaaagatgtatatagtcaaaatttaagatacaattccaatgagtattctgattatcagatttgtaaataactatgtaaatagaaacagataccagaataaatctacag

SEQ ID NO: 172056 - DNA, 9179 bp, Homo sapiens
  Payload ID: 13801
  Gene Symbol: PCDH11X
  Gene Name: protocadherin 11 X-linked
  Uniprot ID: Q9BZA7
  ENST ID: ENST00000373094
  CDS Start-End: 846-4889
ctggtggtccagtacctccaaagatatggaatacactcctgaaatatcctgaaaacttttttttttcagaatcctttaataagcagttatgtcaatctgaaagttgcttacttgtactttatattaatagctattcttgtttttcttatccaaagaaaaatcctctaatccccttttcacatgatagttgttaccatgtttaggcattagtcacatcaacccctctcctctcccaaacttctcttcttcaaatcaaactttattagtccctcctttataatgattccttgcctcgttttatccagatcaattttttttcactttgatgcccagagctgaagaaatggactactgtataaattattcattgccaagagaataattgcattttaaacccatattataacaaagaataatgattatattttgtgatttgtaacaaataccctttattttcccttaactattgaattaaatattttaattatttgtattctctttaactatcttggtatattaaagtattatcttttatatatttatcaatggtggacacttttataggtactctgtgtcatttttgatactgtaggtatcttatttcatttatctttattcttaatgtacgaattcataatatttgattcagaacaaatttatcactaattaacagagtgtcaattatgctaacatctcatttactgattttaatttaaaacagtttttgttaacatgcatgtttagggttggcttcttaataatttcttcttcctcttctctctctcctcttcttttggtcagtgttgtgcgggttaatacaacaaactgtaacaagtgtacctggtatggacttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccgccaatgaaggaggttgtgcgatcttgcacccccatgaaagagtctacaactatggagatctggattcatccccaaccacagcggaaatctgaagggaaagtggcaggaaagtcccagcggcgtgtcacatttcacctgccagaaggctctcaggaaagcagcagtgatggtggactgggagaccatgatgcaggcagccttaccagcacatctcatggcctgccccttggctatcctcaggaggagtactttgatcgtgctacacccagcaatcgcactgaaggggatggcaactccgatcctgaatctactttcatacctggactaaagaaagctgcagaaataactgttcaaccaactgtggaagaggcctctgacaactgcactcaagaatgtctcatctatggccattctgatgcctgctggatgccggcatctctggatcattccagctcttcgcaagcacaggcctctgctctatgccacagcccaccactgtcacaggcctctactcagcaccacagcccacgagtgacacagaccattgctctctgccacagccctccagtgacacagaccatcgcattgtgccacagcccaccaccgatacaggtgtctgctctccaccacagtcctcctctagtgcaggctactgcacttcaccacagcccaccatcagcacaggcctcagccctctgctacagccctcctttagcacaggctgctgcaatcagccacagctctcctctgccacaggttattgccctccatcgtagtcaggcccaatcatcagtcagtttgcagcaaggttgggtgcaaggtgctgatgggctatgctctgttgatcagggagtgcaaggtagtgcaacatctcagttttacaccatgtctgaaagacttcatcccagtgatgattcaattaaagtcattcctttgacaaccttcactccacgccaacaggccagaccgtccagaggtgattcccccattatggaagaacatcccttgtaaagctaaaatagttacttcaaattttcagaaaagatgtatatagtcaaaatttaagatacaattccaatgagtattctgattatcagatttgtaaataactatgtaaatagaaacagataccagaataaatctacagctagacccttagtcaatagttaaccaaaaaattgcaatttgtttaattcagaatgtgtatttaaaaagaaaaggaatttaacaatttgcatccccttgtacagtaaggcttatcatgacagagcgcactatttctgatgtacagtattttttgttgtttttatcatcatgtgcaatattactgatttgtttccatgctgattgtgtggaaccagtatgtagcaaatggaaagcctagaaatatcttattttctaagtttacctttagtttacctaaacttttgttcagataacgttaaaaggtatacgtactctagcctttttttgggctttctttttgatttttgtttgttgttttcagtttttttgttgttgttagtgagtctcccttcaaaatacgcagtaggtagtgtaaatactgcttgtttgtgtctctctgctgtcatgttttctaccttattccaatactatattgttgataaaatttgtatatacattttcaataaagaatatgtataaactgtacagatctagatctacaacctatttctctactctttagtagagttcgagacacagaagtgcaataactgccctaattaagcaactatttgttaaaaagggcctctttttactttaatagtttagtgtaaagtacatcagaaataaagctgtatctgccattttaagcctgtagtccattattacttgggtctttacttctgggaatttgtatgtaacagcctagaaaattaaaaggaggtggatgcatccaaagcacgagtcacttaaaatatcgacggtaaactactattttgtagagaaactcaggaagatttaaatgttgatttgacagctcaataggctgttaccaaagggtgttcagtaaaaataacaaatacatgtaactgtagataaaaccatatactaaatctataagactaagggatttttgttattctagctcaacttactgaagaaaaccactaataacaacaagaatatcaggaaggaacttttcaagaaatgtaattataaatctacatcaaacagaattttaaggaaaaatgcagagggagaaataaggcacatgactgcttcttgcagtcaacaagaaataccaataacacacacagaacaaaaaccatcaaaatctcatatatgaaataaaatatattcttctaagcaaagaaacagtactattcatagaaaacattagttttcttctgttgtctgttatttccttcttgtatcctcttaactggccattatcttgtatgtgcacattttataaatgtacagaaacatcaccaacttaattttcttccatagcaaaactgagaaaataccttgtttcagtataacactaaaccaagagacaattgatgtttaatgggggcggttggggtgggggggggagtcaatatctcctattgattaacttagacatagattttgtaatgtataacttgatatttaatttatgattaaactgtgtgtaaattttgtaacataaactgtggtaattgcataatttcattggtgaggatttccactgaatattgagaaagtttcttttcatgtgcccagcaggttaagtagcgttttcagaatatacattattcccatccattgtaaagttccttaagtcatatttgactgggcgtgcagaataacttcttaacttttaactatcagagtttgattaataaaattaattaatgttttttctccttcgtgttgttaatgttccaagggatttggagcatactggttttccaggtgcatgtgaatcccgaaggactgatgatatttgaatgtttattaaattattatcatacaaatgtgttgatattgtggctattgttgatgttgaaaattttaaacttggggaagattaagaaaagaaccaatagtgacaaaaatcagtgcttccagtagattttagaacattctttgcctcaaaaaacctgcaaagatgatgtgagattttttcttgtgttttaattattttcacattttctctctgcaaaactttagttttctgatgatctacacacacacacacacacacacgtgcacacacacacacatttaaatgatataaaaagaagaggttgaaagattattaaataacttatcaggcatctcaatggttactatctatgttagtgaaaatcaaataggactcaaagttggatatttgggatttttcttctgacagtataatttattgagttactagggaggttcttaaatcctcatatctggaaacttgtgacgttttgacacctttcctatagatgatataggaatgaaccaatacgcttttattaccctttctaactctgattttataatcagacttagattgtgtttagaatattaaatgactgggcaccctcttcttggtttttaccagagaggctttgaatggaagcaggctgagagtagccaaagaggcaaggggtattagcccagttattctcccctatgccttccttctctttctaagcgtccactaggtctggccttggaaacctgttacttctagggcttcagatctgatgatatctttttcatcacattacaagttatttctctgactgaatagacagtggtataggttgacacagcacacaagtggctattgtgatgtatgatgtatgtagtcctacaactgcaaaacgtcttactgaaccaacaatcaaaaaatggttctgttttaaaaaggattttgtttgatttgaaattaaaacttcaagctgaatgacttatatgagaataatacgttcaatcaaagtagttattctattttgtgtccatattccattagattgtgattattaattttctagctatggtattactatatcacacttgtgagtatgtattcaaatactaagtatcttatatgctacgtgcatacacattcttttcttaaactttacctgtgttttaactaatattgtgtcagtgtattaaaaattagcttttacatatgatatctacaatgtaataaatttagagagtaattttgtgtattcttatttacttaacattttacttttaattatgtaaatttggttagaaaataataataaatggttagtgctattgtgtaatggtagcagttacaaagagcctctgccttcccaaactaatatttatcacacatggtcattaaatgggaaaaaaatagactaaacaaatcacaaattgttcagttcttaaaatgtaattatgtcacacacacaaaaaatccttttcaatcctgagaaaattaaaggcgttttactcacatggctatttcaacattagttttttttgtttgtttctttttcatggtattactgaaggtgtgtatactccctaatacacatttatgaaaatctacttgtttaggcttttatttatactcttctgatttatattttttattataattattatttcttatctttcttcttttatattttttggaaaccaaatttatagttagtttaggtaaactttttattatgaccattagaaactattttgaatgcttccaactggctcaattggccgggaaaacatgggagcaagagaagctgaaatatatttctgcaagaacctttctatattatgtgccaattaccacaccagatcaattttatgcagaggccttaaaatattctttcacagtagctttcttacactaaccgtcatgtgcttttagtaaatatgatttttaaaagcagttcaagttgacaacagcagaaacagtaacaaaaaaatctgctcagaaaaatgtatgtgcacaaataaaaaaaattaatggcaattgtttagtgattgtaagtgatactttttaaagagtaaactgtgtgaaatttatactatccctgcttaaaatattaagatttttatgaaatatgtatttatgtttgtattgtgggaagattcctcctctgtgatatcatacagcatctgaaagtgaacagtatcccaaagcagttccaaccatgctttggaagtaagaaggttgactattgtatggccaaggatggcagtatgtaatccagaagcaaacttgtattaattgttctatttcaggttctgtattgcatgttttcttattaatatatattaataaaagttatgagaaataaa

SEQ ID NO: 172057 - DNA, 9146 bp, Homo sapiens
  Payload ID: 13801
  Gene Symbol: PCDH11X
  Gene Name: protocadherin 11 X-linked
  Uniprot ID: Q9BZA7
  ENST ID: ENST00000373097
  CDS Start-End: 846-4859
ctggtggtccagtacctccaaagatatggaatacactcctgaaatatcctgaaaacttttttttttcagaatcctttaataagcagttatgtcaatctgaaagttgcttacttgtactttatattaatagctattcttgtttttcttatccaaagaaaaatcctctaatccccttttcacatgatagttgttaccatgtttaggcattagtcacatcaacccctctcctctcccaaacttctcttcttcaaatcaaactttattagtccctcctttataatgattccttgcctcgttttatccagatcaattttttttcactttgatgcccagagctgaagaaatggactactgtataaattattcattgccaagagaataattgcattttaaacccatattataacaaagaataatgattatattttgtgatttgtaacaaataccctttattttcccttaactattgaattaaatattttaattatttgtattctctttaactatcttggtatattaaagtattatcttttatatatttatcaatggtggacacttttataggtactctgtgtcatttttgatactgtaggtatcttatttcatttatctttattcttaatgtacgaattcataatatttgattcagaacaaatttatcactaattaacagagtgtcaattatgctaacatctcatttactgattttaatttaaaacagtttttgttaacatgcatgtttagggttggcttcttaataatttcttcttcctcttctctctctcctcttcttttggtcagtgttgtgcgggttaatacaacaaactgtaacaagtgtacctggtatggacttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccgccaatgaaggaggttgtgcgatcttgcacccccatgaaagagtctacaactatggagatctggattcatccccaaccacagtcccagcggcgtgtcacatttcacctgccagaaggctctcaggaaagcagcagtgatggtggactgggagaccatgatgcaggcagccttaccagcacatctcatggcctgccccttggctatcctcaggaggagtactttgatcgtgctacacccagcaatcgcactgaaggggatggcaactccgatcctgaatctactttcatacctggactaaagaaagctgcagaaataactgttcaaccaactgtggaagaggcctctgacaactgcactcaagaatgtctcatctatggccattctgatgcctgctggatgccggcatctctggatcattccagctcttcgcaagcacaggcctctgctctatgccacagcccaccactgtcacaggcctctactcagcaccacagcccacgagtgacacagaccattgctctctgccacagccctccagtgacacagaccatcgcattgtgccacagcccaccaccgatacaggtgtctgctctccaccacagtcctcctctagtgcaggctactgcacttcaccacagcccaccatcagcacaggcctcagccctctgctacagccctcctttagcacaggctgctgcaatcagccacagctctcctctgccacaggttattgccctccatcgtagtcaggcccaatcatcagtcagtttgcagcaaggttgggtgcaaggtgctgatgggctatgctctgttgatcagggagtgcaaggtagtgcaacatctcagttttacaccatgtctgaaagacttcatcccagtgatgattcaattaaagtcattcctttgacaaccttcactccacgccaacaggccagaccgtccagaggtgattcccccattatggaagaacatcccttgtaaagctaaaatagttacttcaaattttcagaaaagatgtatatagtcaaaatttaagatacaattccaatgagtattctgattatcagatttgtaaataactatgtaaatagaaacagataccagaataaatctacagctagacccttagtcaatagttaaccaaaaaattgcaatttgtttaattcagaatgtgtatttaaaaagaaaaggaatttaacaatttgcatccccttgtacagtaaggcttatcatgacagagcgcactatttctgatgtacagtattttttgttgtttttatcatcatgtgcaatattactgatttgtttccatgctgattgtgtggaaccagtatgtagcaaatggaaagcctagaaatatcttattttctaagtttacctttagtttacctaaacttttgttcagataacgttaaaaggtatacgtactctagcctttttttgggctttctttttgatttttgtttgttgttttcagtttttttgttgttgttagtgagtctcccttcaaaatacgcagtaggtagtgtaaatactgcttgtttgtgtctctctgctgtcatgttttctaccttattccaatactatattgttgataaaatttgtatatacattttcaataaagaatatgtataaactgtacagatctagatctacaacctatttctctactctttagtagagttcgagacacagaagtgcaataactgccctaattaagcaactatttgttaaaaagggcctctttttactttaatagtttagtgtaaagtacatcagaaataaagctgtatctgccattttaagcctgtagtccattattacttgggtctttacttctgggaatttgtatgtaacagcctagaaaattaaaaggaggtggatgcatccaaagcacgagtcacttaaaatatcgacggtaaactactattttgtagagaaactcaggaagatttaaatgttgatttgacagctcaataggctgttaccaaagggtgttcagtaaaaataacaaatacatgtaactgtagataaaaccatatactaaatctataagactaagggatttttgttattctagctcaacttactgaagaaaaccactaataacaacaagaatatcaggaaggaacttttcaagaaatgtaattataaatctacatcaaacagaattttaaggaaaaatgcagagggagaaataaggcacatgactgcttcttgcagtcaacaagaaataccaataacacacacagaacaaaaaccatcaaaatctcatatatgaaataaaatatattcttctaagcaaagaaacagtactattcatagaaaacattagttttcttctgttgtctgttatttccttcttgtatcctcttaactggccattatcttgtatgtgcacattttataaatgtacagaaacatcaccaacttaattttcttccatagcaaaactgagaaaataccttgtttcagtataacactaaaccaagagacaattgatgtttaatgggggcggttggggtgggggggggagtcaatatctcctattgattaacttagacatagattttgtaatgtataacttgatatttaatttatgattaaactgtgtgtaaattttgtaacataaactgtggtaattgcataatttcattggtgaggatttccactgaatattgagaaagtttcttttcatgtgcccagcaggttaagtagcgttttcagaatatacattattcccatccattgtaaagttccttaagtcatatttgactgggcgtgcagaataacttcttaacttttaactatcagagtttgattaataaaattaattaatgttttttctccttcgtgttgttaatgttccaagggatttggagcatactggttttccaggtgcatgtgaatcccgaaggactgatgatatttgaatgtttattaaattattatcatacaaatgtgttgatattgtggctattgttgatgttgaaaattttaaacttggggaagattaagaaaagaaccaatagtgacaaaaatcagtgcttccagtagattttagaacattctttgcctcaaaaaacctgcaaagatgatgtgagattttttcttgtgttttaattattttcacattttctctctgcaaaactttagttttctgatgatctacacacacacacacacacacacgtgcacacacacacacatttaaatgatataaaaagaagaggttgaaagattattaaataacttatcaggcatctcaatggttactatctatgttagtgaaaatcaaataggactcaaagttggatatttgggatttttcttctgacagtataatttattgagttactagggaggttcttaaatcctcatatctggaaacttgtgacgttttgacacctttcctatagatgatataggaatgaaccaatacgcttttattaccctttctaactctgattttataatcagacttagattgtgtttagaatattaaatgactgggcaccctcttcttggtttttaccagagaggctttgaatggaagcaggctgagagtagccaaagaggcaaggggtattagcccagttattctcccctatgccttccttctctttctaagcgtccactaggtctggccttggaaacctgttacttctagggcttcagatctgatgatatctttttcatcacattacaagttatttctctgactgaatagacagtggtataggttgacacagcacacaagtggctattgtgatgtatgatgtatgtagtcctacaactgcaaaacgtcttactgaaccaacaatcaaaaaatggttctgttttaaaaaggattttgtttgatttgaaattaaaacttcaagctgaatgacttatatgagaataatacgttcaatcaaagtagttattctattttgtgtccatattccattagattgtgattattaattttctagctatggtattactatatcacacttgtgagtatgtattcaaatactaagtatcttatatgctacgtgcatacacattcttttcttaaactttacctgtgttttaactaatattgtgtcagtgtattaaaaattagcttttacatatgatatctacaatgtaataaatttagagagtaattttgtgtattcttatttacttaacattttacttttaattatgtaaatttggttagaaaataataataaatggttagtgctattgtgtaatggtagcagttacaaagagcctctgccttcccaaactaatatttatcacacatggtcattaaatgggaaaaaaatagactaaacaaatcacaaattgttcagttcttaaaatgtaattatgtcacacacacaaaaaatccttttcaatcctgagaaaattaaaggcgttttactcacatggctatttcaacattagttttttttgtttgtttctttttcatggtattactgaaggtgtgtatactccctaatacacatttatgaaaatctacttgtttaggcttttatttatactcttctgatttatattttttattataattattatttcttatctttcttcttttatattttttggaaaccaaatttatagttagtttaggtaaactttttattatgaccattagaaactattttgaatgcttccaactggctcaattggccgggaaaacatgggagcaagagaagctgaaatatatttctgcaagaacctttctatattatgtgccaattaccacaccagatcaattttatgcagaggccttaaaatattctttcacagtagctttcttacactaaccgtcatgtgcttttagtaaatatgatttttaaaagcagttcaagttgacaacagcagaaacagtaacaaaaaaatctgctcagaaaaatgtatgtgcacaaataaaaaaaattaatggcaattgtttagtgattgtaagtgatactttttaaagagtaaactgtgtgaaatttatactatccctgcttaaaatattaagatttttatgaaatatgtatttatgtttgtattgtgggaagattcctcctctgtgatatcatacagcatctgaaagtgaacagtatcccaaagcagttccaaccatgctttggaagtaagaaggttgactattgtatggccaaggatggcagtatgtaatccagaagcaaacttgtattaattgttctatttcaggttctgtattgcatgttttcttattaatatatattaataaaagttatgagaaat

SEQ ID NO: 172058 - DNA, 3637 bp, Homo sapiens
  Payload ID: 13801
  Gene Symbol: PCDH11X
  Gene Name: protocadherin 11 X-linked
  ENST ID: ENST00000395337
  CDS Start-End: 590-3637
cccctttctccccctcggttaagtccctccccctcgccattcaaaagggctggctcggcactggctccttgcagtcggcgaactgtcggggcgggaggagccgtgagcagtagctgcactcagctgcccgcgcggcaaagaggaaggcaagccaaacagagtgcgcagagtggcagtgccagcggcgacacaggcagcacaggcagcccgggctgcctgaatagcctcagaaacaacctcagcgactccggctgctctgcggactgcgagctgtggcggtagagcccgctacagcagtcgcagtctccgtggagcgggcggaagccttttttctccctttcgtttacctcttcattctactctaaaggcatcgttattaggaaaatcctgttgcgaataagaaggattccacagatcacataccggagaggttttgcctcagctgctctcaactttgtaatcttgtgaagaagctgacaagcttggctgattgcagagcactatgaggactgaacgacagtgggttttaattcagatatttcaagtgttgtgcgggttaatacaacaaactgtaacaagtgtacctggtatggacttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccggcacaaagaaaactg

SEQ ID NO: 172059 - DNA, 4156 bp, Homo sapiens
  Payload ID: 13801
  Gene Symbol: PCDH11X
  Gene Name: protocadherin 11 X-linked
  Uniprot ID: Q9BZA7
  ENST ID: ENST00000406881
  CDS Start-End: 1-4020
atggacttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccgccaatgaaggaggttgtgcgatcttgcacccccatgaaagagtctacaactatggagatctggattcatccccaaccacagcggaaatctgaagggaaagtggcaggaaagtcccagcggcgtgtcacatttcacctgccagaaggctctcaggaaagcagcagtgatggtggactgggagaccatgatgcaggcagccttaccagcacatctcatggcctgccccttggctatcctcaggaggagtactttgatcgtgctacacccagcaatcgcactgaaggggatggcaactccgatcctgaatctactgcagaaataactgttcaaccaactgtggaagaggcctctgacaactgcactcaagaatgtctcatctatggccattctgatgcctgctggatgccggcatctctggatcattccagctcttcgcaagcacaggcctctgctctatgccacagcccaccactgtcacaggcctctactcagcaccacagcccacgagtgacacagaccattgctctctgccacagccctccagtgacacagaccatcgcattgtgccacagcccaccaccgatacaggtgtctgctctccaccacagtcctcctctagtgcaggctactgcacttcaccacagcccaccatcagcacaggcctcagccctctgctacagccctcctttagcacaggctgctgcaatcagccacagctctcctctgccacaggttattgccctccatcgtagtcaggcccaatcatcagtcagtttgcagcaaggttgggtgcaaggtgctgatgggctatgctctgttgatcagggagtgcaaggtagtgcaacatctcagttttacaccatgtctgaaagacttcatcccagtgatgattcaattaaagtcattcctttgacaaccttcactccacgccaacaggccagaccgtccagaggtgattcccccattatggaagaacatcccttgtaaagctaaaatagttacttcaaattttcagaaaagatgtatatagtcaaaatttaagatacaattccaatgagtattctgattatcagatttgtaaataactatgtaaatagaaacagataccagaataaatctacag

SEQ ID NO: 172060 - DNA, 4017 bp, Homo sapiens
  Payload ID: 13801
  Gene Symbol: PCDH11X
  Gene Name: protocadherin 11 X-linked
  Uniprot ID: Q9BZA7
  ENST ID: ENST00000504220
  CDS Start-End: 1-3198
atggacttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccgccaatgaaggaggttgtgcgatcttgcacccccatgaaagagtctacaactatggagatctggattcatccccaaccacagcggaaatctgaagggaaagtggcaggaaagactgtgcttacttcctcttccccttctgccatgaccctttcatacctggactaaagaaagctgcagaaataactgttcaaccaactgtggaagaggcctctgacaactgcactcaagaatgtctcatctatggccattctgatgcctgctggatgccggcatctctggatcattccagctcttcgcaagcacaggcctctgctctatgccacagcccaccactgtcacaggcctctactcagcaccacagcccacgagtgacacagaccattgctctctgccacagccctccagtgacacagaccatcgcattgtgccacagcccaccaccgatacaggtgtctgctctccaccacagtcctcctctagtgcaggctactgcacttcaccacagcccaccatcagcacaggcctcagccctctgctacagccctcctttagcacaggctgctgcaatcagccacagctctcctctgccacaggttattgccctccatcgtagtcaggcccaatcatcagtcagtttgcagcaaggttgggtgcaaggtgctgatgggctatgctctgttgatcagggagtgcaaggtagtgcaacatctcagttttacaccatgtctgaaagacttcatcccagtgatgattcaattaaagtcattcctttgacaaccttcactccacgccaacaggccagaccgtccagaggtgattcccccattatggaagaacatcccttgtaaagctaaaatagttacttcaaattttcagaaaagatgtatatagtcaaaatttaagatacaattccaatgagtattctgattatcagatttgtaaataactatgtaaatagaaacagataccagaataaatctacag

SEQ ID NO: 172061 - DNA, 4595 bp, Homo sapiens
  Payload ID: 13802
  Gene Symbol: PCDH11Y
  Gene Name: protocadherin 11 Y-linked
  Uniprot ID: Q9BZA8
  ENST ID: ENST00000215473
  CDS Start-End: 737-3898
ctggtggtccagtacctccaaagatatggaatacactcctgaaatatcctgaaaccttttttttttcagaatcctttaataagcagttatgtcaatctgaaagttgcttacttgtactttatattaatagctattcttgtttttcttatccaaagaaaaatcctctaatccccttttcacatgatagttgttaccatgtttaggcgttagtcacatcaacccctctcctctcccaaacttctcttcttcaaatcaaactttattagtccctcctttataatgattccttgcctccttttatccagatcaattttttttcactttgatgcccagagctgaagaaatggactattgtataaattattcattgccaagagaataattgcattttaaacccatgttataacaaagaataatgattatattttgtgatttgtaacaaataccctttattttcccttaactattgaattaaatattttaattatttgtattctctttaactatcttggtatattaaagtattatcttttatatatttatcaatggtggacacttttataggtactctgtgtcatttttgatactgtaggtatcttatttcatttatctttattcttaatgtacgaattcataatatttgattcagaacagatttatcactaattaacagagtgtcaattatgctaacatctcatttactgattttaatttaaaacagtttttgttaacatgcatgtttagggttggcttcttaataatttcttcttcctcttctctctctcctcttcttttggtcagtgttgtgcgggttaatacaacaaactgtcacaagtgtttgttgtccgggacgtacattttcgcggtcctgctagtatgcgtggtgttccactctggcgcccaggagaaaaactacaccatccgagaagaaattccagaaaacgtcctgataggcaacttgttgaaagaccttaacttgtcgctgattccaaacaagtccttgacaactactatgcagttcaagctagtgtacaagaccggagatgtgccactgattcgaattgaagaggatactggtgagatcttcactaccggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggcataaacggagttcaaaactacgaactaattaagagtcaaaacatttttggcctcgatgtcattgaaacaccagaaggagacaagatgccacaactgattgttcaaaaggagttagatagggaagagaaggatacctatgtgatgaaagtaaaggttgaagatggtggctttcctcaaagatccagtactgctattttgcaagtaagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaattcctttcagattaaggccagtattcagtaatcagttcctcctggagaatgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgatgaaagtaagtgcaacggatgcagacagtgggcctaatgctgagatcaattacctgctaggccctgatgctccacctgaattcagcctggatcgtcgtacaggcatgctgactgtagtgaagaaactagatagagaaaaagaggataaatatttattcacaattctggcaaaagataatggggtaccacccttaaccagcaatgtcacagtctttgtaagcattattgatcagaatgacaatagcccagttttcactcacaatgaatacaaattctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttacaactattcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcagtgaccaatgctacactgattaatgaactggtgcgcaaaagcattgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacatgcagaattctgaatgggctaccccaaacccagaaaacaggcagatgataatgatgaagaaaaagaaaaagaagaagaagcattcccctaagaacctgctgcttaatgttgtcactattgaagaaactaaggcagatgatgttgacagtgatggaaacagagtcacactagaccttcctattgatctagaagagcaaacaatgggaaagtacaattgggtaactacacctactactttcaagcctgacagccctgatttggcccgacactacaaatctgcctctccacagcctgccttccaaattcagcctgaaactcccctgaatttgaagcaccacatcatccaagaactgcctctcgataacacctttgtggcctgtgactctatctccaattgttcctcaagcagttcagatccctacagcgtttctgactgtggctatccagtgacaaccttcgaggtacctgtgtccgtacacaccagaccggtaggtatccaagtttctaacacaactttctaactatttttttattattattttcagttgatgtagaactttacaaaatctattgacttcaaagagggatcaaaacaatcatattctacagatgtacccaatagatatatggattcaattaagtttggtagaagatgagaacaaaataactactgatttaggaaaattggatgcagaataataattatagtaggggcaattttgtctgtagatggcagtatgacaattcttgctagaaaatatattgaaaaaaacttcaacacaaagggttgtagcactgtcctcagtaccattgtgggcatgaggatcagaatagtctgggctagatacatcacattaaagcttttcagaatctgataaatagctctaaatactaatgatattgagaagcctagcttcacttgggaaaatctgtggctgttcacagaaattcagcaccaagatattccccccatactctaccaggccttcaggtcctcataaagaaaagtgtcgttttcagattaggaactcaaaattattttggtgcatcaaatctacagtaacacaatataacaagaatgggattagaaaaatgaaagcctactcattctcatctttaagccagagaatgaaatatatatgaggtctctactttagatagctatttaaatatttgcatatttatgcaaggtattttgagcccttcagaagacattct

SEQ ID NO: 172062 - DNA, 4710 bp, Homo sapiens
  Payload ID: 13802
  Gene Symbol: PCDH11Y
  Gene Name: protocadherin 11 Y-linked
  Uniprot ID: Q9BZA8
  ENST ID: ENST00000333703
  CDS Start-End: 514-3627
cccctttctccccctctgttaagtccctccccctcgccattcaaaagggctggctcggcactggctccttgcagtcggcgaactgtctgggcgggaggagccgtgagcagtagctgcactcagctgcccgcgcggcaaagaggaaggcaagccaaacagagtgcgcagagtggcagtgccagcggcgacacaggcagcacaggcagcccgggctgcctgaatagcctcagaaacaacctcagcgactccggctgctctgcggactgcgagctgtggcggtagagcccgctacagcagtcgcagtctccgtggagcgggcggaagccttttttctccctttcgtttacctcttcattctactctaaaggcatcgttattaggaaaatcctgttgtgaataagaaggattccacagatcacataccagagcggttttgcctcagctgctctcaactttgtaatcttgtgaagaagctgacaagcttggctgattgcagtgcactatgaggactgaatgacagtgggttttaattcagatatttcaagtgttgtgcgggttaatacaacaaactgtcacaagtgtttgttgtccgggacgtacattttcgcggtcctgctagtatgcgtggtgttccactctggcgcccaggagaaaaactacaccatccgagaagaaattccagaaaacgtcctgataggcaacttgttgaaagaccttaacttgtcgctgattccaaacaagtccttgacaactactatgcagttcaagctagtgtacaagaccggagatgtgccactgattcgaattgaagaggatactggtgagatcttcactaccggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggcataaacggagttcaaaactacgaactaattaagagtcaaaacatttttggcctcgatgtcattgaaacaccagaaggagacaagatgccacaactgattgttcaaaaggagttagatagggaagagaaggatacctatgtgatgaaagtaaaggttgaagatggtggctttcctcaaagatccagtactgctattttgcaagtaagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaattcctttcagattaaggccagtattcagtaatcagttcctcctggagaatgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgatgaaagtaagtgcaacggatgcagacagtgggcctaatgctgagatcaattacctgctaggccctgatgctccacctgaattcagcctggatcgtcgtacaggcatgctgactgtagtgaagaaactagatagagaaaaagaggataaatatttattcacaattctggcaaaagataatggggtaccacccttaaccagcaatgtcacagtctttgtaagcattattgatcagaatgacaatagcccagttttcactcacaatgaatacaaattctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttacaactattcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcagtgaccaatgctacactgattaatgaactggtgcgcaaaagcattgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacatgcagaattctgaatgggctaccccaaacccagaaaacaggcagatgataatgatgaagaaaaagaaaaagaagaagaagcattcccctaagaacctgctgcttaatgttgtcactattgaagaaactaaggcagatgatgttgacagtgatggaaacagagtcacactagaccttcctattgatctagaagagcaaacaatgggaaagtacaattgggtaactacacctactactttcaagcctgacagccctgatttggcccgacactacaaatctgcctctccacagcctgccttccaaattcagcctgaaactcccctgaatttgaagcaccacatcatccaagaactgcctctcgataacacctttgtggcctgtgactctatctccaattgttcctcaagcagttcagatccctacagcgtttctgactgtggctatccagtgacaaccttcgaggtacctgtgtccgtacacaccagaccgactgattccaggacatgaactattgaaatctgcagtgagatgtaactttctaggaacaacaaaattccattccccttccaaaaaatttcaatgattgtgatttcaaaattaggctaagatcattaattttgtaatctagatttcccattataaaagcaagcaaaaatcatcttaaaaatgatgtcctagtgaaccttgtgctttctttagctgtaatctggcaatggaaatttaaaatttatggaagagacagtgcagcgcaataacagagtactctcatgctgtttctctgtttgctctgaatcaacagccatgatgtaatataaggctgtcttggtgtatacacttatggttaatatatcagtcatgaaacatgcaattacttgccctgtctgattgttgaataattaaaacattatctccaggagtttggaagtgagctgaactagccaaactactctctgaaaggtatccagggcaagagacatttttaagaccccaaacaaacaaaaaacaaaaccaaaacactctggttcagtgttttgaaaatattgactaacataatattgctgagaaaatcatttttattacccaccactctgcttaaaagttgagtgggccgggcgcggtggctcacgcctgtaattccagcactttgggaggccgaggcgggtggatcacgaggtcaggatattgagaccatcctggctaacatggtgaaaccccatctccactaaaaatacaaaaaattagctgggcgtggtggcgggcgcctgtagtcccagctactcgggaggctgaggcaggagaatggcgtgaacccgggaggcggagcttgcagtgagccgagatggcgccactgcactccagcctgggtgacagagcaagactctgtctcaaaaagaaaaaaatgttcagtgatagaaaataattttactaggtttttatgttgattgtactcatgctgttccactccttttaattattaaaaagttatttttggctgggtgtggtggctcatacctgtaatcccagcactttgggaggccgaggcgggtggatcacctgaggtcaggagttcaagaccagtctggccaacat

SEQ ID NO: 172063 - DNA, 4220 bp, Homo sapiens
  Payload ID: 13802
  Gene Symbol: PCDH11Y
  Gene Name: protocadherin 11 Y-linked
  Uniprot ID: Q9BZA8
  ENST ID: ENST00000362095
  CDS Start-End: 735-3881
ggtggtccagtacctccaaagatatggaatacactcctgaaatatcctgaaaccttttttttttcagaatcctttaataagcagttatgtcaatctgaaagttgcttacttgtactttatattaatagctattcttgtttttcttatccaaagaaaaatcctctaatccccttttcacatgatagttgttaccatgtttaggcgttagtcacatcaacccctctcctctcccaaacttctcttcttcaaatcaaactttattagtccctcctttataatgattccttgcctccttttatccagatcaattttttttcactttgatgcccagagctgaagaaatggactattgtataaattattcattgccaagagaataattgcattttaaacccatgttataacaaagaataatgattatattttgtgatttgtaacaaataccctttattttcccttaactattgaattaaatattttaattatttgtattctctttaactatcttggtatattaaagtattatcttttatatatttatcaatggtggacacttttataggtactctgtgtcatttttgatactgtaggtatcttatttcatttatctttattcttaatgtacgaattcataatatttgattcagaacagatttatcactaattaacagagtgtcaattatgctaacatctcatttactgattttaatttaaaacagtttttgttaacatgcatgtttagggttggcttcttaataatttcttcttcctcttctctctctcctcttcttttggtcagtgttgtgcgggttaatacaacaaactgtcacaagtgtttgttgtccgggacgtacattttcgcggtcctgctagtatgcgtggtgttccactctggcgcccaggagaaaaactacaccatccgagaagaaattccagaaaacgtcctgataggcaacttgttgaaagaccttaacttgtcgctgattccaaacaagtccttgacaactactatgcagttcaagctagtgtacaagaccggagatgtgccactgattcgaattgaagaggatactggtgagatcttcactaccggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggcataaacggagttcaaaactacgaactaattaagagtcaaaacatttttggcctcgatgtcattgaaacaccagaaggagacaagatgccacaactgattgttcaaaaggagttagatagggaagagaaggatacctatgtgatgaaagtaaaggttgaagatggtggctttcctcaaagatccagtactgctattttgcaagtaagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaattcctttcagattaaggccagtattcagtaatcagttcctcctggagaatgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgatgaaagtaagtgcaacggatgcagacagtgggcctaatgctgagatcaattacctgctaggccctgatgctccacctgaattcagcctggatcgtcgtacaggcatgctgactgtagtgaagaaactagatagagaaaaagaggataaatatttattcacaattctggcaaaagataatggggtaccacccttaaccagcaatgtcacagtctttgtaagcattattgatcagaatgacaatagcccagttttcactcacaatgaatacaaattctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttacaactattcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcagtgaccaatgctacactgattaatgaactggtgcgcaaaagcattgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacatgcagaattctgaatgggctaccccaaacccagaaaacaggcagatgataatgatgaagaaaaagaaaaagaagaagaagcattcccctaagaacctgctgcttaatgttgtcactattgaagaaactaaggcagatgatgttgacagtgatggaaacagagtcacactagaccttcctattgatctagaagagcaaacaatgggaaagtacaattgggtaactacacctactactttcaagcctgacagccctgatttggcccgacactacaaatctgcctctccacagcctgccttccaaattcagcctgaaactcccctgaatttgaagcaccacatcatccaagaactgcctctcgataacacctttgtggcctgtgactctatctccaattgttcctcaagcagttcagatccctacagcgtttctgactgtggctatccagtgacaaccttcgaggtacctgtgtccgtacacaccagaccgactgattccaggacatgaactattgaaatctgcagtgagatgtaactttctaggaacaacaaaattccattccccttccaaaaaatttcaatgattgtgatttcaaaattaggctaagatcattaattttgtaatctagatttcccattataaaagcaagcaaaaatcatcttaaaaatgatgtcctagtgaaccttgtgctttctttagctgtaatctggcaatggaaatttaaaatttatggaagagacagtgcagcgcaataacagagtactctcatgctgtttctctgtttgctctgaatcaacagccatgatgtaatataaggctgtcttggtgtatacacttatggttaat

SEQ ID NO: 172064 - DNA, 9039 bp, Homo sapiens
  Payload ID: 13802
  Gene Symbol: PCDH11Y
  Gene Name: protocadherin 11 Y-linked
  Uniprot ID: Q9BZA8
  ENST ID: ENST00000400457
  CDS Start-End: 735-4757
ggtggtccagtacctccaaagatatggaatacactcctgaaatatcctgaaaccttttttttttcagaatcctttaataagcagttatgtcaatctgaaagttgcttacttgtactttatattaatagctattcttgtttttcttatccaaagaaaaatcctctaatccccttttcacatgatagttgttaccatgtttaggcgttagtcacatcaacccctctcctctcccaaacttctcttcttcaaatcaaactttattagtccctcctttataatgattccttgcctccttttatccagatcaattttttttcactttgatgcccagagctgaagaaatggactattgtataaattattcattgccaagagaataattgcattttaaacccatgttataacaaagaataatgattatattttgtgatttgtaacaaataccctttattttcccttaactattgaattaaatattttaattatttgtattctctttaactatcttggtatattaaagtattatcttttatatatttatcaatggtggacacttttataggtactctgtgtcatttttgatactgtaggtatcttatttcatttatctttattcttaatgtacgaattcataatatttgattcagaacagatttatcactaattaacagagtgtcaattatgctaacatctcatttactgattttaatttaaaacagtttttgttaacatgcatgtttagggttggcttcttaataatttcttcttcctcttctctctctcctcttcttttggtcagtgttgtgcgggttaatacaacaaactgtcacaagtgtttgttgtccgggacgtacattttcgcggtcctgctagtatgcgtggtgttccactctggcgcccaggagaaaaactacaccatccgagaagaaattccagaaaacgtcctgataggcaacttgttgaaagaccttaacttgtcgctgattccaaacaagtccttgacaactactatgcagttcaagctagtgtacaagaccggagatgtgccactgattcgaattgaagaggatactggtgagatcttcactaccggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggcataaacggagttcaaaactacgaactaattaagagtcaaaacatttttggcctcgatgtcattgaaacaccagaaggagacaagatgccacaactgattgttcaaaaggagttagatagggaagagaaggatacctatgtgatgaaagtaaaggttgaagatggtggctttcctcaaagatccagtactgctattttgcaagtaagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaattcctttcagattaaggccagtattcagtaatcagttcctcctggagaatgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgatgaaagtaagtgcaacggatgcagacagtgggcctaatgctgagatcaattacctgctaggccctgatgctccacctgaattcagcctggatcgtcgtacaggcatgctgactgtagtgaagaaactagatagagaaaaagaggataaatatttattcacaattctggcaaaagataatggggtaccacccttaaccagcaatgtcacagtctttgtaagcattattgatcagaatgacaatagcccagttttcactcacaatgaatacaaattctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttacaactattcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcagtgaccaatgctacactgattaatgaactggtgcgcaaaagcattgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacatgcagaattctgaatgggctaccccaaacccagaaaacaggcagatgataatgatgaagaaaaagaaaaagaagaagaagcattcccctaagaacctgctgcttaatgttgtcactattgaagaaactaaggcagatgatgttgacagtgatggaaacagagtcacactagaccttcctattgatctagaagagcaaacaatgggaaagtacaattgggtaactacacctactactttcaagcctgacagccctgatttggcccgacactacaaatctgcctctccacagcctgccttccaaattcagcctgaaactcccctgaatttgaagcaccacatcatccaagaactgcctctcgataacacctttgtggcctgtgactctatctccaattgttcctcaagcagttcagatccctacagcgtttctgactgtggctatccagtgacaaccttcgaggtacctgtgtccgtacacaccagaccgtcccagcggcgtgtcacatttcacctgccagaaggctctcaggaaagcagcagtgatggtggactgggagaccatgatgcaggcagccttaccagcacatcccatggcctgccccttggctatcctcaggaggagtactttgatcgtgctacacccagcaatcgcactgaaggggatggcaactccgatcctgaatctactttcatacctggactaaagaaagaaataactgttcaaccaactgtggaagaggcctctgacaactgcactcaagaatgtctcatctatggccattctgatgcctgctggatgccggcatctctggatcattccagctcttcacaagcacaggcctctgctctatgccacagcccaccactgtcacaggcctctactcagcaccacagcccaccagtgacacagaccattgttctctgccacagccctccagtgacacagaccatcgcattgtgccacagcccaccaccgatacaggtgtctgctctccaccacagtcctcctctagtgcagggtactgcacttcaccacagcccaccatcagcacaggcctcagccctctgctacagccctcctttagcacaggctgctgcaatcagccacagctcttctctgccacaggttattgccctccatcgtagtcaggcccaatcatcagtcagtttgcagcaaggttgggtgcaaggtgctaatggactatgctctgttgatcagggagtgcaaggtagtgcaacatctcagttttacaccatgtctgaaagacttcatcccagtgatgattcaattaaagtcattcctttgacaaccttcgctccacgccaacaggccagaccgtccagaggtgattcccccattatggaaacacatcccttgtaaagctaaaatagttacttcaaattttcagaaaagatgtatatagtcaaaatttaagatacaattccaatgagtattctgattatcagatttgtaaataactatgtaaatagaaacagataccagaataaatctacagctagacccttagtcaatagttaaccaaaaaattgcaatttgtttaattcagaatgtgtatttaaaaagaaaaggaatttaacaatttgcatccccttgtacagtaaggcttatcatgacagagcgtactatttctgatgtacagtattttttgttgtttttatcatcatgtgcaatattactgatttgtttccatgctgattgtgtggaaccagtatgtagcaaatggaaagcctagaaatatcttattttctaagtttacctttagtttacctaaacttttgttcagataatgttaaaaggtatacgtactctagccttttttggggctttctttttgatttttgtttgtggttttcagtttttttgttgttgttagtgagtctcccttcaaaatacacagtaggtagtgtaaatactgcttgtttgtgtctctctgctgtcatgttttctaccttattccaatactatattgttgataaaatttgtatatacattttcaataaagaatatgtataaactgtacagatctagatctacaacctatttctctactctttagtagagttcgagacacagaagtgcaataactgccctaattaagcaactatttgttaaaaagggcccctttttactttaatagtttagtgtaaagtacatcagaaataaaactgtatctgacattttaagcctgtagtccattattacttgggtctttacttctgggaatttgtatgtaacagcctagaaaattaaaaggaggtggatgcatccaaagcacgagtcacttaaaatatcgacggtaaactactattttgtagagaaactcaggaagatttaaatgttgatttgacagctcaataggctgttaccaaagggtgttcagtaaaaataacaaatacatgtaactgtagataaaaccacatactaaatctataagactaagggatttttgttattctagctcaacttactgaagaaaaccactaataacaacaagaatatcaggaaggaacttttcaagaaatgtaattataaatctacatcaaacagaattttaaggaaaaatgcagagggagaaataaggcacatgactgcttcttgcagtcaagaagaaataccaataacacacacagaacaaaaaccatcaaaatctcatatatgaaataaaatatattcttctaagcaaagaaacagtactattcatagaaaacattagttttctcctgttgtctgttatttccttcttttatcctcttaactggccattatcttgtatgtgcacattttataaatgtacagaaacatcaccaacttgattttcttccatagcaaaactgagaaaataccttgtttcagtataacactaaaccaagagacaattgatgtttaatgggggcggttggggttgggggggagtcaatatctcctattgattaacttagacatagattttgtaatgtataacttgatatttaatttatgattaaactgtaattttgtaacataaactgtggtaattgcataatttcattggtgaggatttcctttgaatattgagaaagtttcttttcatgtgcccagcaggttaagtagcgttttcagaatatacattattcccatccattgtaaagttccttaagtcatatttgactgggcgtgcagaataacttcttaactattaactatcagagtttgattaataaaattaattaattttttttctccttcgtgttgttaatgttccaagggatttggagcatactggttttccaggtgcatgtgaatcccgaaggactgatgatatttgaatgtttattaaattattatcacacaaatgtgttgatattgtggctattgttgatgttgaaaattgtaaacttggggaagattaagaaaagaaccaatagtgacaaaaatcagtgcttccagtagattttagaacattctttgcctcaaaaaacctgcaaagatgatgtgagattttttcttgtgttttaattattttcacattttctctctgcaaacctttagttttctgatgatctacacacacacatacacacacacacacacacacgtgcacacacacacatttaaaggatataaaaagaagaggttgaaagattattaaataacttatcaggcatctcaatggttactatctatgttagtgaaaatcaaataggactcaaagttggatatttgggatttttcttctgacagtataatttattgagttactagggaggttcttaaatcctcatatctggaaacttgtgaagttttgacacctttcctatagatataggaatgaaccaatacgcttttattaccctttctaactctgattttataatcagacttagattgtgtttagaatattaaatgactgggcaccctcttcttggtttttaccagagaggctttgaatggaagcaggctgagagtagccaaagaggcaaggggtattagcccagttattctcccctatgccttctcttcctaagcgtccactaggtctggccttggaaatctgttacttctacggcttcagatctgatgatatctttttcatcacattacaagttatttctttgactgaatagacagtggtataggttgacacagcacacaagtggctattgtgatgtatgatgtatgtagtcccacaactgcaaaacgtcttactgaagcaacaatcgaaaaatggttctgttttaaaaaggattttgtttgatttgaaattaaaacttcaaactgaatgacttatatgagaataatatgttcaatcaaagtagttattctattttgtgtccatattccattagattgtgattattaattttctagctatggtattactatatcacacttgtgagtatgtattcaaatactaagtatcttatatgctacgtgcatacacattcttttcttaaactttacctgtgttttaactaatattgtgtcagtgtattaaaaattagcttttacatatgatatctacaatgtaataaatttagagagtaattttgtgtattcttatttacttaacattttacttttaattatgtaaatttggttagaaaataataataaatggttagtgctattgtgtaatggtagcagttacaaagagcctctgccttcccaaactaatatttatcacacatggtcattaaatgggaaaaaaatagactaaacaaatcacaaattgttcagttcttaaaatgtaattatgtcacacacacaaaaaaatccttttcaatcctgagaaaattaaaggtgttttactcacatggatatttcaacattagttttttttgtttgtttctttttcatggtattactgaaggtgtgtatactccctaatacacatttatgaaaatctacttgtttagacttttatttatactcttctgatttatattttttattataattattatttcttatcttcttttatattttttggaaaccaaatttatagttagtttaggtaaactttttattatgaccattagaaactattttgaatgtttccaactggctcaattggctgggaaaacatgggaacaagagaagctgaaatatatttctgcaagaacctttctatattatgtgccaattaccacaccagatcaattttatgcagaggccttaaaatattctttcacagtagctttcttacactaaccgtcatgtgcttttagtaaatatgatttttaaaagcagttcaagttgacaacagcagaaacagtaacaaaaaaatctgctcagaaaaatgtatgtgcacaaataaaaaaaattaatggcaattgtttagtgactgtaagtgatactttttaaagagtaaactgtgtgaaatttatactatccctgcttaaaatattaagatttttatgaaatatgtatttatgtttgtattgtgggaagattcctcctctgtgatatcatacagcatctgaaagtgaacagtatcccaaagcagttccaagcatgctttggaagtaagaaggttgactattgtatggccaaggatggcagtatgtaatccagaagcaaacttgtattaattgttctatttcaggttctgtattgcatgttttcttattaatatatattaataaaagttatgagaaataaa

SEQ ID NO: 172065 - DNA, 536 bp, Homo sapiens
  Payload ID: 13802
  Gene Symbol: PCDH11Y
  Gene Name: protocadherin 11 Y-linked
  ENST ID: ENST00000621505
  CDS Start-End: 305-536
agtgccagcggcgacacaggcagcacaggcagcccgggctgcctgaatagcctcagaaacaacctcagcgactccggctgctctgcggactgcgagctgtggcggtagagcccgctacagcagtcgcagtctccgtggagcgggcggaagccttttttctccctttcgtttacctcttcattctactctaaaggcatcgttattagttcatcatagagagagcgcggaccgtgtgcgggccgtcttgacgaaagaaccgagagatggatgcgctaagctgattgcagtgcactatgaggactgaatgacagtgggttttaattcagatatttcaagtgttgtgcgggttaatacaacaaactgtcacaagtgtttgttgtccgggacgtacattttcgcggtcctgctagtatgcgtggtgttccactctggcgcccaggagaaaaactacaccatccgagaagaaattccagaaaacgtcctgataggcaacttgttgaaagaccttaacttgtcgctgattccaaacaagtcct

SEQ ID NO: 172066 - DNA, 4824 bp, Homo sapiens
  Payload ID: 13802
  Gene Symbol: PCDH11Y
  Gene Name: protocadherin 11 Y-linked
  Uniprot ID: Q9BZA8
  ENST ID: ENST00000622698
  CDS Start-End: 613-3726
gcagtcggcgaactgtctgggcgggaggagccgtgagcagtagctgcactcagctgcccgcgcggcaaagaggaaggcaagccaaacagagtgcgcagagtggcagtgccagcggcgacacaggcagcacaggcagcccgggctgcctgaatagcctcagaaacaacctcagcgactccggctgctctgcggactgcgagctgtggcggtagagcccgctacagcagtcgcagtctccgtggagcgggcggaagccttttttctccctttcgtttacctcttcattctactctaaaggcatcgttattagagggtgcttaaaaagtacagatcaactggatggatgaatggatggaagaggatggaatatcttaacaaaacacattttccttaagtaaattcatgcatactccaaataaaatacagaatgtgaagtatctctgaactgtgctgttgaatatggtagctactagctacatgaaaatcctgttgtgaataagaaggattccacagatcacataccagagcggttttgcctcagctgctctcaactttgtaatcttgtgaagaagctgacaagcttggctgattgcagtgcactatgaggactgaatgacagtgggttttaattcagatatttcaagtgttgtgcgggttaatacaacaaactgtcacaagtgtttgttgtccgggacgtacattttcgcggtcctgctagtatgcgtggtgttccactctggcgcccaggagaaaaactacaccatccgagaagaaattccagaaaacgtcctgataggcaacttgttgaaagaccttaacttgtcgctgattccaaacaagtccttgacaactactatgcagttcaagctagtgtacaagaccggagatgtgccactgattcgaattgaagaggatactggtgagatcttcactaccggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggcataaacggagttcaaaactacgaactaattaagagtcaaaacatttttggcctcgatgtcattgaaacaccagaaggagacaagatgccacaactgattgttcaaaaggagttagatagggaagagaaggatacctatgtgatgaaagtaaaggttgaagatggtggctttcctcaaagatccagtactgctattttgcaagtaagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaattcctttcagattaaggccagtattcagtaatcagttcctcctggagaatgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgatgaaagtaagtgcaacggatgcagacagtgggcctaatgctgagatcaattacctgctaggccctgatgctccacctgaattcagcctggatcgtcgtacaggcatgctgactgtagtgaagaaactagatagagaaaaagaggataaatatttattcacaattctggcaaaagataatggggtaccacccttaaccagcaatgtcacagtctttgtaagcattattgatcagaatgacaatagcccagttttcactcacaatgaatacaaattctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttacaactattcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcagtgaccaatgctacactgattaatgaactggtgcgcaaaagcattgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacatgcagaattctgaatgggctaccccaaacccagaaaacaggcagatgataatgatgaagaaaaagaaaaagaagaagaagcattcccctaagaacctgctgcttaatgttgtcactattgaagaaactaaggcagatgatgttgacagtgatggaaacagagtcacactagaccttcctattgatctagaagagcaaacaatgggaaagtacaattgggtaactacacctactactttcaagcctgacagccctgatttggcccgacactacaaatctgcctctccacagcctgccttccaaattcagcctgaaactcccctgaatttgaagcaccacatcatccaagaactgcctctcgataacacctttgtggcctgtgactctatctccaattgttcctcaagcagttcagatccctacagcgtttctgactgtggctatccagtgacaaccttcgaggtacctgtgtccgtacacaccagaccgactgattccaggacatgaactattgaaatctgcagtgagatgtaactttctaggaacaacaaaattccattccccttccaaaaaatttcaatgattgtgatttcaaaattaggctaagatcattaattttgtaatctagatttcccattataaaagcaagcaaaaatcatcttaaaaatgatgtcctagtgaaccttgtgctttctttagctgtaatctggcaatggaaatttaaaatttatggaagagacagtgcagcgcaataacagagtactctcatgctgtttctctgtttgctctgaatcaacagccatgatgtaatataaggctgtcttggtgtatacacttatggttaatatatcagtcatgaaacatgcaattacttgccctgtctgattgttgaataattaaaacattatctccaggagtttggaagtgagctgaactagccaaactactctctgaaaggtatccagggcaagagacatttttaagaccccaaacaaacaaaaaacaaaaccaaaacactctggttcagtgttttgaaaatattgactaacataatattgctgagaaaatcatttttattacccaccactctgcttaaaagttgagtgggccgggcgcggtggctcacgcctgtaattccagcactttgggaggccgaggcgggtggatcacgaggtcaggatattgagaccatcctggctaacatggtgaaaccccatctccactaaaaatacaaaaaattagctgggcgtggtggcgggcgcctgtagtcccagctactcgggaggctgaggcaggagaatggcgtgaacccgggaggcggagcttgcagtgagccgagatggcgccactgcactccagcctgggtgacagagcaagactctgtctcaaaaagaaaaaaatgttcagtgatagaaaataattttactaggtttttatgttgattgtactcatgctgttccactccttttaattattaaaaagttatttttggctgggtgtggtggctcatacctgtaatcccagcactttgggaggccgaggcgggtggatcacctgaggtcaggagttcaagaccagtctggccaacatggcgaaaccccgtct

SEQ ID NO: 172067 - DNA, 6562 bp, Homo sapiens
  Payload ID: 13803
  Gene Symbol: PCDH12
  Gene Name: protocadherin 12
  Uniprot ID: Q9NPG4
  ENST ID: ENST00000231484
  CDS Start-End: 1212-4766
gggaagcgggaggagagccacacggtcaagttgcacaggttcttgcagcttctggaatcaagaccatgggcaccctcataagtcagtgtgggcagggactgccccagggccaatccaagatccagaggtagccatagggtgtgacaagttgtgcagattacaacactcaccccttgcaataacgtcactgcctgtgactcggggccaggcccaggccaaagcccttcctacatcatttcgtttaatcctcacagtttcctgctgaaagggctactattcttactcccatccccactctacagatgaggtaatggaggcccaggaaagttaagtgacttgtcccagatgacaccgctggtaagttgcaaagtcagaatttgaactcaggcagtttacctctgatggctgctctgttaatcacagctgctttccagtgagacaaaaacgggtgatcagggcagagtcaagacagagaggtaaacaagattgggaaaaagacaggaatgagaggggaacaatgggggaaaagataggaacaaagagagttggggaaggggagagaaacaggaaacatgacttgcccgggaggggcatcagtccacgtgcaagcaggtggaggctcaagttttctgctcacttggtgatgcagaggctccctttccctcagcagccgccttgctgcgtggacagcagcttcccatctggcctgtccccggagccccggcctcatcctcctcagcggcaggccacttagcttcacaggaaatgctctttctctaattggcattgaaactcacagccctcccttttcctgtaggtggggtttccataggaaaaagctgcttctctgtttccccagcctagcaactgtttggcagtcagagtcccacatcctgctcaactgggtcaggtccctcttagaccagctcttgtccatcatttgctgaagtggaccaactagttccccagtagggggtctcccctggcaattcttgatcggcgtttggacatctcagatcgcttccaatgaagatggccttgccttggggtcctgcttgtttcataatcatctaactatgggacaaggttgtgccggcagctctgggggaaggagcacggggctgatcaagccatccaggaaacactggaggacttgtccagccttgaaagaactctagtggtttctgaatctagcccacttggcggtaagcatgatgcaacttctgcaacttctgctggggcttttggggccaggtggctacttatttcttttaggggattgtcaggaggtgaccactctcacggtgaaataccaagtgtcagaggaagtgccatctggtacagtgatcgggaagctgtcccaggaactgggccgggaggagaggcggaggcaagctggggctgccttccaggtgttgcagctgcctcaggcgctccccattcaggtggactctgaggaaggcttgctcagcacaggcaggcggctggatcgagagcagctgtgccgacagtgggatccctgcctggtttcctttgatgtgcttgccacaggggatttggctctgatccatgtggagatccaagtgctggacatcaatgaccaccagccacggtttcccaaaggcgagcaggagctggaaatctctgagagcgcctctctgcgaacccggatccccctggacagagctcttgacccagacacaggccctaacaccctgcacacctacactctgtctcccagtgagcactttgccttggatgtcattgtgggccctgatgagaccaaacatgcagaactcatagtggtgaaggagctggacagggaaatccattcattttttgatctggtgttaactgcctatgacaatgggaacccccccaagtcaggtaccagcttggtcaaggtcaacgtcttggactccaatgacaatagccctgcgtttgctgagagttcactggcactggaaatccaagaagatgctgcacctggtacgcttctcataaaactgaccgccacagaccctgaccaaggccccaatggggaggtggagttcttcctcagtaagcacatgcctccagaggtgctggacaccttcagtattgatgccaagacaggccaggtcattctgcgtcgacctctagactatgaaaagaaccctgcctacgaggtggatgttcaggcaagggacctgggtcccaatcctatcccagcccattgcaaagttctcatcaaggttctggatgtcaatgacaacatcccaagcatccacgtcacatgggcctcccagccatcactggtgtcagaagctcttcccaaggacagttttattgctcttgtcatggcagatgacttggattcaggacacaatggtttggtccactgctggctgagccaagagctgggccacttcaggctgaaaagaactaatggcaacacatacatgttgctaaccaatgccacactggacagagagcagtggcccaaatataccctcactctgttagcccaagaccaaggactccagcccttatcagccaagaaacagctcagcattcagatcagtgacatcaacgacaatgcacctgtgtttgagaaaagcaggtatgaagtctccacgcgggaaaacaacttaccctctcttcacctcattaccatcaaggctcatgatgcagacttgggcattaatggaaaagtctcataccgcatccaggactccccagttgctcacttagtagctattgactccaacacaggagaggtcactgctcagaggtcactgaactatgaagagatggccggctttgagttccaggtgatcgcagaggacagcgggcaacccatgcttgcatccagtgtctctgtgtgggtcagcctcttggatgccaatgataatgccccagaggtggtccagcctgtgctcagcgatggaaaagccagcctctccgtgcttgtgaatgcctccacaggccacctgctggtgcccatcgagactcccaatggcttgggcccagcgggcactgacacacctccactggccactcacagctcccggccattccttttgacaaccattgtggcaagagatgcagactcgggggcaaatggagagcccctctacagcatccgcagtggaaatgaagcccacctcttcatcctcaaccctcatacggggcagctgttcgtcaatgtcaccaatgccagcagcctcattgggagtgagtgggagctggagatagtagtagaggaccagggaagcccccccttacagacccgagccctgttgagggtcatgtttgtcaccagtgtggaccacctgagggactcagcccgcaagcctggggccttgagcatgtcgatgctgacggtgatctgcctggctgtactgttgggcatcttcgggttgatcctggctttgttcatgtccatctgccggacagaaaagaaggacaacagggcctacaactgtcgggaggccgagtccacctaccgccagcagcccaagaggccccagaaacacattcagaaggcagacatccacctcgtgcctgtgctcaggggtcaggcaggtgagccttgtgaagtcgggcagtcccacaaagatgtggacaaggaggcgatgatggaagcaggctgggacccctgcctgcaggcccccttccacctcaccccgaccctgtacaggacgctgcgtaatcaaggcaaccagggagcaccggcggagagccgagaggtgctgcaagacacggtcaacctccttttcaaccatcccaggcagaggaatgcctcccgggagaacctgaaccttcccgagccccagcctgccacaggccagccacgttccaggcctctgaaggttgcaggcagccccacagggaggctggctggagaccagggcagtgaggaagccccacagaggccaccagcctcctctgcaaccctgagacggcagcgacatctcaatggcaaagtgtcccctgagaaagaatcagggccccgtcagatcctgcggagcctggtccggctgtctgtggctgccttcgccgagcggaaccccgtggaggagctcactgtggattctcctcctgttcagcaaatctcccagctgctgtccttgctgcatcagggccaattccagcccaaaccaaaccaccgaggaaataagtacttggccaagccaggaggcagcaggagtgcaatcccagacacagatggcccaagtgcaagggctggaggccagacagacccagaacaggaggaagggcctttggatcctgaagaggacctctctgtgaagcaactgctagaagaagagctgtcaagtctgctggaccccagcacaggtctggccctggaccggctgagcgcccctgacccggcctggatggcgagactctctttgcccctcaccaccaactaccgtgacaatgtgatctccccggatgctgcagccacggaggagccaaggaccttccagacgttcggcaaggcagaggcaccagagctgagcccaacaggcacgaggctggccagcacctttgtctcggagatgagctcactgctggagatgctgctggaacagcgctccagcatgcccgtggaggccgcctccgaggcgctgcggcggctctcggtctgcgggaggaccctcagtttagacttggccaccagtgcagcctcaggcatgaaagtgcaaggggacccaggtggaaagacggggactgagggcaagagcagaggcagcagcagcagcagcaggtgcctgtgaacatacctcagacgcctctggatccaagaaccaggggcctgaggatctgtggacaagagctggtttctaaaatcttgtaactcactagctagcggcggcctgagaactttagggtgactgatgctacccccacagaggaggcaagagccccaggactaacagctgactgaccaaagcagccccttgtaagcagctctgagtcttttggaggacagggacggtttgtggctgagataagtgtttcctggcaaaacatatgtggagcacaaagggtcagtcctctggcagaacagatgccacggagtatcacaggcaggaaagggtggccttcttgggtagcaggagtcagggggctgtaccctgggggtgccaggaaatgctctctgacctatcaataaaggaaaagcagtgattcattctcctgtttgcacctgtcaagagggagaagggaagagtaatagagtggggtttatttgtcatccaatccctggcaagaccgtcacactgggcctggacaggagtggggcaccttggtacacagtaacaggtacacaaatagcagacatgtgtgctcttacccctgttcccctatcactatgttaccaactaatctgcttctcagctgcaaaattagagctaagaaagcacaactatttataaagcatttacatgagccaggcaccaggctttacaataggatttaatttgattttccaacaatcctgggagggaggtattattaaccccatttcacagacacggatatggggcttggagaggtcaagtggctttcccaagatcaagcagggagtagagccagagccaggatttggacccaggctgggccaacaccaaaacccatgccttcaaccttgacaccagcctgccaaccaaagacaggagaagggaaggccctggaggtgagctgttggcagcagtgaacttgctcgagctccctcgggaaacactgttgaaaggaacatttccaaagccatccaggcccgcacctctctacattcccaagcacaaggcaaaaggaacttggatctgaactgatgcagacccgttctttcccaacaagtagctcttcaagtgcggatgtcatctttcccaaccccatttgcgggtaaaccttcctctgtcattgcaggttcaggcttgtgaatcccagaggacgctgtgtgaactgggtctatgaaatcggcactgacagcagccagccttccaggggatgggggagggaagaaacagcagatattttcccaaggttcagctttataattttcttggaaatttccgagcagccaatcagctagcttctaaatagtgtgggtctctcctggacactgcaggcaaaagttcctctatctgctcctctttttgtcctttcttggagctcagtgctcatgttcactgttcaagaaatgggccaatcatactcccaactagggataatgtgcatcatacatacttggaatacagtgtggtatcattattccattttacagatgaagaaaatgaggctccccaaagttatgagtttcaggggcagagtttctcctcacctcactctaggccagagtgatctccttacagaatctgtgattttcaggctggatcacagaactgttgggttctgtgggccagtgagagaaactgggggatatcaagcaggcaggcagggtctccagcctgaccagccaggtgcctgctacaaagcaacacttgatgaatagctgttgaatggatgtatgaatgaataaatgtgtcaataaatgcttcagaggcccctttta

SEQ ID NO: 172068 - DNA, 572 bp, Homo sapiens
  Payload ID: 13803
  Gene Symbol: PCDH12
  Gene Name: protocadherin 12
  ENST ID: ENST00000510041
  CDS Start-End: 502-572
acagtttcctgctgaaagggctactattcttactcccatccccactctacagatgaggtaatggaggcccaggaaagttaagtgacttgtcccagatgacaccgctggtggggtttccataggaaaaagctgcttctctgtttccccagcctagcaactgtttggcagtcagagtcccacatcctgctcaactgggtcaggtccctcttagaccagctcttgtccatcatttgctgaagtggaccaactagttccccagtagggggtctcccctggcaattcttgatcggcgtttggacatctcagatcgcttccaatgaagatggccttgccttggggtcctgcttgtttcataatcatctaactatgggacaaggttgtgccggcagctctgggggaaggagcacggggctgatcaagccatccaggaaacactggaggacttgtccagccttgaaagaactctagtggtttctgaatctagcccacttggcggtaagcatgatgcaacttctgcaacttctgctggggcttttggggccaggtggctacttatttcttttaggggattg

SEQ ID NO: 172069 - DNA, 8232 bp, Homo sapiens
  Payload ID: 13804
  Gene Symbol: PCDH17
  Gene Name: protocadherin 17
  Uniprot ID: O14917
  ENST ID: ENST00000377918
  CDS Start-End: 736-4215
agatgcagtccgccgccgccgctgcctcagccagcaatgcaagattagatctctaaatgcagcaaaacactgcctgaaaacagaccggcccgcgcagcaagcagacatttcacggtgcgctggggaagcttcaaaatatatctgtgactctgtcttcgttgctcttcatccccatcaatttcatcacgggaggcgagcagcaagtaagaatttcactttcggatctgcctagagacacacctccctgctccctcccccactcgatgtgaagagtattccggagtctccgggcgggagtagatttgcagcaccctagcgggagcgaggaaaacctactgattctttagctcattatcatctctcccagacgagatttccttcttatcgcctgcctcatcgctcaagtttgagcctcccgaagtccgggcgggagagacgaaacccctggctcacccccagccgcaggaagccaccgccttgctccaagcccctgcagctctgctgcaccgcagcttctcacccagtgcggatgctgtagatcaacaggttcagggaacttgagcagaataaggagagaccaccgggtgccgcagctcgggtgcagagggaaaaaaggacccatagacttgtggctcgcgtcgcgcgcgcacgctgcgccagggccccaggctggcgcgcactccctctctggctcctccagtccgattgctcctgcccccaccttacaggtctgggatgtacctttccatctgttgctgctttcttctatgggcccctgccctcactctcaagaacctcaactactccgtgccggaggagcaaggggccggcacggtgatcgggaacatcggcagggatgctcgactgcagcctgggcttccgcctgcagagcgcggcggcggagggcgcagcaagtcgggtagctaccgggtgctggagaactccgcaccgcacctgctggacgtggacgcagacagcgggctcctctacaccaagcagcgcatcgaccgcgagtccctgtgccgccacaatgccaagtgccagctgtccctcgaggtgttcgccaacgacaaggagatctgcatgatcaaggtagagatccaggacatcaacgacaacgcgccctccttctcctcggaccagatcgaaatggacatctcggagaacgctgctccgggcacccgcttccccctcaccagcgcacatgaccccgacgccggcgagaatgggctccgcacctacctgctcacgcgcgacgatcacggcctctttggactggacgttaagtcccgcggcgacggcaccaagttcccagaactggtcatccagaaggctctggaccgcgagcaacagaatcaccatacgctcgtgctgactgccctggacggtggcgagcctccacgttccgccaccgtacagatcaacgtgaaggtgattgactccaacgacaacagcccggtcttcgaggcgccatcctacttggtggaactgcccgagaacgctccgctgggtacagtggtcatcgatctgaacgccaccgacgccgatgaaggtcccaatggtgaagtgctctactctttcagcagctacgtgcctgaccgcgtgcgggagctcttctccatcgaccccaagaccggcctaatccgtgtgaagggcaatctggactatgaggaaaacgggatgctggagattgacgtgcaggcccgagacctggggcctaaccctatcccagcccactgcaaagtcacggtcaagctcatcgaccgcaacgacaatgcgccgtccatcggtttcgtctccgtgcgccagggggcgctgagcgaggccgcccctcccggcaccgtcatcgccctggtgcgggtcactgaccgggactctggcaagaacggacagctgcagtgtcgggtcctaggcggaggagggacgggcggcggcgggggcctgggcgggcccgggggttccgtccccttcaagcttgaggagaactacgacaacttctacacggtggtgactgaccgcccgctggaccgcgagacacaagacgagtacaacgtgaccatcgtggcgcgggacgggggctctcctcccctcaactccaccaagtcgttcgcgatcaagattctagacgagaacgacaacccgcctcggttcaccaaagggctctacgtgcttcaggtgcacgagaacaacatcccgggagagtacctgggctctgtgctcgcccaggatcccgacctgggccagaacggcaccgtatcctactctatcctgccctcgcacatcggcgacgtgtctatctacacctatgtgtctgtgaatcccacgaacggggccatctacgccctgcgctcctttaacttcgagcagaccaaggcttttgagttcaaggtgcttgctaaggactcgggggcgcccgcgcacttggagagcaacgccacggtgagggtgacagtgctagacgtgaatgacaacgcgccagtgatcgtgctccccacgctgcagaacgacaccgcggagctgcaggtgccgcgcaacgctggcctgggctatctggtgagcactgtgcgcgccctagacagcgacttcggcgagagcgggcgtctcacctacgagatcgtggacggcaacgacgaccacctgtttgagatcgacccgtccagcggcgagatccgcacgctgcaccctttctgggaggacgtgacgcccgtggtggagctggtggtgaaggtgaccgaccacggcaagcctaccctgtccgcagtggccaagctcatcatccgctcggtgagcggatcccttcccgagggggtaccacgggtgaatggcgagcagcaccactgggacatgtcgctgccgctcatcgtgactctgagcactatctccatcatcctcctagcggccatgatcaccatcgccgtcaagtgcaagcgcgagaacaaggagatccgcacttacaactgccgcatcgccgagtacagccacccgcagctgggtgggggcaagggcaagaagaagaagatcaacaaaaatgatatcatgctggtgcagagcgaagtggaggagaggaacgccatgaacgtcatgaacgtggtgagcagcccctccctggccacctcccccatgtacttcgactaccagacccgcctgcccctcagctcgccccggtcggaggtgatgtatctcaaaccggcctccaacaacctgactgtccctcaggggcacgcgggctgccacaccagcttcaccggacaagggactaatgcaagcgagacccctgccactcggatgtccataattcagacagacaattttcccgcagagcccaattacatgggcagcaggcagcagtttgttcaaagtagctccacgtttaaggacccagaaagagccagcctgagagacagtgggcacggggacagtgatcaggctgacagtgaccaagacactaacaaaggctcctgctgtgacatgtctgttagggaggcactcaagatgaaaactacttcaactaaaagccaaccacttgaacaagaaccagaagagtgtgttaattgcacagatgaatgccgagtgcttggtcattctgacaggtgctggatgccacagttccctgcagccaatcaggctgaaaatgcagattaccgcacaaatctctttgtacctacagttgaagctaatgttgagactgagacttacgaaactgtgaatcccactgggaaaaagactttttgtacatttggaaaagacaagcgagagcacactattctcattgccaacgttaaaccttatttaaaagccaaacgtgccctgagccctctcctccaagaggtcccctcagcatcaagcagcccaaccaaggcgtgcatcgagccttgcacctcaacaaaaggctccctggatggctgtgaagcaaaaccaggagccctggctgaagcaagcagtcagtacttgcccactgacagtcaatatctgtcacctagtaagcaaccaagagaccctcccttcatggcttccgatcagatggcaagggtctttgcagatgtgcattccagagccagccgggattccagtgagatgggtgctgttcttgagcagcttgaccaccccaacagggatctgggcagagagtctgtggatgcagaggaagttgtgagagaaattgataagcttttgcaagactgccggggaaacgaccctgtggctgtgagaaagtgaaaaaagaaaaaaaaaaaggcattggcattttcttgtctcttctgttgatttaaaaatgatccctcctggtgataacccattttacagggatgaagaaagaccaatgctgctttaaggcttttagtgaacatctgaagtgcccacaagtatgttctttccactgctgatttctttttcagagataacaatggtttcgttttgaccaaacttgtattaggacagaattaatgatgcttaaagagaaaagaaaaaaagagagaagaaaaaggagagatgaaaaaggaggatgaggagaagaattaccttttgacaatctgttaggaaggtatgcagtgtgagaactgaagtatttctgatcactctcagactgtcctccgtgatttatgctgacttaactgtttacctataaaccccatacaaagcagggtcataatttgtgatctgtggtggatttctagcagtcatcacaggcttctactgaaagtcctgaaaagaccttgcagtagtccaagctacaccaaacattaacacatatttgtggtaaacatttctgtataaagttacctgacacacatataaacacaaggaacattccatatcattagtcgaaaacaaaaacaaaaaaaaaacctttggtcatttgtaagacatctcatgtcatataaaagttaaatgtaaaaagatacagtccattttgtcctgcacacacgtagactaattcacgtcattaaagaagaagaaaacttaaagatttaaaatgcctatttagcattttagtgtccaacaaagatttaaacaatgatgaatatgttttaaatttgacatagaaaagttctaaaaaatagttaccattgagtggtaagattcagagaaaattaacttgattaatatgttttattcatttgtggacactaaaatagctcaggaaagtgaaaatgtcttagacatacgcaagtcacatgaccatttaaatgtgcaaatgtaagaagattcaatgtgtttacatcaaatgacatattttattgatttattgcagattcagtgcatatgagccaaattgttgagtgtgtaagagctatattgtgtattttattaaattaatatatagttgtgttgcaaaaatatttgggcttatattgtaaatggcaagtgttgccttggtagctgtcgaactctatgagttttgttttttcctgcttccttttccccatggagtgtgggaagcagtgcctcagagcaaagtctcttgtttaatgtatagtctaccaagtactacagtacataatctgttcaaaatgtgtttgagtgagctgatggagctaactgaaaggtcaaaaattacatccatcagtcatggttatgtgcaagtccttgtagaagcttttattaaagtcatgctaaatcacaagaattgacatttgtaccaatatctgaaacttcttcatgttttttcaataacatacagcttctgcctgtgtagatattatgccatcagttggttctcaaaagtattttaagtgcttcagatgtgtgttcccattatattttgaaaacatgaaaaatgctttaatgcatgtatgtaccagcagtggttacttgcattgtgtagtgtttttcaagaggtctgggtcttaacaaaatgttttcctttatctcagtgctcttctgcctctttttgttggtgtcctttgagaacaatacaccttctattccttcatttggttacacctttccttgtgacatttagcgagtttcaaacttacttccatatgaggctaagaaacctcaaatttcaggaattgggaaaaataaaattagcacttgcagaagtagcagcagatgggaaaatgccttgattgacattttctttcagcatttaaaatttttggcattttacagcttcatgacaaacagttttgtgcccataccttagaaaatgtggtgctgagttaaataaaggctgtttgagcactggagcagaaaaatgcattatttgcaaactggtggataattttgtgccttctcttctggccaccaagccagtgtagaaacagcaaaaatgtcataaaaattcttatatttaaaacaaaaacaaaagcaaaaacaaacattgaattaaattaagttttgtaattttaaactttaaaaacttctactgaaaatatttccgccaaatgccatcaatattttagactgtacctcgtttgcaaaactgctttgagagggaagagtggacaactcccatcagccttattctcttgagaactatattttggttcctagtaacagcctttccaaagctctactcttggtttttattactcataaatgtttaaattagaaaagaagggaccttgtacatgtgaaacctaattgactctctatattttggacaatttatgtatctgaaatgtgttgtctctgttatatgatgttatttttgccaggagactacaggttgatttagcttgatagctgaaatttgatggaaaactgatttccatttagtcttaccaagtgttgcttctctcttactagacagatatccacttagtaaaatctaaagcagtatgtaaatgaaaccagcaaagagagtagggtttattttataaacattcttaatgctaagtaaccagttgttcaatttattatatgtgtctgaggacattaaaacaccataaggttgtaataattggttgtgccaatgtgtgagggatttacctttaggctctctgtcaccagtgatttactagtgttagctgtttaacacattatctgtatttagtagtgattatttatttacaagttggtggtaattcagcagtcaggactctaagcttttatagttgaattgaggaaatctcgcttttattcatttagctggcaactgcctttattgcagacctctggtgcttggctttcaaggaagcctatgagatgccaaaatcacacctttagagagcaccttgctctaataggtgatgcatgagcaaacagtgagatttgaaggggttttaacataatttagaatgtgaaaaaaatatcaattcatatctttcaagtactaacccctcaaaaaagcccacacatacaaaatatgtgatgtgataccactttgtcttttaggtctttaagtaactgaagttaagcacagaaaaaaaaatcacttcatggaaatttcagtaagaaacccaaacttctaaaaattgcttgcagatgagctaaaaaaaaaaaaaaaaaaaaaaagcaacaaaataaccttttcatcagagttaaaagtagtgagaatctgttagttatacgtataccaaagtaaacattaaagagacatatcatgcaatttcaaagaattctttcatgctatttcttaacctgacatttctaactttattgcaggcaatatacaaagattggctcactactccataggttaattgaattcctggttgagaaactaacttgttttgttttccaaaattagctgaaatcttgtaaaacatgacttccctttaaaggatctagatattgttcaatttaaaatatggcaccataaaaaagtcatgtagtaatagagcatatgcttttttagaaccaggttaaaagctgtttgttatctaatagagtaaaagttactgaggtcaacagatagacaggtctggcataatatatgcccagtcataatagtctaattatattcttttgacaacagacagcattcatcagagcactaattcgaatgagagttttggctatcaagatgtgttgattctaaatattattgaatgagacctgattaaagtctgactttcctggccccagtgttttgcaggttggctatttccattatcagcccatcactccataaagttcttagctgcaccaagtgattggtgaacaaggacaacaacaaaagcagcatacattgtatggatttatctcaacgctattgtttaatggctgtgtttaatgtgatctatctggaaaatgaggactccgaataaaaagctattactaata

SEQ ID NO: 172070 - DNA, 4471 bp, Homo sapiens
  Payload ID: 13804
  Gene Symbol: PCDH17
  Gene Name: protocadherin 17
  Uniprot ID: O14917
  ENST ID: ENST00000484979
  CDS Start-End: 738-3407
gtagatgcagtccgccgccgccgctgcctcagccagcaatgcaagattagatctctaaatgcagcaaaacactgcctgaaaacagaccggcccgcgcagcaagcagacatttcacggtgcgctggggaagcttcaaaatatatctgtgactctgtcttcgttgctcttcatccccatcaatttcatcacgggaggcgagcagcaagtaagaatttcactttcggatctgcctagagacacacctccctgctccctcccccactcgatgtgaagagtattccggagtctccgggcgggagtagatttgcagcaccctagcgggagcgaggaaaacctactgattctttagctcattatcatctctcccagacgagatttccttcttatcgcctgcctcatcgctcaagtttgagcctcccgaagtccgggcgggagagacgaaacccctggctcacccccagccgcaggaagccaccgccttgctccaagcccctgcagctctgctgcaccgcagcttctcacccagtgcggatgctgtagatcaacaggttcagggaacttgagcagaataaggagagaccaccgggtgccgcagctcgggtgcagagggaaaaaaggacccatagacttgtggctcgcgtcgcgcgcgcacgctgcgccagggccccaggctggcgcgcactccctctctggctcctccagtccgattgctcctgcccccaccttacaggtctgggatgtacctttccatctgttgctgctttcttctatgggcccctgccctcactctcaagaacctcaactactccgtgccggaggagcaaggggccggcacggtgatcgggaacatcggcagggatgctcgactgcagcctgggcttccgcctgcagagcgcggcggcggagggcgcagcaagtcgggtagctaccgggtgctggagaactccgcaccgcacctgctggacgtggacgcagacagcgggctcctctacaccaagcagcgcatcgaccgcgagtccctgtgccgccacaatgccaagtgccagctgtccctcgaggtgttcgccaacgacaaggagatctgcatgatcaaggtagagatccaggacatcaacgacaacgcgccctccttctcctcggaccagatcgaaatggacatctcggagaacgctgctccgggcacccgcttccccctcaccagcgcacatgaccccgacgccggcgagaatgggctccgcacctacctgctcacgcgcgacgatcacggcctctttggactggacgttaagtcccgcggcgacggcaccaagttcccagaactggtcatccagaaggctctggaccgcgagcaacagaatcaccatacgctcgtgctgactgccctggacggtggcgagcctccacgttccgccaccgtacagatcaacgtgaaggtgattgactccaacgacaacagcccggtcttcgaggcgccatcctacttggtggaactgcccgagaacgctccgctgggtacagtggtcatcgatctgaacgccaccgacgccgatgaaggtcccaatggtgaagtgctctactctttcagcagctacgtgcctgaccgcgtgcgggagctcttctccatcgaccccaagaccggcctaatccgtgtgaagggcaatctggactatgaggaaaacgggatgctggagattgacgtgcaggcccgagacctggggcctaaccctatcccagcccactgcaaagtcacggtcaagctcatcgaccgcaacgacaatgcgccgtccatcggtttcgtctccgtgcgccagggggcgctgagcgaggccgcccctcccggcaccgtcatcgccctggtgcgggtcactgaccgggactctggcaagaacggacagctgcagtgtcgggtcctaggcggaggagggacgggcggcggcgggggcctgggcgggcccgggggttccgtccccttcaagcttgaggagaactacgacaacttctacacggtggtgactgaccgcccgctggaccgcgagacacaagacgagtacaacgtgaccatcgtggcgcgggacgggggctctcctcccctcaactccaccaagtcgttcgcgatcaagattctagacgagaacgacaacccgcctcggttcaccaaagggctctacgtgcttcaggtgcacgagaacaacatcccgggagagtacctgggctctgtgctcgcccaggatcccgacctgggccagaacggcaccgtatcctactctatcctgccctcgcacatcggcgacgtgtctatctacacctatgtgtctgtgaatcccacgaacggggccatctacgccctgcgctcctttaacttcgagcagaccaaggcttttgagttcaaggtgcttgctaaggactcgggggcgcccgcgcacttggagagcaacgccacggtgagggtgacagtgctagacgtgaatgacaacgcgccagtgatcgtgctccccacgctgcagaacgacaccgcggagctgcaggtgccgcgcaacgctggcctgggctatctggtgagcactgtgcgcgccctagacagcgacttcggcgagagcgggcgtctcacctacgagatcgtggacggcaacgacgaccacctgtttgagatcgacccgtccagcggcgagatccgcacgctgcaccctttctgggaggacgtgacgcccgtggtggagctggtggtgaaggtgaccgaccacggcaagcctaccctgtccgcagtggccaagctcatcatccgctcggtgagcggatcccttcccgagggggtaccacgggtgaatggcgagcagcaccactgggacatgtcgctgccgctcatcgtgactctgagcactatctccatcatcctcctagcggccatgatcaccatcgccgtcaagtgcaagcgcgagaacaaggagatccgcacttacaactgccgcatcgccgagtacagccacccgcagctgggtgggggcaagggcaagaagaagaagatcaacaaaaatgatatcatgctggtgcagagcgaagtggaggagaggaacgccatgaacgtcatgaacgtggtgagcagcccctccctggccacctcccccatgtacttcgactaccagacccgcctgcccctcagctcgccccggtcggaggtgatgtatctcaaaccggcctccaacaacctgactgtccctcaggggcacgcgggctgccacaccagcttcaccggacaagggactaatgcaagcgagacccctgccactcggatgtccataattcagacagacaattttcccgcagagcccaattacatgggcagcaggcagcagtttgttcaaagtatttcagtagctccacgtttaaggacccagaaagagccagcctgagagacagtgggcacggggacagtgatcaggctgacagtgaccaagacactaacaaaggctcctgctgtgacatgtctgttagggaggcactcaagatgaaaactacttcaactaaaagccaaccacttgaacaagaaccagaagagtgtgttaattgcacagatgaatgccgagtgcttggtcattctgacaggtgctggatgccacagttccctgcagccaatcaggctgaaaatgcagattaccgcacaaatctctttgtacctacagttgaagctaatgttgagactgagacttacgaaactgtgaatcccactgggaaaaagactttttgtacatttggaaaagacaagcgagagcacactattctcattgccaacgttaaaccttatttaaaagccaaacgtgccctgagccctctcctccaagaggtcccctcagcatcaagcagcccaaccaaggcgtgcatcgagccttgcacctcaacaaaaggctccctggatggctgtgaagcaaaaccaggagccctggctgaagcaagcagtcagtacttgcccactgacagtcaatatctgtcacctagtaagcaaccaagagaccctcccttcatggcttccgatcagatggcaagggtctttgcagatgtgcattccagagccagccgggattccagtgagatgggtgctgttcttgagcagcttgaccaccccaacagggatctgggcagagagtctgtggatgcagaggaagttgtgagagaaattgataagcttttgcaagactgccggggaaacgaccctgtggctgtgagaaagtgaaaaaagaaaaaaaaaaaggcattggcattttcttgtctcttctgttgatttaaaaatgatccctcctggtgataacccattttacagggatgaagaaagaccaatgctgctttaaggcttttagtgaacatctgaagtgcccacaagtatgttctttccactgctgatttctttttcagagataacaatggtttcgttttgaccaaacttgtattaggacagaattaatgatgcttaaagagaaaa

SEQ ID NO: 172071 - DNA, 1640 bp, Homo sapiens
  Payload ID: 13804
  Gene Symbol: PCDH17
  Gene Name: protocadherin 17
  ENST ID: ENST00000612954
  CDS Start-End: 1-1640
ctagacagcgacttcggcgagagcgggcgtctcacctacgagatcgtggacggcaacgacgaccacctgtttgagatcgacccgtccagcggcgagatccgcacgctgcaccctttctgggaggacgtgacgcccgtggtggagctggtggtgaaggtgaccgaccacggcaagcctaccctgtccgcagtggccaagctcatcatccgctcggtgagcggatcccttcccgagggggtaccacgggtgaatggcgagcagcaccactgggacatgtcgctgccgctcatcgtgactctgagcactatctccatcatcctcctagcggccatgatcaccatcgccgtcaagtgcaagcgcgagaacaaggagatccgcacttacaactgccgcatcgccgagtacagccacccgcagctgggtgggggcaagggcaagaagaagaagatcaacaaaaatgatatcatgctggtgcagagcgaagtggaggagaggaacgccatgaacgtcatgaacgtggtgagcagcccctccctggccacctcccccatgtacttcgactaccagacccgcctgcccctcagctcgccccggtcggaggtgatgtatctcaaaccggcctccaacaacctgactgtccctcaggggcacgcgggctgccacaccagcttcaccggacaagggactaatgcaagcgagacccctgccactcggatgtccataattcagacagacaattttcccgcagagcccaattacatgggcagcaggcagcagtttgttcaaagctccacgtttaaggacccagaaagagccagcctgagagacagtgggcacggggacagtgatcaggctgacagtgaccaagacactaacaaaggctcctgctgtgacatgtctgttagggaggcactcaagatgaaaactacttcaactaaaagccaaccacttgaacaagaaccagaagagtgtgttaattgcacagatgaatgccgagtgcttggtcattctgacaggtgctggatgccacagttccctgcagccaatcaggctgaaaatgcagattaccgcacaaatctctttgtacctacagttgaagctaatgttgagactgagacttacgaaactgtgaatcccactgggaaaaagactttttgtacatttggaaaagacaagcgagagcacactattctcattgccaacgttaaaccttatttaaaagccaaacgtgccctgagccctctcctccaagaggtcccctcagcatcaagcagcccaaccaaggcgtgcatcgagccttgcacctcaacaaaaggctccctggatggctgtgaagcaaaaccaggagccctggctgaagcaagcagtcagtacttgcccactgacagtcaatatctgtcacctagtaagcaaccaagagaccctcccttcatggcttccgatcagatggcaagggtctttgcagatgtgcattccagagccagccgggattccagtgagatgggtgctgttcttgagcagcttgaccaccccaacagggatctgggcagagagtctgtggatgcagaggaagttgtgagagaaattgataagcttttgcaagactgccggggaaacgaccctgtggctgtgagaaagtg

SEQ ID NO: 172072 - DNA, 552 bp, Homo sapiens
  Payload ID: 13804
  Gene Symbol: PCDH17
  Gene Name: protocadherin 17
  ENST ID: ENST00000615375
  CDS Start-End: 1-552
ctgactgtccctcaggggcacgcgggctgccacaccagcttcaccggacaagggactaatgcaagcgagacccctgccactcggatgtccataattcagacagacaattttcccgcagagcccaattacatgggcagcaggcagcagtttgttcaaagtagctccacgtttaaggacccagaaagagccagcctgagagacagtgggcacggggacagtgatcaggctgacagtgaccaagacactaacaaaggctcctgctgtgacatgtctgttagggaggcactcaagatgaaaactacttcaactaaaagccaaccacttgaacaagcattcccgactttgctttcctttgctatcctcaccctacacaccatcacaagtagacttcagtctgttgatctgcttcctccagaaccagaagagtgtgttaattgcacagatgaatgccgagtgcttggtcattctgacaggtgctggatgccacagttccctgcagccaatcaggctgaaaatgcagattaccgcacaaatctctttgtacctacagtt

SEQ ID NO: 172073 - DNA, 5906 bp, Homo sapiens
  Payload ID: 13805
  Gene Symbol: PCDH18
  Gene Name: protocadherin 18
  Uniprot ID: Q9HCL0
  ENST ID: ENST00000344876
  CDS Start-End: 388-3795
gcaatcacgggtgtttagtctgcagccgagcagctaaagggagaaagaatcgctcaggaaagacacactgcagactccaccggcaccctgcaatagatggattccgactacacaagggagaaaacgcggaggtgacactctcctgcctggaaagaggacgaacgaccaaacaaacgcaaggactggactccatgccgaaggtatctggaagtcgtgacacggtgtgtataaaacaaaagtttgcgagctgttaattgctgtgctgtgttattaagagacgctttcaagtttcaagtaccaaatgtagctttacgttgccaaaggaagttgaggcaattgctttgctgttttaacttgctctgtgagggaaatctcataaactgaccaatgcaccaaatgaatgctaaaatgcactttaggtttgtttttgcacttctgatagtatctttcaaccacgatgtactgggcaagaatttgaaatacaggatttatgaggaacagagggttggatcagtaattgcaagactatcagaggatgtggctgatgttttattgaagcttcctaatccttctactgttcgatttcgagccatgcagaggggaaattctcctctacttgtagtaaacgaggataatggggaaatcagcataggggctacaattgaccgtgaacaactgtgccagaaaaacttgaactgttccatagagtttgatgtgatcactctacccacagagcatctgcagcttttccatattgaagttgaagtgctggatattaatgacaattctccccagttttcaagatctctcatacctattgagatatctgagagtgcagcagttgggactcgcattcccctggacagtgcatttgatccagatgttggggaaaattccctccacacatactcgctctctgccaatgatttttttaatatcgaggttcggaccaggactgatggagccaagtatgcagaactcatagtggtcagagagttagatcgggagctgaagtcaagctacgagcttcagctcactgcctcagacatgggagtacctcagaggtctggctcatccatactaaaaataagcatttcagactccaatgacaacagccctgcttttgagcagcaatcttatataatacaactcttagaaaactccccggttggcactttgctcttagatctgaatgccacggatccagatgagggcgctaatgggaaaattgtatattccttcagcagtcatgtgtctcccaaaattatggagacttttaaaattgattctgaaagaggacatttgactcttttcaagcaagtggattatgaaatcaccaaatcctatgagattgatgttcaggctcaagatttgggtccaaattcaatcccagcccattgcaaaattataattaaggttgtggatgttaatgacaataaacctgaaattaacatcaacctcatgtcccctggaaaagaagaaatatcttatatttttgaaggggatcctattgatacatttgttgctttggtcagagttcaggacaaggattctgggctgaatggagaaatagtttgtaagcttcatggacatggtcactttaaacttcagaagacatatgaaaacaattatttaatcttaactaatgccacactggatagagaaaagagatctgagtatagtttgactgtaatcgctgaggacagggggacacccagtctctctacagtgaaacattttacagttcaaatcaatgatatcaatgacaatccaccccacttccagagaagccgatatgaatttgtaatttcagaaaataactcaccaggggcatatatcaccactgttacagccacagatcctgatcttggagaaaatgggcaagtgacatacaccatcttggagagttttattctaggaagttccataactacatatgtaaccattgacccatctaatggagccatctatgccctcagaatctttgatcatgaagaagtgagtcagatcacttttgtggtagaagcaagagatggaggaagcccgaagcaactggtaagcaataccacagttgtgctcaccatcattgacgaaaatgacaacgttcctgtggttatagggcctgcattgcgtaataatacggcagaaatcaccattcccaaaggggctgaaagtggctttcatgtcacaagaataagggcaattgacagagactctggtgtgaatgctgaactcagctgcgccatagtagcaggtaatgaggagaatatcttcataattgatccacgatcatgtgacatccataccaacgttagcatggattctgttccctacacagaatgggagctgtcagttatcattcaggacaaaggcaatcctcagctacataccaaagtccttctgaagtgcatgatctttgaatatgcagagtcggtgacaagtacagcaatgacttcagtaagccaggcatccttggatgtctccatgataataattatttccttaggagcaatttgtgcagtgttgctggttattatggtgctatttgcaactaggtgtaaccgcgagaagaaagacactagatcctataactgcagggtggccgaatcaacttaccagcaccacccaaaaaggccatcccggcagattcacaaaggggacatcacattggtgcctaccataaatggcactctgcccatcagatctcatcacagatcgtctccatcttcatctcctaccttagaaagagggcagatgggcagccggcagagtcacaacagtcaccagtcactcaacagtttggtgacaatctcatcaaaccacgtgccagagaatttctcattagaactcacccacgccactcctgctgttgagcaggtctctcagcttctttcaatgcttcaccaggggcaatatcagccaagaccaagttttcgaggaaacaaatattccaggagctacagatatgcccttcaagacatggacaaatttagcttgaaagacagtggccgtggtgacagtgaggcaggagacagtgattatgatttggggcgagattctccaatagataggctgttgggtgaaggattcagcgacctgtttctcacagatggaagaattccagcagctatgagactctgcacggaggagtgcagggtcctgggacactctgaccagtgctggatgccaccactgccctcaccgtcttctgattataggagtaacatgttcattccaggggaagaattcccaacgcaaccccagcagcagcatccacatcagagtcttgaggatgacgctcagcctgcagattccggtgaaaagaagaagagtttttccacctttggaaaggactccccaaacgatgaggacactggggataccagcacatcatctctgctctcggaaatgagcagtgtgttccagcgtctcttaccgccttccctggacacctattctgaatgcagtgaggtggatcggtccaactccctggagcgcaggaagggacccttgccagccaaaactgtgggttacccacagggggtagcggcatgggcagccagtacgcattttcaaaatcccaccaccaactgtgggccgccacttggaactcactccagtgtgcagccttcttcaaaatggctgccagccatggaggagatccctgaaaattatgaggaagatgattttgacaatgtgctcaaccacctcaatgatgggaaacacgaactcatggatgccagtgaactggtggcagagattaacaaactgcttcaagatgtccgccagagctaggagattttagcgaagcatttttgtttccatgtatatggaaatagggaacaacaacaacaacaaaaaaccctgaaagaactggcattgccaaatagttgcatttatcataaatgtgtctgtgtatattgaatattaaatactgtattttcgtatgtacacaatgcaagtgtgattattttaatctgtattttaaaaatacatttgtaccttatatttatgtgtaatttaacaaacaaattttatttttttactcccatgacagacatgtttttcctagtcgtgtagaaactagccactgttcaaatctgatacactattcaaccacaaagtgtaaaggcactgcttagattagttttgttggggaagaattattatgttgtatgaacaaccccactgaagcattatacaattcttaattccattaagtgatcccactttttttcaataactttttagaaattaagaatcattaaaattgttaagctattttattgttattttctctactttctactagccccaatagttgaactcttataggaaaatcgaaagataaagtgaaagtttatttcaggactgagaaatatcttgaaggttatttattagatgactatctcaaatgaactttttatagacaatgatgaaaacagaattaaagtcaatgtttcctgactcccaggcccctactattccaggccatcacactggcctgttccggagaatatttctctcacaatattattatctacttataattatggtaaacaataaattttattccatccttgtagtatgaaacatgctccaaggaaatggaatctgtcctttaaatggataacagtatgtgttctaatggcataaaatattactggataaaaacagttgtgtcagtgtctctcctaaggtagtaaatataattgacttattctgaacccattctattttgaatctcccctttcctctcacaatacttgaacattttaatcttttggaatattgtctttctttgttataactattcatttttagcttttgtctccagtgcatgatctcatatttttgcttttatttttagtataagaacatttataaaatcatatttttgttactgcaattgttttatttgttgtgtggcaaatgagaaatcctttatttattgtgctgtgatctctctgtgtggaatgccttggtgagagagatgcttattatgactattatcatttctgaccaagcttctattaatgttatttctaataatacactatcttgattgtactctccagaaaatttttctgtcagtgaaaataaaagaaaaattaaagtaaagctaaggaactgtctataagtcagagtcctgttcctacatatttgttcaaaagcttggcatgcagcaggcccttcctgagcgggtgattcagtgttgagtttcaaataataaacaggcagcattcagttggctgggcgaacaagaaaaacacaatggaaaaggaatgagtttgagacttgtaatgggaatgaaagtagtaagccatattccagctaaataagttaaatgcatttggggaataaagaaaaaagagtaagcaagcaataattgcttgaatatttttcaaattacaacaaaaaaaaatactttcttaggacattttgtattaaattgtgcaggataaaaaggtatccttacaatgtttccaggaggcaagaatattatcgtccctggcttgctagtcaggaattgaaacactgggaaagttaagtaactgaaaagtgactaaaattcagatatttgaattctcaaatgagtaccacattaaatagaatatattacctctttcaacaggcacattttcctttataggagagattgcaattacaagtgaaatttcagtatatttttcagtagattacacacacaaacgctaaccatatttaaatgcattctgcctttcaacttcacttcctttcagtatatattaccattaagaaaaagacttttatatcctcactgttcttaatttaaagcaccagcagtaatatgggaagctatgctgaaaaccgctattttgaataatgtgaaataaataaaatgcaatatttcattcaacacaaaa

SEQ ID NO: 172074 - DNA, 5102 bp, Homo sapiens
  Payload ID: 13805
  Gene Symbol: PCDH18
  Gene Name: protocadherin 18
  Uniprot ID: Q9HCL0
  ENST ID: ENST00000412923
  CDS Start-End: 372-3776
agtctgcagccgagcagctaaagggagaaagaatcgctcaggaaagacacactgcagactccaccggcaccctgcaatagatggattccgactacacaagggagaaaacgcggaggtgacactctcctgcctggaaagaggacgaacgaccaaacaaacgcaaggactggactccatgccgaaggtatctggaagtcgtgacacggtgtgtataaaacaaaagtttgcgagctgttaattgctgtgctgtgttattaagagacgctttcaagtttcaagtaccaaatgtagctttacgttgccaaaggaagttgaggcaattgctttgctgttttaacttgctctgtgagggaaatctcataaactgaccaatgcaccaaatgaatgctaaaatgcactttaggtttgtttttgcacttctgatagtatctttcaaccacgatgtactgggcaagaatttgaaatacaggatttatgaggaacagagggttggatcagtaattgcaagactatcagaggatgtggctgatgttttattgaagcttcctaatccttctactgttcgatttcgagccatgcagaggggaaattctcctctacttgtagtaaacgaggataatggggaaatcagcataggggctacaattgaccgtgaacaactgtgccagaaaaacttgaactgttccatagagtttgatgtgatcactctacccacagagcatctgcagcttttccatattgaagttgaagtgctggatattaatgacaattctccccagttttcaagatctctcatacctattgagatatctgagagtgcagcagttgggactcgcattcccctggacagtgcatttgatccagatgttggggaaaattccctccacacatactcgctctctgccaatgatttttttaatatcgaggttcggaccaggactgatggagccaagtatgcagaactcatagtggtcagagagttagatcgggagctgaagtcaagctacgagcttcagctcactgcctcagacatgggagtacctcagaggtctggctcatccatactaaaaataagcatttcagactccaatgacaacagccctgcttttgagcagcaatcttatataatacaactcttagaaaactccccggttggcactttgctcttagatctgaatgccacggatccagatgagggcgctaatgggaaaattgtatattccttcagcagtcatgtgtctcccaaaattatggagacttttaaaattgattctgaaagaggacatttgactcttttcaagcaagtggattatgaaatcaccaaatcctatgagattgatgttcaggctcaagatttgggtccaaattcaatcccagcccattgcaaaattataattaaggttgtggatgttaatgacaataaacctgaaattaacatcaacctcatgtcccctggaaaagaagaaatatcttatatttttgaaggggatcctattgatacatttgttgctttggtcagagttcaggacaaggattctgggctgaatggagaaatagtttgtaagcttcatggacatggtcactttaaacttcagaagacatatgaaaacaattatttaatcttaactaatgccacactggatagagaaaagagatctgagtatagtttgactgtaatcgctgaggacagggggacacccagtctctctacagtgaaacattttacagttcaaatcaatgatatcaatgacaatccaccccacttccagagaagccgatatgaatttgtaatttcagaaaataactcaccaggggcatatatcaccactgttacagccacagatcctgatcttggagaaaatgggcaagtgacatacaccatcttggagagttttattctaggaagttccataactacatatgtaaccattgacccatctaatggagccatctatgccctcagaatctttgatcatgaagaagtgagtcagatcacttttgtggtagaagcaagagatggaggaagcccgaagcaactggtaagcaataccacagttgtgctcaccatcattgacgaaaatgacaacgttcctgtggttatagggcctgcattgcgtaataatacggcagaaatcaccattcccaaaggggctgaaagtggctttcatgtcacaagaataagggcaattgacagagactctggtgtgaatgctgaactcagctgcgccatagtagcaggtaatgaggagaatatcttcataattgatccacgatcatgtgacatccataccaacgttagcatggattctgttccctacacagaatgggagctgtcagttatcattcaggacaaaggcaatcctcagctacataccaaagtccttctgaagtgcatgatctttgaatatgcagagtcggtgacaagtacagcaatgacttcagtaagccaggcatccttggatgtctccatgataataattatttccttaggagcaatttgtgcagtgttgctggttattatggtgctatttgcaactaggtgtaaccgcgagaagaaagacactagatcctataactgcagggtggccgaatcaacttaccagcaccacccaaaaaggccatcccggcagattcacaaaggggacatcacattggtgcctaccataaatggcactctgcccatcagatctcatcacagatcgtctccatcttcatctcctaccttagaaagagggcagatgggcagccggcagagtcacaacagtcaccagtcactcaacagtttggtgacaatctcatcaaaccacgtgccagagaatttctcattagaactcacccacgccactcctgctgttgaggtctctcagcttctttcaatgcttcaccaggggcaatatcagccaagaccaagttttcgaggaaacaaatattccaggagctacagatatgcccttcaagacatggacaaatttagcttgaaagacagtggccgtggtgacagtgaggcaggagacagtgattatgatttggggcgagattctccaatagataggctgttgggtgaaggattcagcgacctgtttctcacagatggaagaattccagcagctatgagactctgcacggaggagtgcagggtcctgggacactctgaccagtgctggatgccaccactgccctcaccgtcttctgattataggagtaacatgttcattccaggggaagaattcccaacgcaaccccagcagcagcatccacatcagagtcttgaggatgacgctcagcctgcagattccggtgaaaagaagaagagtttttccacctttggaaaggactccccaaacgatgaggacactggggataccagcacatcatctctgctctcggaaatgagcagtgtgttccagcgtctcttaccgccttccctggacacctattctgaatgcagtgaggtggatcggtccaactccctggagcgcaggaagggacccttgccagccaaaactgtgggttacccacagggggtagcggcatgggcagccagtacgcattttcaaaatcccaccaccaactgtgggccgccacttggaactcactccagtgtgcagccttcttcaaaatggctgccagccatggaggagatccctgaaaattatgaggaagatgattttgacaatgtgctcaaccacctcaatgatgggaaacacgaactcatggatgccagtgaactggtggcagagattaacaaactgcttcaagatgtccgccagagctaggagattttagcgaagcatttttgtttccatgtatatggaaatagggaacaacaacaacaacaaaaaaccctgaaagaactggcattgccaaatagttgcatttatcataaatgtgtctgtgtatattgaatattaaatactgtattttcgtatgtacacaatgcaagtgtgattattttaatctgtattttaaaaatacatttgtaccttatatttatgtgtaatttaacaaacaaattttatttttttactcccatgacagacatgtttttcctagtcgtgtagaaactagccactgttcaaatctgatacactattcaaccacaaagtgtaaaggcactgcttagattagttttgttggggaagaattattatgttgtatgaacaaccccactgaagcattatacaattcttaattccattaagtgatcccactttttttcaataactttttagaaattaagaatcattaaaattgttaagctattttattgttattttctctactttctactagccccaatagttgaactcttataggaaaatcgaaagataaagtgaaagtttatttcaggactgagaaatatcttgaaggttatttattagatgactatctcaaatgaactttttatagacaatgatgaaaacagaattaaagtcaatgtttcctgactcccaggcccctactattccaggccatcacactggcctgttccggagaatatttctctcacaatattattatctacttataattatggtaaacaataaattttattccatccttgtagtatgaaacatgctccaaggaaatggaatctgtcctttaaatggataacagtatgtgttctaatggcataaaatattactggataaaaacagttgtgtcagtgtctctcctaaggtagtaaatataattgacttattctgaacccattctattttgaatctcccctttcctctcacaatacttgaacattttaatcttttggaatattgtctttctttgttataactattcatttttagcttttgtctccagtgcatgatctcatatttttgcttttatttttagtataagaacatttataaaatcatatttttgttactgcaattgttttatttgttgtgtggcaaatgagaaatcctttatttattgtgctgtgatctctctgtgtggaatgccttggtgagagagatgcttattatgactattatcatttctgaccaagcttctattaatgttatttctaataatacactatcttgattgtactctccagaaaatttttctgtcagtgaaaataaaagaaaaattaaagtaaa

SEQ ID NO: 172075 - DNA, 1483 bp, Homo sapiens
  Payload ID: 13805
  Gene Symbol: PCDH18
  Gene Name: protocadherin 18
  ENST ID: ENST00000510305
  CDS Start-End: 252-1292
agattttagactggagtcagcaatcacgggtgtttagtctgcagccgagcagctaaagggagaaagaatcgctcaggaaagacacactgcagactccaccggcaccctgcaatagatggattccgactacacaagggagaaaacgcggaggtgacactctcctgcctggaaagaggacgaacgaccaaacaaacgcaaggactggactccatgccgaaggtatctggaagtcgtgacacgaaagagggcagatgggcagccggcagagtcacaacagtcaccagtcactcaacagtttggtgacaatctcatcaaaccacgtgccagagaatttctcattagaactcacccacgccactcctgctgttgagcaggtctctcagcttctttcaatgcttcaccaggggcaatatcagccaagaccaagttttcgaggaaacaaatattccaggagctacagatatgcccttcaagacatggacaaatttagcttgaaagacagtggccgtggtgacagtgaggcaggagacagtgattatgatttggggcgagattctccaatagataggctgttgggtgaaggattcagcgacctgtttctcacagatggaagaattccagcagctatgagactctgcacggaggagtgcagggtcctgggacactctgaccagtgctggatgccaccactgccctcaccgtcttctgattataggagtaacatgttcattccaggggaagaattcccaacgcaaccccagcagcagcatccacatcagagtcttgaggatgacgctcagcctgcagattccggtgaaaagaagaagagtttttccacctttggaaaggactccccaaacgatgaggacactggggataccagcacatcatctctgctctcggaaatgagcagtgtgttccagcgtctcttaccgccttccctggacacctattctgaatgcagtgaggtggatcggtccaactccctggagcgcaggaagggacccttgccagccaaaactgtgggttacccacagggggtagcggcatgggcagccagtacgcattttcaaaatcccaccaccaactgtgggccgccacttggaactcactccagtgtgcagccttcttcaaaatggctgccagccatggaggagatccctgaaaattatgaggaagatgattttgacaatgtgctcaaccacctcaatgatgggaaacacgaactcatggatgccagtgaactggtggcagagattaacaaactgcttcaagatgtccgccagagctaggagattttagcgaagcatttttgtttccatgtatatggaaatagggaacaacaacaacaacaaaaaaccctgaaagaactggcattgccaaatagttgcatttatcataaatgtgtctgtgtatattgaatattaaatactgtattttcgtatgtacacaatgcaagtgtgattattttaatctgtatttt

SEQ ID NO: 172076 - DNA, 1331 bp, Homo sapiens
  Payload ID: 13805
  Gene Symbol: PCDH18
  Gene Name: protocadherin 18
  ENST ID: ENST00000511115
  CDS Start-End: 193-1140
agcaatcacgggtgtttagtctgcagccgagcagctaaagggagaaagaatcgctcaggaaagacacactgcagactccaccggcaccctgcaatagatggattccgactacacaagggagaaaacgcggaggtgacactctcctgcctggaaagaggacgaacgaccaaacaaacgcaaggactggactccatgccgaaggtatctggaagtcgtgacacggtctctcagcttctttcaatgcttcaccaggggcaatatcagccaagaccaagttttcgaggaaacaaatattccaggagctacagatatgcccttcaagacatggacaaatttagcttgaaagacagtggccgtggtgacagtgaggcaggagacagtgattatgatttggggcgagattctccaatagataggctgttgggtgaaggattcagcgacctgtttctcacagatggaagaattccagcagctatgagactctgcacggaggagtgcagggtcctgggacactctgaccagtgctggatgccaccactgccctcaccgtcttctgattataggagtaacatgttcattccaggggaagaattcccaacgcaaccccagcagcagcatccacatcagagtcttgaggatgacgctcagcctgcagattccggtgaaaagaagaagagtttttccacctttggaaaggactccccaaacgatgaggacactggggataccagcacatcatctctgctctcggaaatgagcagtgtgttccagcgtctcttaccgccttccctggacacctattctgaatgcagtgaggtggatcggtccaactccctggagcgcaggaagggacccttgccagccaaaactgtgggttacccacagggggtagcggcatgggcagccagtacgcattttcaaaatcccaccaccaactgtgggccgccacttggaactcactccagtgtgcagccttcttcaaaatggctgccagccatggaggagatccctgaaaattatgaggaagatgattttgacaatgtgctcaaccacctcaatgatgggaaacacgaactcatggatgccagtgaactggtggcagagattaacaaactgcttcaagatgtccgccagagctaggagattttagcgaagcatttttgtttccatgtatatggaaatagggaacaacaacaacaacaaaaaaccctgaaagaactggcattgccaaatagttgcatttatcataaatgtgtctgtgtatattgaatattaaatactgtattttcgtatgtacacaatgcaagtgtgattattttaatctgtatttt

SEQ ID NO: 172077 - DNA, 4625 bp, Homo sapiens
  Payload ID: 13805
  Gene Symbol: PCDH18
  Gene Name: protocadherin 18
  ENST ID: ENST00000507846
  CDS Start-End: 555-3299
agattttagactggagtcagcaatcacgggtgtttagtctgcagccgagcagctaaagggagaaagaatcgctcaggaaagacacactgcagactccaccggcaccctgcaatagatggattccgactacacaagggagaaaacgcggaggtgacactctcctgcctggaaagaggacgaacgaccaaacaaacgcaaggactggactccatgccgaaggtatctggaagtcgtgacacgagcatctgcagcttttccatattgaagttgaagtgctggatattaatgacaattctccccagttttcaagatctctcatacctattgagatatctgagagtgcagcagttgggactcgcattcccctggacagtgcatttgatccagatgttggggaaaattccctccacacatactcgctctctgccaatgatttttttaatatcgaggttcggaccaggactgatggagccaagtatgcagaactcatagtggtcagagagttagatcgggagctgaagtcaagctacgagcttcagctcactgcctcagacatgggagtacctcagaggtctggctcatccatactaaaaataagcatttcagactccaatgacaacagccctgcttttgagcagcaatcttatataatacaactcttagaaaactccccggttggcactttgctcttagatctgaatgccacggatccagatgagggcgctaatgggaaaattgtatattccttcagcagtcatgtgtctcccaaaattatggagacttttaaaattgattctgaaagaggacatttgactcttttcaagcaagtggattatgaaatcaccaaatcctatgagattgatgttcaggctcaagatttgggtccaaattcaatcccagcccattgcaaaattataattaaggttgtggatgttaatgacaataaacctgaaattaacatcaacctcatgtcccctggaaaagaagaaatatcttatatttttgaaggggatcctattgatacatttgttgctttggtcagagttcaggacaaggattctgggctgaatggagaaatagtttgtaagcttcatggacatggtcactttaaacttcagaagacatatgaaaacaattatttaatcttaactaatgccacactggatagagaaaagagatctgagtatagtttgactgtaatcgctgaggacagggggacacccagtctctctacagtgaaacattttacagttcaaatcaatgatatcaatgacaatccaccccacttccagagaagccgatatgaatttgtaatttcagaaaataactcaccaggggcatatatcaccactgttacagccacagatcctgatcttggagaaaatgggcaagtgacatacaccatcttggagagttttattctaggaagttccataactacatatgtaaccattgacccatctaatggagccatctatgccctcagaatctttgatcatgaagaagtgagtcagatcacttttgtggtagaagcaagagatggaggaagcccgaagcaactggtaagcaataccacagttgtgctcaccatcattgacgaaaatgacaacgttcctgtggttatagggcctgcattgcgtaataatacggcagaaatcaccattcccaaaggggctgaaagtggctttcatgtcacaagaataagggcaattgacagagactctggtgtgaatgctgaactcagctgcgccatagtagcaggtaatgaggagaatatcttcataattgatccacgatcatgtgacatccataccaacgttagcatggattctgttccctacacagaatgggagctgtcagttatcattcaggacaaaggcaatcctcagctacataccaaagtccttctgaagtgcatgatctttgaatatgcagagtcggtgacaagtacagcaatgacttcagtaagccaggcatccttggatgtctccatgataataattatttccttaggagcaatttgtgcagtgttgctggttattatggtgctatttgcaactaggtgtaaccgcgagaagaaagacactagatcctataactgcagggtggccgaatcaacttaccagcaccacccaaaaaggccatcccggcagattcacaaaggggacatcacattggtgcctaccataaatggcactctgcccatcagatctcatcacagatcgtctccatcttcatctcctaccttagaaagagggcagatgggcagccggcagagtcacaacagtcaccagtcactcaacagtttggtgacaatctcatcaaaccacgtgccagagaatttctcattagaactcacccacgccactcctgctgttgaggtctctcagcttctttcaatgcttcaccaggggcaatatcagccaagaccaagttttcgaggaaacaaatattccaggagctacagatatgcccttcaagacatggacaaatttagcttgaaagacagtggccgtggtgacagtgaggcaggagacagtgattatgatttggggcgagattctccaatagataggctgttgggtgaaggattcagcgacctgtttctcacagatggaagaattccagcagctatgagactctgcacggaggagtgcagggtcctgggacactctgaccagtgctggatgccaccactgccctcaccgtcttctgattataggagtaacatgttcattccaggggaagaattcccaacgcaaccccagcagcagcatccacatcagagtcttgaggatgacgctcagcctgcagattccggtgaaaagaagaagagtttttccacctttggaaaggactccccaaacgatgaggacactggggataccagcacatcatctctgctctcggaaatgagcagtgtgttccagcgtctcttaccgccttccctggacacctattctgaatgcagtgaggtggatcggtccaactccctggagcgcaggaagggacccttgccagccaaaactgtgggttacccacagggggtagcggcatgggcagccagtacgcattttcaaaatcccaccaccaactgtgggccgccacttggaactcactccagtgtgcagccttcttcaaaatggctgccagccatggaggagatccctgaaaattatgaggaagatgattttgacaatgtgctcaaccacctcaatgatgggaaacacgaactcatggatgccagtgaactggtggcagagattaacaaactgcttcaagatgtccgccagagctaggagattttagcgaagcatttttgtttccatgtatatggaaatagggaacaacaacaacaacaaaaaaccctgaaagaactggcattgccaaatagttgcatttatcataaatgtgtctgtgtatattgaatattaaatactgtattttcgtatgtacacaatgcaagtgtgattattttaatctgtattttaaaaatacatttgtaccttatatttatgtgtaatttaacaaacaaattttatttttttactcccatgacagacatgtttttcctagtcgtgtagaaactagccactgttcaaatctgatacactattcaaccacaaagtgtaaaggcactgcttagattagttttgttggggaagaattattatgttgtatgaacaaccccactgaagcattatacaattcttaattccattaagtgatcccactttttttcaataactttttagaaattaagaatcattaaaattgttaagctattttattgttattttctctactttctactagccccaatagttgaactcttataggaaaatcgaaagataaagtgaaagtttatttcaggactgagaaatatcttgaaggttatttattagatgactatctcaaatgaactttttatagacaatgatgaaaacagaattaaagtcaatgtttcctgactcccaggcccctactattccaggccatcacactggcctgttccggagaatatttctctcacaatattattatctacttataattatggtaaacaataaattttattccatccttgtagtatgaaacatgctccaaggaaatggaatctgtcctttaaatggataacagtatgtgttctaatggcataaaatattactggataaaaacagttgtgtcagtgtctctcctaaggtagtaaatataattgacttattctgaacccattctattttgaatctcccctttcctctcacaatacttgaacattttaatcttttggaatattgtctttctttgttataactattcatttttagcttttgtctccagtgcatgatctcatatttttgcttttatttttagtataagaacatttataaaatcatatttttgttactgcaattgttttatttgttgtgtggcaaatgagaaatcctttatttattgtgctgtgatctctctgtgtggaatgccttggtgagagagatgcttattatgactattatcatttctgaccaagcttctattaatgttatttctaataatacactatcttgattgtactctccagaaaatttttctgtcagtgaaaataaaagaaaaattaaagtaaa

SEQ ID NO: 172078 - DNA, 819 bp, Homo sapiens
  Payload ID: 13805
  Gene Symbol: PCDH18
  Gene Name: protocadherin 18
  ENST ID: ENST00000611581
  CDS Start-End: 211-501
agattttagactggagtcagcaatcacgggtgtttagtctgcagccgagcagctaaagggagaaagaatcgctcaggaaagacacactgcagactccaccggcaccctgcaatagatggattccgactacacaagggagaaaacgcggaggtgacactctcctgcctggaaagaggacgaacgaccaaacaaacgcaaggactggactccatgccgaaggtatctggaagtcgtgacacggtctctcagcttctttcaatgcttcaccaggggcaatatcagccaagaccaagttttcgaggaaacaaatattccaggagctacagatatgcccttcaagacatggacaaatttagcttgaaagacagtggccgtggtgacagtgaggcaggagacagtgattatgatttggggcgagattctccaatagataggctgttgggtgaaggattcagcgacctgtttctcacagatggaagaattccagcagtgcagctatgagactctgcacggaggagtgcagggtcctgggacactctgaccagtgctggatgccaccactgccctcaccgtcttctgattataggagtaacatgttcattccaggggaagaattcccaacgcaaccccagcagcagcatccacatcagagtcttgaggatgacgctcagcctgcagattccggtgaaaagaagaagagtttttccacctttggaaaggactccccaaacgatgaggacactggggataccagcacatcatctctgctctcggaaatgagcagtgtgttccagcgtctcttaccgccttccctggaca

SEQ ID NO: 172079 - DNA, 7937 bp, Homo sapiens
  Payload ID: 13806
  Gene Symbol: PCDH19
  Gene Name: protocadherin 19
  Uniprot ID: Q8TAB3
  ENST ID: ENST00000255531
  CDS Start-End: 1-3306
atggagtcgctcctgctgccggtgctgctgctgctggccatactgtggacgcaggctgccgccctcattaatctcaagtactcggtagaagaggagcagcgcgccgggacggtgattgccaacgtggccaaagacgcgcgagaggcgggcttcgcgctggacccccggcaggcttcagcctttcgcgtggtgtccaactcggctccacacctagtggacatcaatcccagctctggcctgctggtcaccaagcagaagattgaccgtgatctgctgtgccgccagagccccaagtgcatcatctcgctcgaggtcatgtccagctcaatggaaatctgcgtgataaaggtggagatcaaggacctgaacgacaatgcgcccagtttcccggcagcacagatcgagctggagatctcggaggcagccagccctggcacgcgcatcccgctggacagcgcttacgatccagactcaggaagctttggcgtgcagacttacgagctcacgcccaacgagctgttcggcctggagatcaagacgcgcggcgacggctcccgctttgccgaactcgtggtggaaaagagcctggaccgcgagacgcagtcgcactacagcttccgaatcactgcgctagacggtggcgacccgccgcgcctgggcaccgttggccttagtatcaaggtgaccgactccaatgacaacaacccggtgtttagcgagtccacctacgcggtgagcgtgccagaaaactcgcctcccaacacacccgtcatccgcctcaacgccagcgatccagacgagggcaccaacggccaggtggtctactccttctatggctacgtcaacgaccgcacgcgcgagctctttcagatcgacccgcacagtggcctggtcactgtcactggcgctttagactacgaagaggggcacgtgtacgaactggacgtgcaggctaaggacttggggcccaattccatcccggcacactgcaaggtcaccgtcagcgtgctggacaccaatgacaatccgccggtcatcaacctgctgtcagtcaacagtgagcttgtggaggtcagcgagagcgcccccccgggctacgtgatcgccttggtgcgggtgtctgatcgcgactcaggcctcaatggacgtgtgcagtgccgtttgctgggcaatgtgccctttcgactgcaggaatatgagagcttctccactattctggtggacggacggctggaccgcgagcagcacgaccaatacaacctcacaattcaggcacgcgacggcggcgtgcccatgctgcagagtgccaagtcctttaccgtgctcatcactgacgaaaatgacaaccacccgcacttttccaagccctactaccaggtcattgtgcaggagaacaacacgcctggcgcctatctgctctctgtgtctgctcgcgaccccgacctgggtctcaacggcagtgtctcctaccagatcgtgccgtcgcaggtgcgggacatgcctgtcttcacctatgtctccatcaatcccaactcaggcgacatctacgcgctgcgatcctttaaccacgagcagaccaaggcgttcgaattcaaggtgctggccaaggacggcggccttccctcactgcaaagcaacgctacggtgcgggtcatcatcctcgacgtcaacgacaacaccccggtcatcacagccccacctctgattaacggcactgccgaggtctacataccccgcaactctggcataggctacctggtgactgttgtcaaggcagaagactacgatgagggcgaaaatggccgagtcacctacgacatgaccgagggcgaccgcggcttctttgaaatagaccaggtcaatggcgaagtcagaaccacccgcaccttcggggagagctccaagtcctcctatgagcttatcgtggtggctcacgaccacggcaagacatctctctctgcctctgctctcgtcctaatctacttgtcccctgctctcgatgcccaagagtcaatgggctctgtgaacttgtccttgattttcattattgccctgggctccattgcgggcatcctctttgtaactatgatcttcgtggcaatcaagtgcaagcgagacaacaaagagatccggacctacaactgcagaattgctgagtactcctatgggcatcaaaagaaatcaagcaagaagaaaaaaatcagtaagaatgacatccgcctggtaccccgggatgtggaggagacagacaagatgaacgttgtcagttgctcttccctgacctcctccctcaactattttgactaccaccagcagacgctgcccctgggctgccgccgctctgagagcactttcctgaatgtggagaaccagaatacccgcaacaccagtgctaaccacatctaccatcactctttcaacagccaggggccccagcagcctgacctgattatcaacggtgtgcctctgcctgagactgaaaactattcttttgactccaactacgtgaatagccgagcccatttaatcaagagcagctccaccttcaaggacttagagggcaacagcctgaaggatagtggacatgaggagagtgaccaaactgacagtgagcatgatgtccagcggagcctgtattgtgatactgctgtcaacgatgtgctgaacaccagtgtgacctccatgggatctcagatgcctgatcatgatcagaatgaaggatttcattgccgggaagaatgccggattcttggccactctgacaggtgctggatgccccggaaccccatgcccatccgttccaagtcccctgagcatgtgaggaacatcatcgcgctgtctattgaagctactgctgctgatgtcgaggcttatgacgactgcggccccaccaaacggactttcgcaacctttgggaaagatgtcagcgaccacccggctgaggagaggcctaccctgaaaggcaagaggactgtcgatgtgaccatctgcagccccaaggtcaacagcgttatccgggaggcaggcaatggctgtgaggcgattagccctgtcacctcccccctccacctcaagagctctctgcccaccaagccttccgtgtcttacaccattgccctggctcccccagcccgtgatctggagcagtatgtcaacaatgtcaacaatggccctactcgtccctctgaagctgagccccgtggagctgatagcgagaaagtcatgcatgaggtcagccccattctgaaggaaggtcgcaacaaagagtcccctggtgtgaagcgtctgaaggatatcgttctctaaaccagtctccaggaagaagagaaagaaaccacactggctagtgaagaagcaggagcttcttgttttaattgctcaccaatggttggttcttgagtggctatatttcagagcttttcctaaatgtattgtttataggtgattatcattctgtgacagtcccttgtttcaacaggcagcaggggtgttcagttggagcaaattagctttggcttgagttgttcatggggccttgatgttggggaaacagagacaaattcagttgtgaaaagtattatgtattaagtgtttgaatttatatatttttctatgtcaaaattataatataaattaccattgtttgtggaggattacatttaaaaaagcaaaaagtgaaaaaaaaaagctctggacacctttaataagctcgccactgttttttgtagtgtagacaagttaatggtcatttattgtgtactattcattgattcagtgatgtgaaattgagcccccaaaaggttgtttctgaagctcgagtacttcccaatgccgctactttgctgtggacacccctgctttaaaaacccttttgctagctgtgctattgttgtatttgatattgcaaattgctatgtgtgtggtgatggcaaaaggcttttaaaagttggtgttttctttttcttaaaaaaataataaaactacagacaaaaacaaagtgcaaacaactgagacagcaaatgaatgagcaacaccatgcatatagattgagtacttggagaatactcacgttttttaactcatgtagtgattgctcaccactttgcaaagtatttttcctgcctttcagtggtctgcccaggtccatgatagatcattgcagaaagtcatttttggataggctgctatctaatttgcagttgtcagaaatactgtgctgaaagttttatgacatccatcttttaaattttcaggccctgaacaggaaagttgctcctgaagttatgtttccaggcttagaaattccctctctccaatcatctaaaattgaagatgactgaatctattttaagatctaaattagcatctcttcagacacacacttcctgattcagtgtttcccaatcatgattagaattagactgcaaagcacgtcatgggctgggattgagaactccatgttgctctgtatcttaggcttatatacgtagggatagagtaagcagtacaaagtgtatattttggaaaagacaggtaacaggtaacagcatcgctaatccaattactgtgccttctaaacggagacactcagacacttgaactcatctttttatgactaatagttttttgattaaaaatgtgaacaagaaaatactaaaataaaaatcctttcgatttagccaactctttttgctgtaggctaggaatacaccctttttaaattaacacactgtagatcctttttttctgttttaacattcctctaactcccccatttatcttttgtctattaatattcactagccaacatagtatttttgcagcctaagagttcattatttaaaaataaactaaagaaatatgtcacctttgttctgccttggtcttaagagagttgtttctagagaaacaagttttatggttctgttttcatttgtttcattttttgaaattcaggaatacacagagagaaggcctagaggttagagcactagaatgcaaaagaggatttattttcttaagtttaggtagataagtcagctcttttgaatgttttacttatttttgcctgagttcctagctttacgcattactaggaatattttcttttacaggagggagaagggttttgagggagggggtgggtaaggcagtagggatggggttaggtaggggagaacatttctgaaaaagaacttataatgaagctacaaatccatccttatttcttattcagtgctgaatactacctcatgcaaaatattggtgtggctgcaaatttccctctgaagctgacacaattaaggatgaattaccataacatcttcatttttcctcatttcattgcctctcatacagttttctccctctgatttatttcattttggtagtggattttgaattaagtatttatttctctttgcaagtgactatttgattaacacattaaaaattttttaaaaatttcccctttaagttatgatggctgcctatagaatttagactgtttctcaccctgatccatcctgatattatgttattagctacgatttcaaggtcactttgaagtcagacttcacagttttctacaggtgtatttcttgctatgctcagtgggaaccagggagcagaaaagattgtggaaagtgggaacattaattgtcacgtggctgttgagccagagaggccactggctgccatgcctcttaccagccaagttttaaatggttagagtggcattggcattgattttgcttttctcttgggttttcttcatttcttttcataattcatcttcaagctatagatccatccttcttccctatccaaatactttgttctcagtgggcagtcagatttttttggcttccaaacctcactgagcatgttcagagaattcctctcattaaggaaatatttttccccacaattgtctgatgtatgagtcctctcagaagcacaagtgcatactaggaaggctttgtaaactggttttgtaggcaggctgtacctgcaaataggcattctgagcaaggatcctaaatttccctttggctcatgtcccccccgccccaccccaccttctcctttttggcatgtctggtgaaaagctacaaggttcacagggccaaatattctcccttttgttctctaaacatgttgcacacataaactcaagggagtgatttcggttcctaagtcctagggagttctattccatttattctgatgtcccttttaaggaggagttggtgttgaagtgtgacatgctttaatgataactgctttggcaattccccagacaggtatacttcttcatccaaaattgcacctaaggtgttcatttagacaaaattgttcgcttagtgatccactgatctctaatcagaaatatttttaaaaaatacaatttagatctctgaaaattggaaccactcaagagtatcatcttgatagtgttacttcagcatatgactgactgattttatgaagggagtttagctgacttttccctgtagccctatcatattaaaaacaaaaagtggtccacttgaagcagcaaggacaaagggcagtttagggagaggcagggtgaaggggatagctcgattgggcatccagagtggaaaaggattattattgtacataatagcagttctggctggaattccaatccactttctggggatcattttgatgttgaatgttcccccaaagcattctgacaagtttggtccacttggctctttaccccgggtaataagacccttattgactttgaaaaactggcataaatgagcttaagaaatccattgtatacagtcctagtgtttgccttcttggtaaaattacatttaaggatgtcatttcatgagtcaaattgtatctgctgacactgaagtgtattgagatgttgttctttagtttaagtatgtaacaaagtaatattcaaaggggatgtttgggggtggggctgggaccgggtggctttatattgataatgaaatattccagagcaaaacacattgtcctaatgaagttgttgcagctctcttcgttttcttgtgccgctggaattggcttgtgggtcacttgttgtgcaaaagtgaattaatttcaaataggaatcatattgcttttgtgaaacaaagaaaatttaccaccttgtctgatacatagattggaaggcgctcttggtaaagaataacccacaaacacctgatcttgattggaaagcattgtaggtcattagggaaaactgatgatgctgactgttgctccagctgtgttggcaattcaagatgaccttgttactaactgaaagttgctgtcaaccttagcaaacaaaccagctaacaccattacagcactggttaagtagatttttactggcactggctggcgttcagctgaggaaggctaggatacagactttaatgaccaagagccagactagctcgagctagaaatcagcaacaaatacctccttgtgctatttgaatgctaaggtattagttgcaataggcttacgccttcgctcctctagtgaggggaatgagcctgatgacactattactgtttacctgtcaaaccagggtggaaatttagagggatgcaagtacagtatgtctcattaagcagtctctgttgctgattatatgaagataaaattgttgtatatgctgatctgtatgttatgtacattttcacagtgattgaatcattgtaaaaagaaaaaagacaaaaaagaatcaccactgtctattttatgaagatgataaagcagctttattaaattattacagttatgtttcaaatggtgttatctgccacattgtttccttttatctggtggttctctgtttccccctttaaatgtgttttctctgcttcaaaaatttaatgcattttagtattaaaggctattatggaaaaag

SEQ ID NO: 172080 - DNA, 9756 bp, Homo sapiens
  Payload ID: 13806
  Gene Symbol: PCDH19
  Gene Name: protocadherin 19
  Uniprot ID: Q8TAB3
  ENST ID: ENST00000373034
  CDS Start-End: 1677-5123
agtagtttgcggcatccggaggagcagcagcagcagtagcggcggcggctggcgcagcgcggagacggacgagcgggcacagacggcagcacagctcccgtgcaccatgcctggcttgcccgggaggcactggcacccgcgtccctagcccggcgctggcccttggcgcgttgcgctccgcagcattccggctgagcgatttcatccgaaatcctaaacctcctaccccaaacccattgcctcctgcttgctcatactccacactcacactccccacaccacacactcactcttcctctctctctcacacattcacacacagcccgagacagacagagaaagcgagacagacctcccgagtgcgcgagcgcccgggaggaagggagcccaacgcagcgcggccagcgcctctccgggaagatgaaatcaagacgctcctgcaagtaaacttcggcggcgacaaaatcgtcgactgtggcagctgctgaggcggaccccagcgacgtgcaactgagctaggagggcttcctcccgcggcggcggcggcggcggcggcggcggcggaccttggagcgacaccccagcccaaacggagagaagagaagcacccggtacccacggcggcggccccgcctctcctggccggtactgttgttgcctccccttccctcttccccattccccgccacccccggccattagaaagaccggggctttgattttcttggacaaattgccatctccccgtttccacaaacttgacgtggagggtcggactgcgttgttaactttgatttcctagacgaaaacgcccgcagaccctcaactgctctgtggggggaactccgctcccacctcggatcctggacagacgcgcccccaagcccttcgaagccagccttagcgcgagggagcgcgctcaagctctggcagcctctctcccctcccccttcctctgctggccccgggaccgccatccgactcaaccctataaccgggtgcccgcggcgcttgccagtaactgactcccgtctgcgacaccccctttctcccgaacaggcctcgaagaggccagtgtggcccccccagaccccggagggcgcattccaagcgggtactctctccgcagtgaactgggagcgctggggggaggtctttgcgcatgccaggtgcacagacagcgagttcgccagcctcagtgccggtgcaccgcggcgggccgggcagtgcctgaaaggctgcgcctcctccgccctctttaccttcgcctcaagtactgtccggactcagcggtgcgtcctccaggccgcgcagacgccgcccgacccgcagccctgggcggctgccgacagtcgcgcccggctaactttgaaggggtaaaactgagtagccgggctggagggagggggctcggggccgcgcggcgctcccttggcccctcggagcccccggggcccccgcgagcccccgccgcgtccgccgcaacctcagcattggagccgccgcgggtgtcccccgcgcgccgccgggccgccctgggcgggacttctcccgcggcctccggggccacggggcgcgcgcaacaggcggcccgagccggcgggaagctggagcgccgacggcgtcggtctcggaggggtgtggagaggcgaggccaggcagagccccgtgcagccatggagtcgctcctgctgccggtgctgctgctgctggccatactgtggacgcaggctgccgccctcattaatctcaagtactcggtagaagaggagcagcgcgccgggacggtgattgccaacgtggccaaagacgcgcgagaggcgggcttcgcgctggacccccggcaggcttcagcctttcgcgtggtgtccaactcggctccacacctagtggacatcaatcccagctctggcctgctggtcaccaagcagaagattgaccgtgatctgctgtgccgccagagccccaagtgcatcatctcgctcgaggtcatgtccagctcaatggaaatctgcgtgataaaggtggagatcaaggacctgaacgacaatgcgcccagtttcccggcagcacagatcgagctggagatctcggaggcagccagccctggcacgcgcatcccgctggacagcgcttacgatccagactcaggaagctttggcgtgcagacttacgagctcacgcccaacgagctgttcggcctggagatcaagacgcgcggcgacggctcccgctttgccgaactcgtggtggaaaagagcctggaccgcgagacgcagtcgcactacagcttccgaatcactgcgctagacggtggcgacccgccgcgcctgggcaccgttggccttagtatcaaggtgaccgactccaatgacaacaacccggtgtttagcgagtccacctacgcggtgagcgtgccagaaaactcgcctcccaacacacccgtcatccgcctcaacgccagcgatccagacgagggcaccaacggccaggtggtctactccttctatggctacgtcaacgaccgcacgcgcgagctctttcagatcgacccgcacagtggcctggtcactgtcactggcgctttagactacgaagaggggcacgtgtacgaactggacgtgcaggctaaggacttggggcccaattccatcccggcacactgcaaggtcaccgtcagcgtgctggacaccaatgacaatccgccggtcatcaacctgctgtcagtcaacagtgagcttgtggaggtcagcgagagcgcccccccgggctacgtgatcgccttggtgcgggtgtctgatcgcgactcaggcctcaatggacgtgtgcagtgccgtttgctgggcaatgtgccctttcgactgcaggaatatgagagcttctccactattctggtggacggacggctggaccgcgagcagcacgaccaatacaacctcacaattcaggcacgcgacggcggcgtgcccatgctgcagagtgccaagtcctttaccgtgctcatcactgacgaaaatgacaaccacccgcacttttccaagccctactaccaggtcattgtgcaggagaacaacacgcctggcgcctatctgctctctgtgtctgctcgcgaccccgacctgggtctcaacggcagtgtctcctaccagatcgtgccgtcgcaggtgcgggacatgcctgtcttcacctatgtctccatcaatcccaactcaggcgacatctacgcgctgcgatcctttaaccacgagcagaccaaggcgttcgaattcaaggtgctggccaaggacggcggccttccctcactgcaaagcaacgctacggtgcgggtcatcatcctcgacgtcaacgacaacaccccggtcatcacagccccacctctgattaacggcactgccgaggtctacataccccgcaactctggcataggctacctggtgactgttgtcaaggcagaagactacgatgagggcgaaaatggccgagtcacctacgacatgaccgagggcgaccgcggcttctttgaaatagaccaggtcaatggcgaagtcagaaccacccgcaccttcggggagagctccaagtcctcctatgagcttatcgtggtggctcacgaccacggcaagacatctctctctgcctctgctctcgtcctaatctacttgtcccctgctctcgatgcccaagagtcaatgggctctgtgaacttgtccttgattttcattattgccctgggctccattgcgggcatcctctttgtaactatgatcttcgtggcaatcaagtgcaagcgagacaacaaagagatccggacctacaactgcagtaattgtttaaccatcacttgtctcctcggctgttttataaaaggacaaaacagcaagtgtctgcattgcatctcggtttctcccattagcgaggagcaagacaaaaagacagaggagaaagtgagcctaaggggaaagagaattgctgagtactcctatgggcatcaaaagaaatcaagcaagaagaaaaaaatcagtaagaatgacatccgcctggtaccccgggatgtggaggagacagacaagatgaacgttgtcagttgctcttccctgacctcctccctcaactattttgactaccaccagcagacgctgcccctgggctgccgccgctctgagagcactttcctgaatgtggagaaccagaatacccgcaacaccagtgctaaccacatctaccatcactctttcaacagccaggggccccagcagcctgacctgattatcaacggtgtgcctctgcctgagactgaaaactattcttttgactccaactacgtgaatagccgagcccatttaatcaagagcagctccaccttcaaggacttagagggcaacagcctgaaggatagtggacatgaggagagtgaccaaactgacagtgagcatgatgtccagcggagcctgtattgtgatactgctgtcaacgatgtgctgaacaccagtgtgacctccatgggatctcagatgcctgatcatgatcagaatgaaggatttcattgccgggaagaatgccggattcttggccactctgacaggtgctggatgccccggaaccccatgcccatccgttccaagtcccctgagcatgtgaggaacatcatcgcgctgtctattgaagctactgctgctgatgtcgaggcttatgacgactgcggccccaccaaacggactttcgcaacctttgggaaagatgtcagcgaccacccggctgaggagaggcctaccctgaaaggcaagaggactgtcgatgtgaccatctgcagccccaaggtcaacagcgttatccgggaggcaggcaatggctgtgaggcgattagccctgtcacctcccccctccacctcaagagctctctgcccaccaagccttccgtgtcttacaccattgccctggctcccccagcccgtgatctggagcagtatgtcaacaatgtcaacaatggccctactcgtccctctgaagctgagccccgtggagctgatagcgagaaagtcatgcatgaggtcagccccattctgaaggaaggtcgcaacaaagagtcccctggtgtgaagcgtctgaaggatatcgttctctaaaccagtctccaggaagaagagaaagaaaccacactggctagtgaagaagcaggagcttcttgttttaattgctcaccaatggttggttcttgagtggctatatttcagagcttttcctaaatgtattgtttataggtgattatcattctgtgacagtcccttgtttcaacaggcagcaggggtgttcagttggagcaaattagctttggcttgagttgttcatggggccttgatgttggggaaacagagacaaattcagttgtgaaaagtattatgtattaagtgtttgaatttatatatttttctatgtcaaaattataatataaattaccattgtttgtggaggattacatttaaaaaagcaaaaagtgaaaaaaaaaagctctggacacctttaataagctcgccactgttttttgtagtgtagacaagttaatggtcatttattgtgtactattcattgattcagtgatgtgaaattgagcccccaaaaggttgtttctgaagctcgagtacttcccaatgccgctactttgctgtggacacccctgctttaaaaacccttttgctagctgtgctattgttgtatttgatattgcaaattgctatgtgtgtggtgatggcaaaaggcttttaaaagttggtgttttctttttcttaaaaaaataataaaactacagacaaaaacaaagtgcaaacaactgagacagcaaatgaatgagcaacaccatgcatatagattgagtacttggagaatactcacgttttttaactcatgtagtgattgctcaccactttgcaaagtatttttcctgcctttcagtggtctgcccaggtccatgatagatcattgcagaaagtcatttttggataggctgctatctaatttgcagttgtcagaaatactgtgctgaaagttttatgacatccatcttttaaattttcaggccctgaacaggaaagttgctcctgaagttatgtttccaggcttagaaattccctctctccaatcatctaaaattgaagatgactgaatctattttaagatctaaattagcatctcttcagacacacacttcctgattcagtgtttcccaatcatgattagaattagactgcaaagcacgtcatgggctgggattgagaactccatgttgctctgtatcttaggcttatatacgtagggatagagtaagcagtacaaagtgtatattttggaaaagacaggtaacaggtaacagcatcgctaatccaattactgtgccttctaaacggagacactcagacacttgaactcatctttttatgactaatagttttttgattaaaaatgtgaacaagaaaatactaaaataaaaatcctttcgatttagccaactctttttgctgtaggctaggaatacaccctttttaaattaacacactgtagatcctttttttctgttttaacattcctctaactcccccatttatcttttgtctattaatattcactagccaacatagtatttttgcagcctaagagttcattatttaaaaataaactaaagaaatatgtcacctttgttctgccttggtcttaagagagttgtttctagagaaacaagttttatggttctgttttcatttgtttcattttttgaaattcaggaatacacagagagaaggcctagaggttagagcactagaatgcaaaagaggatttattttcttaagtttaggtagataagtcagctcttttgaatgttttacttatttttgcctgagttcctagctttacgcattactaggaatattttcttttacaggagggagaagggttttgagggagggggtgggtaaggcagtagggatggggttaggtaggggagaacatttctgaaaaagaacttataatgaagctacaaatccatccttatttcttattcagtgctgaatactacctcatgcaaaatattggtgtggctgcaaatttccctctgaagctgacacaattaaggatgaattaccataacatcttcatttttcctcatttcattgcctctcatacagttttctccctctgatttatttcattttggtagtggattttgaattaagtatttatttctctttgcaagtgactatttgattaacacattaaaaattttttaaaaatttcccctttaagttatgatggctgcctatagaatttagactgtttctcaccctgatccatcctgatattatgttattagctacgatttcaaggtcactttgaagtcagacttcacagttttctacaggtgtatttcttgctatgctcagtgggaaccagggagcagaaaagattgtggaaagtgggaacattaattgtcacgtggctgttgagccagagaggccactggctgccatgcctcttaccagccaagttttaaatggttagagtggcattggcattgattttgcttttctcttgggttttcttcatttcttttcataattcatcttcaagctatagatccatccttcttccctatccaaatactttgttctcagtgggcagtcagatttttttggcttccaaacctcactgagcatgttcagagaattcctctcattaaggaaatatttttccccacaattgtctgatgtatgagtcctctcagaagcacaagtgcatactaggaaggctttgtaaactggttttgtaggcaggctgtacctgcaaataggcattctgagcaaggatcctaaatttccctttggctcatgtcccccccgccccaccccaccttctcctttttggcatgtctggtgaaaagctacaaggttcacagggccaaatattctcccttttgttctctaaacatgttgcacacataaactcaagggagtgatttcggttcctaagtcctagggagttctattccatttattctgatgtcccttttaaggaggagttggtgttgaagtgtgacatgctttaatgataactgctttggcaattccccagacaggtatacttcttcatccaaaattgcacctaaggtgttcatttagacaaaattgttcgcttagtgatccactgatctctaatcagaaatatttttaaaaaatacaatttagatctctgaaaattggaaccactcaagagtatcatcttgatagtgttacttcagcatatgactgactgattttatgaagggagtttagctgacttttccctgtagccctatcatattaaaaacaaaaagtggtccacttgaagcagcaaggacaaagggcagtttagggagaggcagggtgaaggggatagctcgattgggcatccagagtggaaaaggattattattgtacataatagcagttctggctggaattccaatccactttctggggatcattttgatgttgaatgttcccccaaagcattctgacaagtttggtccacttggctctttaccccgggtaataagacccttattgactttgaaaaactggcataaatgagcttaagaaatccattgtatacagtcctagtgtttgccttcttggtaaaattacatttaaggatgtcatttcatgagtcaaattgtatctgctgacactgaagtgtattgagatgttgttctttagtttaagtatgtaacaaagtaatattcaaaggggatgtttgggggtggggctgggaccgggtggctttatattgataatgaaatattccagagcaaaacacattgtcctaatgaagttgttgcagctctcttcgttttcttgtgccgctggaattggcttgtgggtcacttgttgtgcaaaagtgaattaatttcaaataggaatcatattgcttttgtgaaacaaagaaaatttaccaccttgtctgatacatagattggaaggcgctcttggtaaagaataacccacaaacacctgatcttgattggaaagcattgtaggtcattagggaaaactgatgatgctgactgttgctccagctgtgttggcaattcaagatgaccttgttactaactgaaagttgctgtcaaccttagcaaacaaaccagctaacaccattacagcactggttaagtagatttttactggcactggctggcgttcagctgaggaaggctaggatacagactttaatgaccaagagccagactagctcgagctagaaatcagcaacaaatacctccttgtgctatttgaatgctaaggtattagttgcaataggcttacgccttcgctcctctagtgaggggaatgagcctgatgacactattactgtttacctgtcaaaccagggtggaaatttagagggatgcaagtacagtatgtctcattaagcagtctctgttgctgattatatgaagataaaattgttgtatatgctgatctgtatgttatgtacattttcacagtgattgaatcattgtaaaaagaaaaaagacaaaaaagaatcaccactgtctattttatgaagatgataaagcagctttattaaattattacagttatgtttcaaatggtgttatctgccacattgtttccttttatctggtggttctctgtttccccctttaaatgtgttttctctgcttcaaaaatttaatgcattttagtattaaaggctattatggaaaaagta

SEQ ID NO: 172081 - DNA, 7936 bp, Homo sapiens
  Payload ID: 13806
  Gene Symbol: PCDH19
  Gene Name: protocadherin 19
  Uniprot ID: Q8TAB3
  ENST ID: ENST00000420881
  CDS Start-End: 1-3303
atggagtcgctcctgctgccggtgctgctgctgctggccatactgtggacgcaggctgccgccctcattaatctcaagtactcggtagaagaggagcagcgcgccgggacggtgattgccaacgtggccaaagacgcgcgagaggcgggcttcgcgctggacccccggcaggcttcagcctttcgcgtggtgtccaactcggctccacacctagtggacatcaatcccagctctggcctgctggtcaccaagcagaagattgaccgtgatctgctgtgccgccagagccccaagtgcatcatctcgctcgaggtcatgtccagctcaatggaaatctgcgtgataaaggtggagatcaaggacctgaacgacaatgcgcccagtttcccggcagcacagatcgagctggagatctcggaggcagccagccctggcacgcgcatcccgctggacagcgcttacgatccagactcaggaagctttggcgtgcagacttacgagctcacgcccaacgagctgttcggcctggagatcaagacgcgcggcgacggctcccgctttgccgaactcgtggtggaaaagagcctggaccgcgagacgcagtcgcactacagcttccgaatcactgcgctagacggtggcgacccgccgcgcctgggcaccgttggccttagtatcaaggtgaccgactccaatgacaacaacccggtgtttagcgagtccacctacgcggtgagcgtgccagaaaactcgcctcccaacacacccgtcatccgcctcaacgccagcgatccagacgagggcaccaacggccaggtggtctactccttctatggctacgtcaacgaccgcacgcgcgagctctttcagatcgacccgcacagtggcctggtcactgtcactggcgctttagactacgaagaggggcacgtgtacgaactggacgtgcaggctaaggacttggggcccaattccatcccggcacactgcaaggtcaccgtcagcgtgctggacaccaatgacaatccgccggtcatcaacctgctgtcagtcaacagtgagcttgtggaggtcagcgagagcgcccccccgggctacgtgatcgccttggtgcgggtgtctgatcgcgactcaggcctcaatggacgtgtgcagtgccgtttgctgggcaatgtgccctttcgactgcaggaatatgagagcttctccactattctggtggacggacggctggaccgcgagcagcacgaccaatacaacctcacaattcaggcacgcgacggcggcgtgcccatgctgcagagtgccaagtcctttaccgtgctcatcactgacgaaaatgacaaccacccgcacttttccaagccctactaccaggtcattgtgcaggagaacaacacgcctggcgcctatctgctctctgtgtctgctcgcgaccccgacctgggtctcaacggcagtgtctcctaccagatcgtgccgtcgcaggtgcgggacatgcctgtcttcacctatgtctccatcaatcccaactcaggcgacatctacgcgctgcgatcctttaaccacgagcagaccaaggcgttcgaattcaaggtgctggccaaggacggcggccttccctcactgcaaagcaacgctacggtgcgggtcatcatcctcgacgtcaacgacaacaccccggtcatcacagccccacctctgattaacggcactgccgaggtctacataccccgcaactctggcataggctacctggtgactgttgtcaaggcagaagactacgatgagggcgaaaatggccgagtcacctacgacatgaccgagggcgaccgcggcttctttgaaatagaccaggtcaatggcgaagtcagaaccacccgcaccttcggggagagctccaagtcctcctatgagcttatcgtggtggctcacgaccacggcaagacatctctctctgcctctgctctcgtcctaatctacttgtcccctgctctcgatgcccaagagtcaatgggctctgtgaacttgtccttgattttcattattgccctgggctccattgcgggcatcctctttgtaactatgatcttcgtggcaatcaagtgcaagcgagacaacaaagagatccggacctacaactgcagaattgctgagtactcctatgggcatcaaaagaaatcaagcaagaagaaaaaaatcagtaagaatgacatccgcctggtaccccgggatgtggaggagacagacaagatgaacgttgtcagttgctcttccctgacctcctccctcaactattttgactaccaccagcagacgctgcccctgggctgccgccgctctgagagcactttcctgaatgtggagaaccagaatacccgcaacaccagtgctaaccacatctaccatcactctttcaacagccaggggccccagcagcctgacctgattatcaacggtgtgcctctgcctgagactgaaaactattcttttgactccaactacgtgaatagccgagcccatttaatcaagagctccaccttcaaggacttagagggcaacagcctgaaggatagtggacatgaggagagtgaccaaactgacagtgagcatgatgtccagcggagcctgtattgtgatactgctgtcaacgatgtgctgaacaccagtgtgacctccatgggatctcagatgcctgatcatgatcagaatgaaggatttcattgccgggaagaatgccggattcttggccactctgacaggtgctggatgccccggaaccccatgcccatccgttccaagtcccctgagcatgtgaggaacatcatcgcgctgtctattgaagctactgctgctgatgtcgaggcttatgacgactgcggccccaccaaacggactttcgcaacctttgggaaagatgtcagcgaccacccggctgaggagaggcctaccctgaaaggcaagaggactgtcgatgtgaccatctgcagccccaaggtcaacagcgttatccgggaggcaggcaatggctgtgaggcgattagccctgtcacctcccccctccacctcaagagctctctgcccaccaagccttccgtgtcttacaccattgccctggctcccccagcccgtgatctggagcagtatgtcaacaatgtcaacaatggccctactcgtccctctgaagctgagccccgtggagctgatagcgagaaagtcatgcatgaggtcagccccattctgaaggaaggtcgcaacaaagagtcccctggtgtgaagcgtctgaaggatatcgttctctaaaccagtctccaggaagaagagaaagaaaccacactggctagtgaagaagcaggagcttcttgttttaattgctcaccaatggttggttcttgagtggctatatttcagagcttttcctaaatgtattgtttataggtgattatcattctgtgacagtcccttgtttcaacaggcagcaggggtgttcagttggagcaaattagctttggcttgagttgttcatggggccttgatgttggggaaacagagacaaattcagttgtgaaaagtattatgtattaagtgtttgaatttatatatttttctatgtcaaaattataatataaattaccattgtttgtggaggattacatttaaaaaagcaaaaagtgaaaaaaaaaagctctggacacctttaataagctcgccactgttttttgtagtgtagacaagttaatggtcatttattgtgtactattcattgattcagtgatgtgaaattgagcccccaaaaggttgtttctgaagctcgagtacttcccaatgccgctactttgctgtggacacccctgctttaaaaacccttttgctagctgtgctattgttgtatttgatattgcaaattgctatgtgtgtggtgatggcaaaaggcttttaaaagttggtgttttctttttcttaaaaaaataataaaactacagacaaaaacaaagtgcaaacaactgagacagcaaatgaatgagcaacaccatgcatatagattgagtacttggagaatactcacgttttttaactcatgtagtgattgctcaccactttgcaaagtatttttcctgcctttcagtggtctgcccaggtccatgatagatcattgcagaaagtcatttttggataggctgctatctaatttgcagttgtcagaaatactgtgctgaaagttttatgacatccatcttttaaattttcaggccctgaacaggaaagttgctcctgaagttatgtttccaggcttagaaattccctctctccaatcatctaaaattgaagatgactgaatctattttaagatctaaattagcatctcttcagacacacacttcctgattcagtgtttcccaatcatgattagaattagactgcaaagcacgtcatgggctgggattgagaactccatgttgctctgtatcttaggcttatatacgtagggatagagtaagcagtacaaagtgtatattttggaaaagacaggtaacaggtaacagcatcgctaatccaattactgtgccttctaaacggagacactcagacacttgaactcatctttttatgactaatagttttttgattaaaaatgtgaacaagaaaatactaaaataaaaatcctttcgatttagccaactctttttgctgtaggctaggaatacaccctttttaaattaacacactgtagatcctttttttctgttttaacattcctctaactcccccatttatcttttgtctattaatattcactagccaacatagtatttttgcagcctaagagttcattatttaaaaataaactaaagaaatatgtcacctttgttctgccttggtcttaagagagttgtttctagagaaacaagttttatggttctgttttcatttgtttcattttttgaaattcaggaatacacagagagaaggcctagaggttagagcactagaatgcaaaagaggatttattttcttaagtttaggtagataagtcagctcttttgaatgttttacttatttttgcctgagttcctagctttacgcattactaggaatattttcttttacaggagggagaagggttttgagggagggggtgggtaaggcagtagggatggggttaggtaggggagaacatttctgaaaaagaacttataatgaagctacaaatccatccttatttcttattcagtgctgaatactacctcatgcaaaatattggtgtggctgcaaatttccctctgaagctgacacaattaaggatgaattaccataacatcttcatttttcctcatttcattgcctctcatacagttttctccctctgatttatttcattttggtagtggattttgaattaagtatttatttctctttgcaagtgactatttgattaacacattaaaaattttttaaaaatttcccctttaagttatgatggctgcctatagaatttagactgtttctcaccctgatccatcctgatattatgttattagctacgatttcaaggtcactttgaagtcagacttcacagttttctacaggtgtatttcttgctatgctcagtgggaaccagggagcagaaaagattgtggaaagtgggaacattaattgtcacgtggctgttgagccagagaggccactggctgccatgcctcttaccagccaagttttaaatggttagagtggcattggcattgattttgcttttctcttgggttttcttcatttcttttcataattcatcttcaagctatagatccatccttcttccctatccaaatactttgttctcagtgggcagtcagatttttttggcttccaaacctcactgagcatgttcagagaattcctctcattaaggaaatatttttccccacaattgtctgatgtatgagtcctctcagaagcacaagtgcatactaggaaggctttgtaaactggttttgtaggcaggctgtacctgcaaataggcattctgagcaaggatcctaaatttccctttggctcatgtcccccccgccccaccccaccttctcctttttggcatgtctggtgaaaagctacaaggttcacagggccaaatattctcccttttgttctctaaacatgttgcacacataaactcaagggagtgatttcggttcctaagtcctagggagttctattccatttattctgatgtcccttttaaggaggagttggtgttgaagtgtgacatgctttaatgataactgctttggcaattccccagacaggtatacttcttcatccaaaattgcacctaaggtgttcatttagacaaaattgttcgcttagtgatccactgatctctaatcagaaatatttttaaaaaatacaatttagatctctgaaaattggaaccactcaagagtatcatcttgatagtgttacttcagcatatgactgactgattttatgaagggagtttagctgacttttccctgtagccctatcatattaaaaacaaaaagtggtccacttgaagcagcaaggacaaagggcagtttagggagaggcagggtgaaggggatagctcgattgggcatccagagtggaaaaggattattattgtacataatagcagttctggctggaattccaatccactttctggggatcattttgatgttgaatgttcccccaaagcattctgacaagtttggtccacttggctctttaccccgggtaataagacccttattgactttgaaaaactggcataaatgagcttaagaaatccattgtatacagtcctagtgtttgccttcttggtaaaattacatttaaggatgtcatttcatgagtcaaattgtatctgctgacactgaagtgtattgagatgttgttctttagtttaagtatgtaacaaagtaatattcaaaggggatgtttgggggtggggctgggaccgggtggctttatattgataatgaaatattccagagcaaaacacattgtcctaatgaagttgttgcagctctcttcgttttcttgtgccgctggaattggcttgtgggtcacttgttgtgcaaaagtgaattaatttcaaataggaatcatattgcttttgtgaaacaaagaaaatttaccaccttgtctgatacatagattggaaggcgctcttggtaaagaataacccacaaacacctgatcttgattggaaagcattgtaggtcattagggaaaactgatgatgctgactgttgctccagctgtgttggcaattcaagatgaccttgttactaactgaaagttgctgtcaaccttagcaaacaaaccagctaacaccattacagcactggttaagtagatttttactggcactggctggcgttcagctgaggaaggctaggatacagactttaatgaccaagagccagactagctcgagctagaaatcagcaacaaatacctccttgtgctatttgaatgctaaggtattagttgcaataggcttacgccttcgctcctctagtgaggggaatgagcctgatgacactattactgtttacctgtcaaaccagggtggaaatttagagggatgcaagtacagtatgtctcattaagcagtctctgttgctgattatatgaagataaaattgttgtatatgctgatctgtatgttatgtacattttcacagtgattgaatcattgtaaaaagaaaaaagacaaaaaagaatcaccactgtctattttatgaagatgataaagcagctttattaaattattacagttatgtttcaaatggtgttatctgccacattgtttccttttatctggtggttctctgtttccccctttaaatgtgttttctctgcttcaaaaatttaatgcattttagtattaaaggctattatggaaaaagta

SEQ ID NO: 172082 - DNA, 329 bp, Homo sapiens
  Payload ID: 13806
  Gene Symbol: PCDH19
  Gene Name: protocadherin 19
  ENST ID: ENST00000464981
  CDS Start-End: 1-24
cgtctgaaggatatcgttctctaaaccagtctccaggaagaagagaaagaaaccacactggctagtgaagaagcaggagcttcttgttttaattgctcaccaatgtgattgaatcattgtaaaaagaaaaaagacaaaaaagaatcaccactgtctattttatgaagatgataaagcagctttattaaattattacagttatgtttcaaatggtgttatctgccacattgtttccttttatctggtggttctctgtttccccctttaaatgtgttttctctgcttcaaaaatttaatgcattttagtattaaaggctattatggaaaaa

SEQ ID NO: 172083 - DNA, 4778 bp, Homo sapiens
  Payload ID: 13807
  Gene Symbol: PCDH20
  Gene Name: protocadherin 20
  Uniprot ID: Q8N6Y1
  ENST ID: ENST00000409204
  CDS Start-End: 365-3220
tttattttaattctccctctcttgctagcaacctgtggacttggcatctgactggtgcggcaaggaaggaggctggtaggtaagcgctactgtgcccaaccccgagctgcctcttcgcagtcttcaggagcaagtcccccattccagctcctctggcagagtatggagttacctgcgtccggggcaggaaaccatgaatgtgcccttctgccctcttgcctttctgccactctttgagttcccgtccttaattgaagagccagtgactattggctgaagttcccccagcgatttgcatgaaccgagagggagtgtcttctgccgccctcccttcaagagcgctctgactgcagcctcccagggaatgcgcggccgagggaatgcgcgcagctcacaggccctgggagtgagctggtgcccggcgacctggcacccgcgcctggatatggggcgtctacatcgtcccaggagcagcaccagctacaggaacctgccgcatctgtttctgtttttcctcttcgtgggacccttcagctgcctcgggagttacagccgggccaccgagcttctgtacagcctaaacgagggactacccgcgggggtgctcatcggcagcctggccgaggacctgcggctgctgcccaggtctgcagggaggccggacccgcagtcgcagctgccagagcgcaccggtgctgagtggaacccccctctctccttcagcctggcctcccggggactgagtggccagtacgtgaccctagacaaccgctctggggagctgcacacttcagctcaggagatcgacagggaggccctgtgtgttgaagggggtggagggactgcgtggagcggcagcgtttccatctcctcctctccttctgactcttgtcttttgctgctggatgtgcttgtcctgcctcaggaatacttcaggtttgtgaaggtgaagatcgccatcagagacatcaatgacaacgccccgcagttccctgtttcccagatctcggtgtgggtcccggaaaatgcacctgtaaacacccgactggccatagagcatcctgctgtggacccagatgtaggcattaatggggtacagacctatcgcttactggactaccatggtatgttcaccctggacgtggaggagaatgagaatggggagcgcaccccctacctaattgtcatgggtgctttggacagggaaacccaggaccagtatgtgagcatcatcatagctgaggatggtgggtctccaccacttttgggcagtgccactctcaccattggcatcagtgacattaatgacaattgccctctcttcacagactcacaaatcaatgtcactgtgtatgggaatgctacagtgggcaccccaattgcagctgtccaggctgtggataaagacttggggaccaatgctcaaattacttattcttacagtcagaaagttccacaagcatctaaggatttatttcacctggatgaaaacactggagtcattaaacttttcagtaagattggaggaagtgttctggagtcccacaagctcaccatccttgctaatggaccaggctgcatccctgctgtaatcactgctcttgtgtccattattaaagttattttcagaccccctgaaattgtccctcgttacatagcaaacgagatagatggtgtggtttatctgaaagaactggaacccgttaacactcccattgcgtttttcaccataagagatccagaaggtaaatacaaggttaactgctacctggatggtgaagggccgtttaggttatcaccttacaaaccatacaataatgaatatttactagagaccacaaaacctatggactatgagctacagcagttctatgaagtagctgtggtggcttggaactctgagggatttcatgtcaaaagggtcattaaagtgcaacttttagatgacaatgataatgctccaattttccttcaacccttaatagaactaaccatcgaagagaacaactcacccaatgcctttttgactaagctgtatgctacagatgccgacagcgaggagagaggccaagtttcatattttctgggacctgatgctccatcatatttttccttagacagtgtcacaggaattctgacagtttctactcagctggaccgagaagagaaagaaaagtacagatacactgtcagagctgttgactgtgggaagccacccagagaatcagtagccactgtggccctcacagtgttggataaaaatgacaacagtcctcggtttatcaacaaggacttcagcttttttgtgcctgaaaactttccaggctatggtgagattggagtaattagtgtaacagatgctgacgctggacgaaatggatgggtcgccctctctgtggtgaaccagagtgatatttttgtcatagatacaggaaagggtatgctgagggctaaagtctctttggacagagagcagcaaagctcctatactttgtgggttgaagctgttgatgggggtgagcctgccctctcctctacagcaaaaatcacaattctccttctagatatcaatgacaaccctcctcttgttttgtttcctcagtctaatatgtcttatctgttagtactgccttctactctgccaggctccccggttacagaagtctatgctgtcgacaaagacacaggcatgaatgctgtcatagcttacagcatcatagggagaagaggtcctaggcctgagtccttcaggattgaccctaaaactggcaacattactttggaagaggcattgctgcagacagattatgggctccatcgcttactggtgaaagtgagtgatcatggttatcccgagcctctccactccacagtcatggtgaacctatttgtcaatgacactgtcagtaatgagagttacattgagagtcttttaagaaaagaaccagagattaatatagaggagaaagaaccacaaatctcaatagaaccgactcataggaaggtagaatctgtgtcttgtatgcccaccttagtagctctgtctgtaataagcttgggttccatcacactggtcacagggatgggcatatacatctgtttaaggaaaggggaaaagcatcccagggaagatgaaaatttggaagtacagattccactgaaaggaaaaattgacttgcatatgcgagagagaaagccaatggatatttctaatatttgatatttcatggtggaataacacagagaaatgttttaactgactttggatcttcatcacctaaaaaagagtgtgttgatggcagttccaatgaaggacaactaatttataacttgttctatattgtaaatagctgtttacaggtttttaaatttaaattcagaggttataaaatgtgtacagcatttttaagtgaaaattagtactaacagctataggacttgtatttaaaaaaaaaaaaaaagcttggacatggtttgcagctttcatacaccaagcagatgattgataaaacctgggagtaaggtaagaaaaatggaacaaatttttatctaaaaattcctgtcaccacaagagggcatcagctgctcctttgcaggaaactggggtattgtacttggcagttgtacatgaaattaatgaaagagtatattttaaatatattgtttttaacattaaacaaatatgaaattaaagtaaattaaatttcaccctatttaaacatatgataaaaaaagaaatgcacttgtaaacagaatgtttattacctcataagtgcatatatagtgtgaaagagaaggcattaaaaagaagtgcaattcctttttagcaaggataaaatcattgccttgtgttacagattcagcctgctgaagagtattccactttctgtgtactcgaattgctttctgtttgctttaccactgcacttgttattattacaagggaaatagatttatacatacatatatatattcttcattacaggaaatgtaactagatattgtgcccaagaaaaacagccagaagcaaagaaatgcttcaatctttagttgcttcataggcattcatgacattttagtgctttcacaacttgttggtcgtactttatacttgggttatatattagacttttataggcttgaaatcatccatcacataagaaaatagaaatcatattaaaagtgaattcttctagaggcttgtgtacactactggttgttttagttgggccttttatatgaaagttatactgtacttatctttttgttgttgtttaggtttgttgactaccatttctggcttcctttctttggttttggattaaatccaacagtttatttgtaagccctgcagcagatttctttgataatttagcttttactgaatctcttgcaatgaagaaagctatttcatcagtgatttatcactttcaattcattgtgtgagctggaaatattattttatatgagagctatagcaaaataatctgtataaacaaggaatgtgttagcttaaactggatcattttactttttggcatcatgcatctgtactgtaccaaaagtgtttatatgtctgcaaattaaaggtatatattttcataatttctttctcacttttagcattttatatttgaacatgggcttgttatttcactgaagtgcctgtcatttgtttgtttttagggttaaatgtgggtaacctgtagtattctgctatactaaagtttatattaaatgaattcattactcaattaaacattgggtaaattattaaa

SEQ ID NO: 172084 - DNA, 6403 bp, Homo sapiens
  Payload ID: 13808
  Gene Symbol: PCDH7
  Gene Name: protocadherin 7
  Uniprot ID: O60245
  ENST ID: ENST00000361762
  CDS Start-End: 1009-4218
gaatgcaggtgagaaaaggcacggactctgcggctgcgaacccaaacttgggcaccgcacggtgcgcactgctcagccttcgcccccgtgggcgaaaggctgctgcggtttcaggcggctgcttcgtgactaatgaccttgcgcagagttgttaagaaaaaagagaaacccgcgctctccggggtgagaagggactgactctgggcgtctctgaagatggctcgggcttctctttggcgcgccggggggaccctgacactgaccgctctgtgacgcgagtagtctcccctgcaccgtgcccgaagcgacgtgccgggggatttttcattctcgatctgttgactggctcccccgctgcatgagcagagtcggagttgagactggcttgttgctggccccagcgcctggtgcaggaagcgactcacgtttgtctgggtggccggagccggagcagagcctgggtttggagtgagtgcctggaacgtgaattggactcaactcgagtagcagcaaagaccagcgggctggcaggcgggggaggctgcaggctcattccccacctcttcccagccccactgcccgtctgccggagcggttctggccccttccgacagagcggggactagagccggggattctccgcccgctgaggggatgactctgggttgggggagcgccgaacccgcggcgcgcagtgtcccgtgaactgtgagtactgcgactgaacggcggcaggcgagcgggcgattagcacccattgcatgaattatgaaacaataactttcggaagaagcaggaggaaaaaaagaagcatctatcgctgccctcccacccccattcccggccaactctccacgccgcttttgccccctccctcccctccctctcgctccttcctttccgggagaggggagaggactcgggggagggcaggcggccggccccggaggaggggggcgccgagggggctgtggttagaaggagcagtagcagcagcagcaggagaagatgctgaggatgcggaccgcgggatgggcgcgcggctggtgcttgggctgctgcctcctcctgccgctctcgctcagcctggcggccgccaagcagctcctccggtaccggctggccgaggagggccccgccgacgtccgcatcggcaacgtggcttcagacctgggcatcgtgaccggatcgggtgaggtgactttcagcctggagtccggttccgagtacctgaagatcgacaacctcactggcgagctgagcacgagcgagcggcgcatcgaccgcgagaagctgccccagtgtcagatgatcttcgacgagaacgagtgcttcctggacttcgaggtgtcggtgatcgggccctcgcagagctgggtggacctgtttgagggtcaggtcatcgtgcttgacatcaacgacaacacgcccaccttcccgtcgcccgtgctcacgctcacggtggaggagaatcggccggtgggcacactttacctgctgcccacagccaccgaccgcgacttcggccgcaacggcatcgagcgctacgagctgctccaggagcccggaggcggcggcagcggcggcgagagccggcgcgccggggcggccgacagcgccccctaccccgggggcggcgggaacggcgcgagcggcggcggctcgggaggctccaagcggcggctggacgcatcagagggcggcggcggcaccaaccccggcggccgcagcagcgtgttcgagctgcaggtggcggacaccccggacggcgagaagcagccgcagctgatcgtgaagggggcgctggaccgcgagcagcgcgactcctacgagctgaccctgcgagtgcgcgacggcggcgacccgcctcgctcctcgcaggccatcctacgggtcctcatcaccgacgtgaacgacaacagcccccgcttcgagaagagcgtgtacgaggccgacttggctgagaacagcgccccggggacccccatcctgcaactgcgcgcagccgacttggacgtgggggtcaacgggcagatcgaatacgtgttcggggcggccaccgagtcggtgaggcggctgctgcgccttgacgagacgtccggctggctcagcgtcctgcaccggatcgaccgcgaggaggtgaaccagctgcgcttcacggtcatggcccgcgaccgcgggcagccccccaagaccgacaaggccaccgtggtccttaacatcaaagacgagaacgacaacgtgccgtccattgaaatccgcaagattgggcgcatccccctcaaggacggggtggccaacgtggccgaggacgttctggtcgacacccccatcgctctggtgcaggtgtccgaccgagaccaaggcgagaacggggtggtcacctgcaccgtggtgggcgacgtgcccttccagctcaagccagccagcgacaccgagggcgaccagaacaagaaaaagtacttcttgcacacctcgacccctctggactatgaggccacccgggagttcaacgtggtcatcgtggcggtggactcaggcagccccagcctctcgagcaacaactccctgattgtcaaggtgggagacaccaacgacaacccgcccatgttcggccagtcggtggtggaggtttacttccctgagaacaacatcccgggcgagagggtggccacggtgctggcgacagacgcagacagcggtaagaacgccgagatcgcctactcgctggactcctctgtgatggggatctttgccatcgatcccgattctggggacatcctggtcaataccgtgctggaccgcgagcagactgacaggtatgagtttaaagttaacgccaaagacaaaggcatccccgtgctgcagggcagcactacggtgattgtgcaggtggctgataaaaatgacaatgaccctaagtttatgcaggacgtcttcaccttttatgtgaaagaaaacttgcagcccaacagccctgtggggatggtcaccgtgatggatgctgacaaggggcggaatgcagagatgagcctgtacatagaggagaacaataacattttttctattgaaaatgacacggggaccatttactccacaatgtcttttgaccgggaacatcagaccacatacactttcagagtcaaggctgtggatgggggagatcctcccagatctgccacagctacagtctcgctttttgtgatggatgaaaatgacaatgctcccacagttacccttcccaaaaacatttcctacactttactgccaccttcgagtaatgtcaggacagtagtagctacagtgttggcaacagacagtgatgatggcatcaatgcagacctgaactacagcattgtgggaggaaatcccttcaagctgtttgaaattgatcccactagtggtgtggtttccttagtgggaaaactcacccaaaagcattatggcttgcacaggttggtggtgcaagtgaatgacagtgggcagccttcccagtccaccacgactctggtgcacgtgtttgtcaatgaaagtgtttctaatgcaactgcgattgactcccagatagctagaagtttgcacatcccactcacccaggatatagctggtgacccaagctatgaaattagcaaacagagactcagtattgtcattggcgtggttgctggcattatgacggtgattctaatcatcttaattgtagtgatggcaaggtactgcaggtccaaaaataaaaatggctatgaagccggcaaaaaagatcacgaagacttttttacaccccaacagcatgacaaatctaaaaagcctaaaaaggacaagaaaaacaaaaaatctaagcagcctctctacagcagcattgtcactgtggaggcttctaagccaaatggacagaggtatgatagtgtcaatgagaagctgtcagacagcccaagcatggggcgatacaggtccgttaatggtgggcccggcagtcctgacctggcaaggcattacaaatctagttccccattgcctactgttcagcttcatccccagtcaccaactgcaggaaaaaaacaccaggccgtacaagatctaccaccagccaacacatttgtgggagcaggagacaacatttcaattggatcagatcactgctctgagtacagctgtcaaaccaataacaagtacagcaaacagatgcgtctacatccatacattactgtgtttggctgaattccactctaatatgatgctccattatgcaccatactgtgatgacctttctactccgaaacctgctggagcctgcccttggccgtggggtgtcagccaatcactgcttgttccacttgttgtacattttatttttgagtctttttctttctcatatacagaaaaatagtatgaaaataaaataaatgtatgaaacagtattaatgcagaaatgtgctactaatggatgtctgagtcaccagaaattccattcttaaagaggcggttagcacctattagacgtaacagtgatgtcttttaaaaaatccaaaagcatattgcaacaataagtttgagactttgtgtgaacaaagggaaattcagcctcttatgtctttgtctttaatacattaaatactgattttgaataaaaatctaaattgatcaatatttttaagtgccatgtaatcacaggcctgtcagatagttttgttagagtgaaggataatatcttttgctcattctgtgtgtgtatttttaaatgctgttttgtgtgtttgtgtgtgtttccatatatgtgtgtgtgtgtgtgtgtatatatatatatatgctggaactttgagcaatatttataaaaatattgtctgtaaaacaagtttgagaaattaattttttatatttataatgggcactgtaatggattgatttttttcttaatcttgaaatagtgaccaagatatttatatcatttttgaatttattttttaattctttaagaaaatttagaacttttcactttcatttgctaaagtcactgtagtcacattcggaaggaatatgtggctttctgttctttatggactacgtttatcagaagtccatatttattaaacatcctatttgatgtcagataacgtaaactcaagcagcttcaaagagttcagcatgttacatattattgagagagcaagtgactgaattttagttgtataagcaatattataggtaggtcagggagtcctctggatggcccctctacctctttatgtttgtatgtttatgtctttatttgttatgtcgtatgtgtttatgagcctagaaaatagcctagaaaataagtgttccatatgtaaagtttaataattttgtaatacatttaccacgctgtctgccctattaaaattttccacaaatttgggaactaagaatgccaaattctcaagattttttggtgaatcactctcaatataatagccacttaagaaaaataaataaataaatattggaaggccattggaagtgataggaaatgcactgtaacccctgtgaatctctaatgtatacctgaggattttcattttataagctgtgtatttaatcttgcaaaagggaaattttcagaaacatcactgcaagtacagtaagatttctgtataaaacttaattatcctcaacctctcattttgttttgaacacaaggactagtgtaagaaactggtgaaaggaaccttaccaatctctgcttcttgaaaatgctgttttcctcattccaaatagtaaacgtcactagatattcttcaaatgtaaatcccgtaacaagtcatatcaactcaaaaacaaattacagaaaaatcaaagtctagaattttgggttaatttaatgtgcaatcacatagaagtgatatttatgaataccttcacaaagaagaacattgtaagttagcattttctaaacaggttgcaacacactcttgaggtatgaatcaatttattgagtctctaccacaattagaaaagtacaaaataaaatagaaaaattcagagtacatcacccatagtaagagtaaatattgacttgtgcaatttttgtttcagttgtgtttgtgtggaggtgtgtgtttctgttctcggttgctatgttaaaaatatatcttattgtggaagcagttgaaaaggtttgagaaccagcactctagactggggtaggaagttatggctatttactattatgactggaaaaacatagtaaatcaaagcaagaaaaaaaaatgctgacactctcaaggattttagtgtactattaagctgaatcagaatgatcaacagcatactgattacagcaacatttatcaacagtaaaaagcttttgagaagtctattaccattcctctactattcttgtgattaaaaacaaaaaatctttgaa

SEQ ID NO: 172085 - DNA, 6769 bp, Homo sapiens
  Payload ID: 13808
  Gene Symbol: PCDH7
  Gene Name: protocadherin 7
  ENST ID: ENST00000511884
  CDS Start-End: 1-2813
gcgtgtacgaggccgacttggctgagaacagcgccccggggacccccatcctgcaactgcgcgcagccgacttggacgtgggggtcaacgggcagatcgaatacgtgttcggggcggccaccgagtcggtgaggcggctgctgcgccttgacgagacgtccggctggctcagcgtcctgcaccggatcgaccgcgaggaggtgaaccagctgcgcttcacggtcatggcccgcgaccgcgggcagccccccaagaccgacaaggccaccgtggtccttaacatcaaagacgagaacgacaacgtgccgtccattgaaatccgcaagattgggcgcatccccctcaaggacggggtggccaacgtggccgaggacgttctggtcgacacccccatcgctctggtgcaggtgtccgaccgagaccaaggcgagaacggggtggtcacctgcaccgtggtgggcgacgtgcccttccagctcaagccagccagcgacaccgagggcgaccagaacaagaaaaagtacttcttgcacacctcgacccctctggactatgaggccacccgggagttcaacgtggtcatcgtggcggtggactcaggcagccccagcctctcgagcaacaactccctgattgtcaaggtgggagacaccaacgacaacccgcccatgttcggccagtcggtggtggaggtttacttccctgagaacaacatcccgggcgagagggtggccacggtgctggcgacagacgcagacagcggtaagaacgccgagatcgcctactcgctggactcctctgtgatggggatctttgccatcgatcccgattctggggacatcctggtcaataccgtgctggaccgcgagcagactgacaggtatgagtttaaagttaacgccaaagacaaaggcatccccgtgctgcagggcagcactacggtgattgtgcaggtggctgataaaaatgacaatgaccctaagtttatgcaggacgtcttcaccttttatgtgaaagaaaacttgcagcccaacagccctgtggggatggtcaccgtgatggatgctgacaaggggcggaatgcagagatgagcctgtacatagaggagaacaataacattttttctattgaaaatgacacggggaccatttactccacaatgtcttttgaccgggaacatcagaccacatacactttcagagtcaaggctgtggatgggggagatcctcccagatctgccacagctacagtctcgctttttgtgatggatgaaaatgacaatgctcccacagttacccttcccaaaaacatttcctacactttactgccaccttcgagtaatgtcaggacagtagtagctacagtgttggcaacagacagtgatgatggcatcaatgcagacctgaactacagcattgtgggaggaaatcccttcaagctgtttgaaattgatcccactagtggtgtggtttccttagtgggaaaactcacccaaaagcattatggcttgcacaggttggtggtgcaagtgaatgacagtgggcagccttcccagtccaccacgactctggtgcacgtgtttgtcaatgaaagtgtttctaatgcaactgcgattgactcccagatagctagaagtttgcacatcccactcacccaggatatagctggtgacccaagctatgaaattagcaaacagagactcagtattgtcattggcgtggttgctggcattatgacggtgattctaatcatcttaattgtagtgatggcaaggtactgcaggtccaaaaataaaaatggctatgaagccggcaaaaaagatcacgaagacttttttacaccccaacagcatgacaaatctaaaaagcctaaaaaggacaagaaaaacaaaaaatctaagcagcctctctacagcagcattgtcactgtggaggcttctaagccaaatggacagaggtatgatagtgtcaatgagaagctgtcagacagcccaagcatggggcgatacaggtccgttaatggtgggcccggcagtcctgacctggcaaggcattacaaatctagttccccattgcctactgttcagcttcatccccagtcaccaactgcaggaaaaaaacaccaggccgtacaagatctaccaccagccaacacatttgtgggagcaggagacaacatttcaattggatcagatcactgctctgagtacagctgtcaaaccaataacaagtacagcaaacagccatttcgtagagtgacgttttctgttgtgagtcagcctcaggacccacatcaggggtcactgcagagttgctatgacagcgggctggaggagtcagaaacaccaagcagtaagagttcatcagggccaagactgggtgcgcttccactcccagaggacaactatgaaaggaccacgccggatggcagtgttgattcaaggcctcttccagatgtagccctgactgggaagtgcactcgtgagtgtgatgagtatggccactcagactcctgctggatgccggtccgcacttctccggagaggaagaagagccagcctaaactgtccactttcatgcctgttgatgaacgaggaagccaggaaaagctggccaatggggaggccgccatcatgggtgaccgcaacagaaacctcctgaacaaaaagttgacctcatcctatgagaccttcagtgcagctagtttcagcaaaaatgaggaagccaaccctgaggatattccccttacaaaaacaggggaatataagccatctcctgtcaatactctcactagaagagaagtttacctgtaggctataaaggagcaacagcaaagttctttacatgtatgaaaaggagaataaggggcaaaaaccttacaaagcaaaacgtttaatcacaaagagggggctaccaaagagacaaagctttgcctgccacttctgcctccagatcaggcctttagtgatactgttagcctgattctactgtacaatgtagaaaccatccttgttacttgcatgtctaaccccttcactgattcccaacactcactttctcttccccacccctctccaaaaaaaaaaaaacaaaaagaaaagaaaaaaaaagggggatagttgcaagtttctttcacagtaactgtacgaagcctgattagcagaacacaacacaccctcattatccctaagctgaagcatgattttagtcactttgattttgttcgagtgtcatctggctggtcaaaaataagcaggacagataaaatgtatttcagacataccatcagaaaatggtttatcaccatcaaaggcaatcctttgaaagtgatagagtccctctaaaggtacagtccttagaaagagggactgtattaaaaagtattttgggaatatcaaagctttaatattccaacaaagactaagagaaaaacaatactcagtgggtgattgcagtcctaaattgtcatatgttgttattttcaggtcaagagcatcaacttcaattccatacattcaccaaatattctcagtatacacacagtcttgattacatgtatcaatttcaccagttatgacttctaaaaattatatatattttttcagaacaagaccactattattaactaacttgaacaattgtatcatccaaaggccaaagatcatatggcagatcagggaagtcatgaagttgatttggtcttgacgtggaaaaccattaaacaacaaaagcaactgaacccatgtatgcacagaaacaatcaaacactagttcattttatagtgcccaggaaaatgttccttcttttaaaatggattttatttgaaagcgcagaaaatgaaaactagtgagatatatttttggtattataataggcaattggttgaggttcaagtttagtttcaggtaatattatcagggaagattccatgttttaaaatagtatttatggatcatgggtaggttaagaaagatgcattggcatatagtcttgatagttaagtccacgattatcattttagaatccaggctatgcttgctgctctttttatccacattttaaattacaattgcattttttacttgttcagtgcacactttgatgcaccacaagtgcattaattttgaatcgtgtgcaatatagaaatattttgagactcacaacattgaaacaaggtgacaccctagttgactttatcactaatgtgatttgaacattatttaaacaaatctagactgaacatgaaagaaaggagttttgggcagtgacatttttcacagaatgtatatctcaaaggtgaaagcagagtttttccagtgcaataaaaagaaacagaatatgcagattttgagctactcactctatagaggataacctaacacggctgaaaattgagctgggacattcagacgaaagtgacaatccatggacagaatagggaataacaggtgtgaagagaacaaacttatcactgaatgtttgcaagctggttaaggcatagccttgatggctctctagcaaactgtagaaacaatgtagctttgggtagtttcatgctttgcagaatttcttagactataaagtgacacagcctggaatataggttgataattcactataggtcttcaaaatacttatctttgaaaaccgcttctctgtttggtggggtacaatttgggggtcatttccttatgctctttcttaaatggagttttcattttgatgttagtttatgtataataggtaggatgcaaaaagatatgtaattgaaacaaaaaacattggactaaaatatcagtaattgaacatgtttatgtttgattattatttacactatggaaagatgcaattctagtactttgttaggaaactgcattaaagcagttctgccttgtataatctgtaagtacctattaagacaaaatacttctaaagatacttatgaaatgtatacacattttttcttgcacgttacaaagaaaatactcaattgcataacacggatgtttgacaaacttttttttttttaatgcatttctttctttcatgagacattgaaaccactgatagctcatttcaccctatcttaaacccttctcttgtctataaaactaatacgggtcacaccggaccttcggattaattggatccacattccccaatgatgtttgcaccccattcaagatagccatgccattgtcatttaactcgtgaacctctctttaaaactaaaatggatgtgaaagaataaaattcagtgtactgtaagtattcacagtaattctagtagaattagctgtcataacatgtttattatataatgagctggcatgacacagaaatatattttgtgtttgtatgacttttattttaaataggttaaatctggtgccactccatatatagagtgcttttgaaaaaaaatcaataaaaagaaacaaaaaaaataaatgagtgaatgcaaaataagcaactgtgccttttatacctgttgttacggtaaaaaaacggttgttgggtttggacaatgaggggaaatgggctattcccaacttttttgatcctgtatatttgtccatgtttattttctgaacataataaataatatattaaaaatttgccttctgacaaactcagataatggaccagtcttaaatattgttatgtcataaagcaaagttaaggcattaatatgggctgcttaaatctgactagaagatgaaagcgtttattgtaagtgtaacacagagatactatcaggagtgaaatcagtccatttggcaaggtaaaatactgatttagagttttattctttatttcttttttgttgtgtttctttcagctatggtttcattttggttgtacagtatataaaccatatttgttttctgtacacaagactctcaagtgaattttgcatgcattatacattaggacacatttataaattaatgagtaactatataaatttatgtgtattaaaacgtctgtagcttcaatctaaaatctactgctctttctgaatctccagatatcatttctgtatggtttctgactggcctgctgcctgagtttcagaaaacaagggaggcattatttttatgggaggaggaactaagatggtactgaggatgtctgactgaaacactaccctaggaagctgtcttgtaggaaaatagaataaaacacacagaccagaagaaattgtcaagaagcaaacagccatccaaaaacagtcatgagaaatctaaagacctaaataatcttaggtatatgctctcagtgagaaataagaaaatgtgtccttaagcaaaaataaataaataaataaataaataaataaataataaaaagtgagcatgatcatgaatatagtaaatcttgtgagttgtgacctaggtgaaggtgtaatgataacatctggaggaagcatcatttgttcagctacctagggtttactttcagacttttcctacagtttaaagcacttgcgttcagtgtggtacgatctgtttgtaatgttaatcattgactattgttctgctacttggatgttgatagtgaagcagagaacaatttatcatcgtttattatgagtcactatgcacgcaactatgcttaacatggcgaaatgtattaaacactcgtccaactatttatgaaatactttgcataatttaatttgcttttgtacagttttatgtaaataaattgcttgtcatttttgtctctgcaaattaaaatataacatggtcaaatggtttcaca

SEQ ID NO: 172086 - DNA, 4457 bp, Homo sapiens
  Payload ID: 13808
  Gene Symbol: PCDH7
  Gene Name: protocadherin 7
  Uniprot ID: O60245
  ENST ID: ENST00000543491
  CDS Start-End: 571-3789
gccggagccggagcagagcctgggtttggagtgagtgcctggaacgtgaattggactcaactcgagtagcagcaaagaccagcgggctggcaggcgggggaggctgcaggctcattccccacctcttcccagccccactgcccgtctgccggagcggttctggccccttccgacagagcggggactagagccggggattctccgcccgctgaggggatgactctgggttgggggagcgccgaacccgcggcgcgcagtgtcccgtgaactgtgagtactgcgactgaacggcggcaggcgagcgggcgattagcacccattgcatgaattatgaaacaataactttcggaagaagcaggaggaaaaaaagaagcatctatcgctgccctcccacccccattcccggccaactctccacgccgcttttgccccctccctcccctccctctcgctccttcctttccgggagaggggagaggactcgggggagggcaggcggccggccccggaggaggggggcgccgagggggctgtggttagaaggagcagtagcagcagcagcaggagaagatgctgaggatgcggaccgcgggatgggcgcgcggctggtgcttgggctgctgcctcctcctgccgctctcgctcagcctggcggccgccaagcagctcctccggtaccggctggccgaggagggccccgccgacgtccgcatcggcaacgtggcttcagacctgggcatcgtgaccggatcgggtgaggtgactttcagcctggagtccggttccgagtacctgaagatcgacaacctcactggcgagctgagcacgagcgagcggcgcatcgaccgcgagaagctgccccagtgtcagatgatcttcgacgagaacgagtgcttcctggacttcgaggtgtcggtgatcgggccctcgcagagctgggtggacctgtttgagggtcaggtcatcgtgcttgacatcaacgacaacacgcccaccttcccgtcgcccgtgctcacgctcacggtggaggagaatcggccggtgggcacactttacctgctgcccacagccaccgaccgcgacttcggccgcaacggcatcgagcgctacgagctgctccaggagcccggaggcggcggcagcggcggcgagagccggcgcgccggggcggccgacagcgccccctaccccgggggcggcgggaacggcgcgagcggcggcggctcgggaggctccaagcggcggctggacgcatcagagggcggcggcggcaccaaccccggcggccgcagcagcgtgttcgagctgcaggtggcggacaccccggacggcgagaagcagccgcagctgatcgtgaagggggcgctggaccgcgagcagcgcgactcctacgagctgaccctgcgagtgcgcgacggcggcgacccgcctcgctcctcgcaggccatcctacgggtcctcatcaccgacgtgaacgacaacagcccccgcttcgagaagagcgtgtacgaggccgacttggctgagaacagcgccccggggacccccatcctgcaactgcgcgcagccgacttggacgtgggggtcaacgggcagatcgaatacgtgttcggggcggccaccgagtcggtgaggcggctgctgcgccttgacgagacgtccggctggctcagcgtcctgcaccggatcgaccgcgaggaggtgaaccagctgcgcttcacggtcatggcccgcgaccgcgggcagccccccaagaccgacaaggccaccgtggtccttaacatcaaagacgagaacgacaacgtgccgtccattgaaatccgcaagattgggcgcatccccctcaaggacggggtggccaacgtggccgaggacgttctggtcgacacccccatcgctctggtgcaggtgtccgaccgagaccaaggcgagaacggggtggtcacctgcaccgtggtgggcgacgtgcccttccagctcaagccagccagcgacaccgagggcgaccagaacaagaaaaagtacttcttgcacacctcgacccctctggactatgaggccacccgggagttcaacgtggtcatcgtggcggtggactcaggcagccccagcctctcgagcaacaactccctgattgtcaaggtgggagacaccaacgacaacccgcccatgttcggccagtcggtggtggaggtttacttccctgagaacaacatcccgggcgagagggtggccacggtgctggcgacagacgcagacagcggtaagaacgccgagatcgcctactcgctggactcctctgtgatggggatctttgccatcgatcccgattctggggacatcctggtcaataccgtgctggaccgcgagcagactgacaggtatgagtttaaagttaacgccaaagacaaaggcatccccgtgctgcagggcagcactacggtgattgtgcaggtggctgataaaaatgacaatgaccctaagtttatgcaggacgtcttcaccttttatgtgaaagaaaacttgcagcccaacagccctgtggggatggtcaccgtgatggatgctgacaaggggcggaatgcagagatgagcctgtacatagaggagaacaataacattttttctattgaaaatgacacggggaccatttactccacaatgtcttttgaccgggaacatcagaccacatacactttcagagtcaaggctgtggatgggggagatcctcccagatctgccacagctacagtctcgctttttgtgatggatgaaaatgacaatgctcccacagttacccttcccaaaaacatttcctacactttactgccaccttcgagtaatgtcaggacagtagtagctacagtgttggcaacagacagtgatgatggcatcaatgcagacctgaactacagcattgtgggaggaaatcccttcaagctgtttgaaattgatcccactagtggtgtggtttccttagtgggaaaactcacccaaaagcattatggcttgcacaggttggtggtgcaagtgaatgacagtgggcagccttcccagtccaccacgactctggtgcacgtgtttgtcaatgaaagtgtttctaatgcaactgcgattgactcccagatagctagaagtttgcacatcccactcacccaggatatagctggtgacccaagctatgaaattagcaaacagagactcagtattgtcattggcgtggttgctggcattatgacggtgattctaatcatcttaattgtagtgatggcaaggtactgcaggtccaaaaataaaaatggctatgaagccggcaaaaaagatcacgaagacttttttacaccccaacagcatgacaaatctaaaaagcctaaaaaggacaagaaaaacaaaaaatctaagcagcctctctacagcagcattgtcactgtggaggcttctaagccaaatggacagaggtatgatagtgtcaatgagaagctgtcagacagcccaagcatggggcgatacaggtccgttaatggtgggcccggcagtcctgacctggcaaggcattacaaatctagttccccattgcctactgttcagcttcatccccagtcaccaactgcaggaaaaaaacaccaggccgtacaagatctaccaccagccaacacatttgtgggagcaggagacaacatttcaattggatcagatcactgctctgagtacagctgtcaaaccaataacaagtacagcaaacaggtaagatgtatcccaaatatatttaaatatcccagggagggctaataactctgagacagattatcttctgtaaagttttgtcttctcgtttttaaagttattaaaattttaacagtaggaatttaatgttaatttttgcaccattaatttagcaaaggccatctacaagaggtataccactgtattttgcaaattagaattaaggttcactaaactactgaaagaagtattcagagtaggcagtgtttggcagttctctttgcacttgacatccctaattcatactacatttttttgtttccagaataaatatgtgtgtattacttagatggttagttttcacctgaaattattttcttctgtggcaactaagtggataattacatccagagaaaaagtttctaaagttactactggtgtctatgcaaattggattccatagaagttttagctatgttatttacaatgcaggattttacagataaatagatgctgattcatgcagatgtagtactaagtctgagatattgaaatactgactactttgatgaaactgctggtttaaaaatatttactgatatgcaaatgtcatgcaaaactccactttcaatcttttatatctataataatcgatacctataacaattagtgttctataatgatatgcaattaccatttgcattctttctgtttggtattaaaagtttgcaaac

SEQ ID NO: 172087 - DNA, 865 bp, Homo sapiens
  Payload ID: 13808
  Gene Symbol: PCDH7
  Gene Name: protocadherin 7
  ENST ID: ENST00000509759
  CDS Start-End: 1-376
caacatttcaattggatcagatcactgctctgagtacagctgtcaaaccaataacaagtacagcaaacagccatttcgtagagtgacgttttctgttgtgagtcagcctcaggacccacatcaggggtcactgcagagttgctatgacagcgggctggaggagtcagaaacaccaagcagtaagagttcatcagggccaagactgggtgcgcttccactcccagaggacaactatgaaaggaccacgccggatggcagtgttggtgaggcagagcatatggaaaatggtgttgctgccatcactacctttcccttcctcccctttcctcatggcaagacgcatggaagaagagtgctgttaaggcctctccattaatcaacagattcaaggcctcttccagatgtagccctgactgggaagtgcactcgtgagtgtgatgagtatggccactcagactcctgctggatgccggtccgcacttctccggagaggaagaagagccagcctaaactgtccactttcatgcctgttgatgaacgaggaagccaggaaaagctggccaatggggaggccgccatcatgggtgaccgcaacagaaacctcctgaacaaaaagttgacctcatcctatgagaccttcagtgcagctagtttcagcaaaaatgaggaagccaaccctgaggatattccccttacaaaaacaggggaatataagccatctcctgtcaatactctcactagaagagaagtttacctgtaggctataaaggagcaacagcaaagttctttacatgtatgaaaaggagaataaggggcaaaaaccttacaaagcaaaacgtttaatcacaaagagggggctaccaaa

SEQ ID NO: 172088 - DNA, 2029 bp, Homo sapiens
  Payload ID: 13808
  Gene Symbol: PCDH7
  Gene Name: protocadherin 7
  ENST ID: ENST00000621961
  CDS Start-End: 1-1753
tattgaaaatgacacggggaccatttactccacaatgtcttttgaccgggaacatcagaccacatacactttcagagtcaaggctgtggatgggggagatcctcccagatctgccacagctacagtctcgctttttgtgatggatgaaaatgacaatgctcccacagttacccttcccaaaaacatttcctacactttactgccaccttcgagtaatgtcaggacagtagtagctacagtgttggcaacagacagtgatgatggcatcaatgcagacctgaactacagcattgtgggaggaaatcccttcaagctgtttgaaattgatcccactagtggtgtggtttccttagtgggaaaactcacccaaaagcattatggcttgcacaggttggtggtgcaagtgaatgacagtgggcagccttcccagtccaccacgactctggtgcacgtgtttgtcaatgaaagtgtttctaatgcaactgcgattgactcccagatagctagaagtttgcacatcccactcacccaggatatagctggtgacccaagctatgaaattagcaaacagagactcagtattgtcattggcgtggttgctggcattatgacggtgattctaatcatcttaattgtagtgatggcaaggtactgcaggtccaaaaataaaaatggctatgaagccggcaaaaaagatcacgaagacttttttacaccccaacagcatgacaaatctaaaaagcctaaaaaggacaagaaaaacaaaaaatctaagcagcctctctacagcagcattgtcactgtggaggcttctaagccaaatggacagaggtatgatagtgtcaatgagaagctgtcagacagcccaagcatggggcgatacaggtccgttaatggtgggcccggcagtcctgacctggcaaggcattacaaatctagttccccattgcctactgttcagcttcatccccagtcaccaactgcaggaaaaaaacaccaggccgtacaagatctaccaccagccaacacatttgtgggagcaggagacaacatttcaattggatcagatcactgctctgagtacagctgtcaaaccaataacaagtacagcaaacagctggtgatggagaacaacgtgttaatcttggattccttctgtcagatagcacagaaataccacaagccatttcgtagagtgacgttttctgttgtgagtcagcctcaggacccacatcaggggtcactgcagagttgctatgacagcgggctggaggagtcagaaacaccaagcagtaagagttcatcagggccaagactgggtgcgcttccactcccagaggacaactatgaaaggaccacgccggatggcagtgttgattcaaggcctcttccagatgtagccctgactgggaagtgcactcgtgagtgtgatgagtatggccactcagactcctgctggatgccggtccgcacttctccggagaggaagaagagccagcctaaactgtccactttcatgcctgttgatgaacgaggaagccaggaaaagctggccaatggggaggccgccatcatgggtgaccgcaacagaaacctcctgaacaaaaagttgacctcatcctatgagaccttcagtgcagctagtttcagcaaaaatgaggaagccaaccctgaggatattccccttacaaaaacaggggaatataagccatctcctgtcaatactctcactagaagagaagtttacctgtaggctataaaggagcaacagcaaagttctttacatgtatgaaaaggagaataaggggcaaaaaccttacaaagcaaaacgtttaatcacaaagagggggctaccaaagagacaaagctttgcctgccacttctgcctccagatcaggcctttagtgatactgttagcctgattctactgtacaatgtagaaaccatccttgttacttgcatgtctaaccccttcactgattcccaacactcactttctcttccccacccctctccaaaaaaaaaaaaa

SEQ ID NO: 172089 - DNA, 3708 bp, Homo sapiens
  Payload ID: 13809
  Gene Symbol: PCDH8
  Gene Name: protocadherin 8
  Uniprot ID: O95206
  ENST ID: ENST00000338862
  CDS Start-End: 206-3127
cagcttctgtaagagacggagaggcgcagagtgagggcgggtccgcgcgtcctcagagcccgctggaggctcggagctgctacccgcagacttctcccgcacagggctcgcaaagagcgtgattccgagagcctgagactgacgcccgacctggaaaccagagaagacttccttagcctttcggatcgcacttgaggctggaggcatgagtcctgtgaggcgttggggcagcccctgccttttccccttgcagctcttcagcctctgctgggtgctctcagtggcccagagcaaaacagtccgatacagcaccttcgaggaggatgcccccggcacggtcatcgggaccctggccgaggacctgcatatgaaagtatcgggtgacacaagcttccgcctgatgaagcaattcaacagctctctgctccgggtgcgcgaaggcgacgggcagctgaccgtcggggacgccggcctggaccgcgagcggctgtgtggccaggccccgcagtgcgtgctggccttcgatgtggtcagcttctcgcaggagcagttccggctggtgcacgtggaggtagaggtgagggacgtcaacgaccacgcgccgcgcttccccagggcccagatcccggtagaggtgtccgagggtgcggcagtgggcacgcgcatccccttggaggtgccggtggacgaggacgtgggcgccaacgggctgcagaccgtgcgcctggccgagccgcacagcccctttcgcgtggagctgcagacgcgagcggacggcgctcagtgcgcagacctggtgctgctgcaggagctggaccgcgagagccaggccgcctacagcctggagctggtggcccaggacggcggccgcccgccgcgctccgccacggctgccctcagcgtgcgcgtcctggatgcgaatgaccacagcccggccttcccgcagggcgccgtggccgaagtggagctggcggaagacgcgcccgtgggctccctgcttctcgacctggacgcagccgaccccgacgagggacctaacggcgacgtggtgttcgcatttggcgcccgcaccccgccggaggcgcgccgcctctttcggcttgacccgcgatcaggccgcctcaccctggccgggcccgtggactacgagcgtcaggacacctacgagctggacgtgcgggcgcaggaccgcggacccgggccccgcgctgccacctgcaaggtcatcgtgcgcatccgagacgtcaatgacaacgcacccgacatcgccatcaccccgctggccgccccaggcgcgccggcaacctcacccttcgccgctgccgccgccgccgctgcactcgggggagcggacgctagctcgccggcgggagccgggacgccggaggctggtgccacttcgctggtgccggagggggcggcgcgcgagagcctggtggccctggtcagcacctcggacagggactcgggcgccaacgggcaagtgcgctgcgccctctatgggcacgagcacttccggctgcagccggcctacgcgggcagctacctggtggtgaccgcggcgtcgctggaccgcgaacgcatcgccgagtacaacttgacgctggtggccgaggatcgcggcgcgcccccgctgcgcacagtgcggccctacacggtgcgtgtgggcgacgagaacgacaacgcgccgctcttcacgcggccggtctatgaggtgtcggtgcgcgagaacaacccgccaggcgcctacctggccacggtggccgcccgcgaccgggacctgggccgcaacggccaggtcacctaccggctgctggaggccgaggtgggccgcgccgggggcgccgtgtccacttatgtctcggtggacccagctaccggagccatctacgcgctgcgcagcttcgactatgagacgctgcgccaactcgacgttcgcatccaagctagcgacggcggctcccctcagctttccagcagcgccctagtgcaagtgcgcgtgctggaccagaacgaccatgcgccagtcctggtgcacccggcgccagccaatggctccctagaagtggcggtgcctgggcgcaccgcaaaggacacggttgtggcccgtgtgcaggcccgggatgcagacgagggagccaacggggagctggcgttcgagctgcagcagcaggagccgcgcgaagccttcgccatcggccgccgcacgggggagatactgctcaccggcgacctctcgcaggagccacccggtcgcgtgttcagggcgctcctggtcatatccgacggcggccgtcccccgctcaccaccaccgcaactgtcagcttcgtggtaacagcagggggcgggcgtgggccggctgcgcctgccagtgcaggaagcccggagcgttcccgcccgcctggctctcggctcggggtgtccgggtcggtgctgcaatgggacacgccgctgatcgtcatcatcgtgctggccgggagctgcacgctgctgctggccgccatcatcgccatcgccaccacctgcaaccgccgcaagaaggagccctacggtgcctccccgggttttggaaaggagccggcgccccctgtggcggtgtggaaaggacactccttcaacaccatttctggcagagaagcagagaagttcagcggcaaagacagcggtaaaggggacagtgatttcaacgacagcgattccgacatcagcggggacgctctgaaaaaggatctcatcaaccacatgcagagtggactgtgggcgtgcaccgctgagtgtaagatcctgggccactctgaccgctgctggagcccatcctgcagcgggcccaacgcacatccatcgcctcacccaccagcccagatgtcaaccttctgtaagagcacgtcactgcctcgggatcctctgcgcagggacaattactaccaggcccagctgcccaagacagtggggctgcagagcgtctatgagaaagtactgcacagagactatgacaggacagtcactctgctctcccctccccgtccagggaggctcccagacctgcaggagattggagtacccctctaccagtcccctcctggcaggtacctgtccccgaagaagggagccaatgaaaatgtgtaatcccatgctgcatgtcttcacacatatacaggtcactccgagaagcccctaagttattgaccggtttcagtgttgtatatataaatatgcaagatgtgccttacaatgaagttgttggaagctatttccaatcacattggtactgtttggtatttgcaaacaaaaatgtagttaatgtaatttttatgaaatgtgtgcagtatttaatttttcttatgctattgactttgatttcaattgcggcttgccattttcttagtgtttttaacctgtacattgtgtaatgtaatgtttgtatataatgaaattttgttatatttttatataataaaagctaaagtggaagttattgccaaaggaactgtctgtaagacaaaaaacaaaacatgttggaattacttaattgaaatttatctttcacctgaaacaacctagtgtttgagaaattttgccttgccaagtataacttgtatatcttgactctgtggtagatttcaagttcaatgttatttaattacatttggttttccgtaaaccgtgtcacttataagcacagtaataaaagatttgtcatgtgtttg

SEQ ID NO: 172090 - DNA, 5088 bp, Homo sapiens
  Payload ID: 13809
  Gene Symbol: PCDH8
  Gene Name: protocadherin 8
  Uniprot ID: O95206
  ENST ID: ENST00000377942
  CDS Start-End: 205-3417
agcttctgtaagagacggagaggcgcagagtgagggcgggtccgcgcgtcctcagagcccgctggaggctcggagctgctacccgcagacttctcccgcacagggctcgcaaagagcgtgattccgagagcctgagactgacgcccgacctggaaaccagagaagacttccttagcctttcggatcgcacttgaggctggaggcatgagtcctgtgaggcgttggggcagcccctgccttttccccttgcagctcttcagcctctgctgggtgctctcagtggcccagagcaaaacagtccgatacagcaccttcgaggaggatgcccccggcacggtcatcgggaccctggccgaggacctgcatatgaaagtatcgggtgacacaagcttccgcctgatgaagcaattcaacagctctctgctccgggtgcgcgaaggcgacgggcagctgaccgtcggggacgccggcctggaccgcgagcggctgtgtggccaggccccgcagtgcgtgctggccttcgatgtggtcagcttctcgcaggagcagttccggctggtgcacgtggaggtagaggtgagggacgtcaacgaccacgcgccgcgcttccccagggcccagatcccggtagaggtgtccgagggtgcggcagtgggcacgcgcatccccttggaggtgccggtggacgaggacgtgggcgccaacgggctgcagaccgtgcgcctggccgagccgcacagcccctttcgcgtggagctgcagacgcgagcggacggcgctcagtgcgcagacctggtgctgctgcaggagctggaccgcgagagccaggccgcctacagcctggagctggtggcccaggacggcggccgcccgccgcgctccgccacggctgccctcagcgtgcgcgtcctggatgcgaatgaccacagcccggccttcccgcagggcgccgtggccgaagtggagctggcggaagacgcgcccgtgggctccctgcttctcgacctggacgcagccgaccccgacgagggacctaacggcgacgtggtgttcgcatttggcgcccgcaccccgccggaggcgcgccgcctctttcggcttgacccgcgatcaggccgcctcaccctggccgggcccgtggactacgagcgtcaggacacctacgagctggacgtgcgggcgcaggaccgcggacccgggccccgcgctgccacctgcaaggtcatcgtgcgcatccgagacgtcaatgacaacgcacccgacatcgccatcaccccgctggccgccccaggcgcgccggcaacctcacccttcgccgctgccgccgccgccgctgcactcgggggagcggacgctagctcgccggcgggagccgggacgccggaggctggtgccacttcgctggtgccggagggggcggcgcgcgagagcctggtggccctggtcagcacctcggacagggactcgggcgccaacgggcaagtgcgctgcgccctctatgggcacgagcacttccggctgcagccggcctacgcgggcagctacctggtggtgaccgcggcgtcgctggaccgcgaacgcatcgccgagtacaacttgacgctggtggccgaggatcgcggcgcgcccccgctgcgcacagtgcggccctacacggtgcgtgtgggcgacgagaacgacaacgcgccgctcttcacgcggccggtctatgaggtgtcggtgcgcgagaacaacccgccaggcgcctacctggccacggtggccgcccgcgaccgggacctgggccgcaacggccaggtcacctaccggctgctggaggccgaggtgggccgcgccgggggcgccgtgtccacttatgtctcggtggacccagctaccggagccatctacgcgctgcgcagcttcgactatgagacgctgcgccaactcgacgttcgcatccaagctagcgacggcggctcccctcagctttccagcagcgccctagtgcaagtgcgcgtgctggaccagaacgaccatgcgccagtcctggtgcacccggcgccagccaatggctccctagaagtggcggtgcctgggcgcaccgcaaaggacacggttgtggcccgtgtgcaggcccgggatgcagacgagggagccaacggggagctggcgttcgagctgcagcagcaggagccgcgcgaagccttcgccatcggccgccgcacgggggagatactgctcaccggcgacctctcgcaggagccacccggtcgcgtgttcagggcgctcctggtcatatccgacggcggccgtcccccgctcaccaccaccgcaactgtcagcttcgtggtaacagcagggggcgggcgtgggccggctgcgcctgccagtgcaggaagcccggagcgttcccgcccgcctggctctcggctcggggtgtccgggtcggtgctgcaatgggacacgccgctgatcgtcatcatcgtgctggccgggagctgcacgctgctgctggccgccatcatcgccatcgccaccacctgcaaccgccgcaagaaggaggtgcgcaaagggggggccctccgggaagagcggcccggggcggcgggcggcggagcctcggctcccggctccccggaggaggccgcccggggagccgggcccaggcccaacatgttcgacgtgctcaccttccctggcaccggcaaagcgccctttggcagccccgcggcggacgcgcctccgcctgcggtcgccgcggccgaagtgccgggctcagagggcggcagcgccactggggaaagcgcctgtcacttcgaggggcagcagcggctccgcggcgcgcacgccgagccctacggtgcctccccgggttttggaaaggagccggcgccccctgtggcggtgtggaaaggacactccttcaacaccatttctggcagagaagcagagaagttcagcggcaaagacagcggtaaaggggacagtgatttcaacgacagcgattccgacatcagcggggacgctctgaaaaaggatctcatcaaccacatgcagagtggactgtgggcgtgcaccgctgagtgtaagatcctgggccactctgaccgctgctggagcccatcctgcagcgggcccaacgcacatccatcgcctcacccaccagcccagatgtcaaccttctgtaagagcacgtcactgcctcgggatcctctgcgcagggacaattactaccaggcccagctgcccaagacagtggggctgcagagcgtctatgagaaagtactgcacagagactatgacaggacagtcactctgctctcccctccccgtccagggaggctcccagacctgcaggagattggagtacccctctaccagtcccctcctggcaggtacctgtccccgaagaagggagccaatgaaaatgtgtaatcccatgctgcatgtcttcacacatatacaggtcactccgagaagcccctaagttattgaccggtttcagtgttgtatatataaatatgcaagatgtgccttacaatgaagttgttggaagctatttccaatcacattggtactgtttggtatttgcaaacaaaaatgtagttaatgtaatttttatgaaatgtgtgcagtatttaatttttcttatgctattgactttgatttcaattgcggcttgccattttcttagtgtttttaacctgtacattgtgtaatgtaatgtttgtatataatgaaattttgttatatttttatataataaaagctaaagtggaagttattgccaaaggaactgtctgtaagacaaaaaacaaaacatgttggaattacttaattgaaatttatctttcacctgaaacaacctagtgtttgagaaattttgccttgccaagtataacttgtatatcttgactctgtggtagatttcaagttcaatgttatttaattacatttggttttccgtaaaccgtgtcacttataagcacagtaataaaagatttgtcatgtgtttgaagaatctgccaattgcttttcatgaagctgcctatagtcagacattcacaaataatttgagtatcagaatgaaaccttctttcaagtgctaattatttgggcattattaatgttcatgacaatattaaacctgtaggatttcaagtattgcaaaatgtcacccaagtattaaaaacgtgtgttgatttcataaattatgtgcatctccatatgtattagtctataaaatccctgctctcatttattcactaggtaaatattcattgagcagccaccaaaaagtgaagaaagctaagtttgggttgttcattcactaattaaacaagcatctgtagaacttttactagctgctggtacctcctcctcaagctggagtttgaggtgaagaagacgtagtcccaaagagccctcagcttattcggggtgttagtatcaaaaagactaacatcttagtcttttggaatataataggttcccactacattctgtcctacttcctctttccttgccttcctctggagccagtctccaaagtaactatcagctctattccactcaaatttatgggcaaaatgacatgatgtttgggattcgctttaaaatgttctagaaaaaaacacagggagctatgtgaaacaagatcgatttgataagatattgataattgtcaatgctagcataggtgcatgtgaggtagggaaatttcagcagtatctctaaatgtttgtgtttgaaaatgtacataatggaaagtcttaaaaaaagacactcaagagtactatgcctatgtcttatactctatggatttcatttgaaattaaaatgatgataagcataatgagacctaacatttactgagcaagtcttctgtgagcagagctccttaccaagcattctgcatgaattatctcatttaatcagcaaactacccccaggatatgggaagtatcattaactccattttgcaattaaagaaaccgaggcacaagaaggttagataaaatgccaaaaatcacacagctaataagtatccagggtgagattcaaacctaggttattcagtgcaaaaaataaaacaaagtaatgaaa

SEQ ID NO: 172091 - DNA, 28227 bp, Homo sapiens
  Payload ID: 13810
  Gene Symbol: PCDH9
  Gene Name: protocadherin 9
  ENST ID: ENST00000377861
  CDS Start-End: 802-3900
gggctgcggccgcccgcgccgcaagatgcaggccaatcagagcccgggggcggggcctgggcagtcacgccctccctctgggcttattgagagttatatcaagaaattcagttcagagagaggagagggagaaggagagaggggcagaggggaagggagagagggagagcacgcgagacggaaaggagcgcctcagagtctctgaagcacgcaagagataaccgattaggaatttttcgggcaactgtcacccggatagctgtcagagaatcatcatcaccgcaactctgacgtttcctacaagaagttagagacttaagcagtattggcatcggatggaaatggtatgcatgctgctgtggaaaatatccctgagctgaagaagtgcaactatgtgttgtgtgtgctaaatgcccagaagaacccagacccagtgggtaagagagacgaaatgtggagagaatgactaacgacaaatccgtgaatttgttctctggagttgctaatttgccagcccgaagcaacacattttacaaggaggaaacattttgctgcttctgatttctccccaaactggtgctaccagatgcatggctttctatgtgttggaacaaatcattcctaactgcagcatactgggaaaggggaaaggttgaggcaactaaccggctgtctccaaataagtgatgagatataatgcatcctccagtccatgcacgcttcctcttgcaatttgtgcatcattcctcagtggaaacctttaaaccctaaaatccaggaaaagaaaataaatacattatcatggacctgagggatttttacctgttggctgctctgattgcctgtttaaggctggattccgcaatagctcaagaacttatttacactattagagaggaattgcctgaaaatgtgcccataggaaacataccaaaggatctgaacatttctcacatcaatgctgccacagggaccagcgccagccttgtctacagactggtttctaaagctggggatgcccctttggtgaaagtttccagcagcactggggaaattttcacaacctccaacagaatagacagagaaaaactctgtgctggcgcctcatatgctgaggagaatgagtgtttctttgaacttgaggtggtgatcctccccaatgatttcttcaggctgatcaaaataaaaataattgtcaaggataccaatgataatgcccccatgtttccatctcctgtcatcaatatttccattccagaaaacactttgatcaacagccgctttccaattccatcagcaacagatcctgacacaggcttcaatggtgtacagcattatgaattgttaaatgggcagagtgtttttggactggatatcgtggaaactccagagggagagaagtggccacaactgattgttcagcaaaacttggatagagaacagaaagatacctatgtgatgaaaatcaaagtagaggatggaggcactccacagaaatccagtacggccatactgcaggtcacagtaagtgatgtaaatgacaacaggccagtgtttaaagagggtcaagtggaggtgcatattccagagaatgctcccgtaggtacctctgtaattcagctccatgccactgatgcagatataggcagtaatgctgaaatccggtacatttttggtgcccaggtcgcccctgcaaccaaaagactctttgctttaaataatactactgggctgattacagttcagaggtccttagatagagaggagacagccattcacaaagtgacagtgctggctagtgacggcagctccactcctgctcgagcaacggttaccatcaatgtcaccgatgtaaatgataaccctcctaatatagacctcaggtacattataagtcccatcaatggcaccgtgtatttatctgagaaagatcctgtcaatacaaagattgccctaattacagtttcagataaggacacagatgtgaatggcaaagtgatctgttttattgaaagagaggtcccatttcatttgaaggcggtatatgacaaccaatatttgttagagacctcttctttgttggactatgagggcaccaaagaattcagctttaaaattgttgcctctgattctgggaagcccagtttaaatcagactgccctggtaagggttaagcttgaggatgaaaatgacaacccaccaattttcaaccagcctgtaattgagctgtcagtttctgaaaacaaccgacgtgggttatacttaacaactattagtgccacagatgaagacagtgggaaaaatgcagacattgtttatcagcttggaccgaatgcctccttctttgatctggaccgaaaaacaggagttttgacagcctccagagtatttgacagagaagaacaagaacgattcatttttacagtaactgccagggacaatgggacccctcccctccaaagccaagcggctgtgattgttactgttctggatgagaatgacaatagccccaagtttactcataatcattttcaattttttgtgtctgagaatctgccaaagtatagtactgtgggggtaatcacagtgacagatgcagatgctggagagaataaagctgtgactctttccattctaaatgacaatgataattttgtgttggatccctattctggagtcataaagtcaaatgtctcatttgatagagagcagcagagttcctacacttttgatgtcaaagccactgatggaggacaaccacctcgttcctctactgcaaaagtaactatcaacgtcatggatgtcaatgacaacagcccagttgtcatttctccaccgtctaatacttcctttaagttggtgcccctctcagccattcctggctccgtggtagcagaagtttttgcagtggatgttgacactggaatgaacgctgaactaaagtatactatagtgagtggaaacaataaaggcttattccggattgatccagtaacaggtaacattactctggaagaaaaaccagcacctactgatgtgggattgcatcgtttggtggtcaacataagtgacctggggtaccctaagtctttgcacacgcttgtgcttgtattcctttatgttaacgacactgctggaaatgcctcctatatctatgacttgatccgcaggactatggagaccccgttggacaggaacataggggatagtagccaaccctatcaaaatgaggactatctaaccatcatgattgccatcatcgccggtgccatggtggtcattgttgtgatcttcgtcaccgttctggtgcgctgtcgccatgcatcaaggttcaaagcagctcagaggagcaagcaaggtgccgaatggatgtccccaaaccaggagaacaagcaaaacaagaaaaagaaaagaaagaaaaggaagtctcccaaaagctctcttttgaactttgttactatcgaagagtccaaacccgatgatgcagttcatgaacctatcaatgggacaataagcctgccggctgaactggaggagcaaagtataggaagatttgactggggcccggcacctccaacaacattcaagcctaacagtcctgacctggccaagcactacaaatctgcttctccacagcctgcttttcatctcaaaccagacactccagtttccgtgaaaaagcaccacgtgattcaggaactccctttggacaacacctttgttgggggttgtgacaccctttctaaacgctcttccactagttcagatcacttcagtgcctcagagtgcagttcccaaggaggcttcaagacaaagggccccttacacaccagacaggtaaacgagcacttttactggtctataagtactgcatacaagtgcccagtcaaccagtattaacgtgccagtatgtctattgttttggtctaactttagcttagttagaaagaggtaaaaaaaaacttgaccccttttctattcctctggggctcagtcaagaatttttagaacagctttgaaatttctgagttctgagaatattttctcctttcagtttccttcaaatggcaaaagatgaaaagagaaaattattccaaaatgtcccaagataatgtttgctgaagaagaaaaaacctgtcctgatatgccaaattctgctcctgggggtttccaaattgactgcttcaagactttcaccttaccttttgatctaaaaagtcaccttcaaatctcaagttttcaatgacttttgaaggtgtgactgcaattatgttgcagctatggttgctaaaggggttaattttttttttagtctctaaacaggatagtagaatattaaatgtacatcagctgtgaagcacatgatcgttgatagattgcaactaagccatataggaagtcttctctttgatttcaaattattttattgtaatatattaaattcggtacttaatagaaagatttttagtgtccgcagtggccaaatactctttcaaaaaaaaaaaaaaaaagaatgcttgctgcctaatataactgatttaaaaagaaaagaatgaatccattgtaaatattctctcatcttagtaatgcataagtgatctgtcataactcattttaaactgtgaaatatgccatatgaagagggattaagaggctgagaaactcatatttcaaccaaatccagaattagtttttcttaggtctaataattccttgttaataaagatttaaatgcagcgctgtctaatttatttcactggtgcttgtctgttgccacaaaatttgaatatcgataatagcctgtagatggcactagggtatcatgtcgcttgtgctggccaggtgccaatcccgcagtagcaaggagaagggggagggaaggatcaagctggtagtacagccaaagataccttttatttaatgatagttgctctggagcaactagcatttaagttcattcgcttgctcttttgtgattagctctcagcacaccaactttctaggatttcgtaatgctagttctgtctttgtcgatatggagttcacctatggtgatggcccatctgtacttgtttataaataaggaacacatagattttagaaaatcaagtaaagcaaaattagtttgcagaacagtatcaacagttatcattgattagtctttggagaatcaagagtttttattttctgagggtggggtgaagtaggatgttttattgaaacagtttcccccttaccaactatcatttattgctctggaaggacttaaggcttcatggtaataaaatatttataagagtaattttgacaatgagtcatacagatactcccagaacatcaagtataatacatattaccatacaactaaaatctccattcttaaagtaaaatattaaacagtagagcgttttaaaagtacaaatatttacagcttaaatacacaggaagaaaggactttaatcagtatagaattttaaaggagactatgagattattacatataagtcaaagttagaacgacttaatttttgtgttaactttgttagtatttgaaaagaggttgatgttttaaaatttaaaaaatgttcagtcttagtaaaggtttttaaaagttaaatagttaactatgataagaaaagtaatttatgaaactaaatgagtttgattaaaaagttgctcttaatgaacagaaagaaaattttttaaattatttacttctgttatggttactcacaatacacatggtattttatgatatgcataattatgttgagaaactaatatgacttaaactttttcatgtaaaatctgacattttctttccaaagaaatgtactgatatacttccagcatcatctttttttctgtctatacgtggtgatattagcattgatgtatagatccactttttctgacctccccaaaagttgaacctatatatagtgtagtgacataaatgttaagtgcatttcagcaaagtatgcaagagatcttttcttgaggcttagtcagtcataaaagtctttgtatgatgtaatctttcaaataggatactgagtaattctctaactggaactaaagtgcgttttagaaatttcttgtgaccatgtgtcactttgcagttctcctatgggtattccaatgttcatatggaactaggtaattcactcttatgataaagagctattaaaatggctttgcttacaccttttaaaagttttcatgctgaaaaagaaatagtgtgatgttggagaaaagagatagaagtcggtggagaagtggtagtgatatacaaagtaatatgtacatttttttggataaaagaagcatatttcctatgaatgaacgacatcaaatatatactactctttaaaaatttgttttcactgaactgtatgattgctatctgcagatgttctagttaagctaaaaagtaaaaacttttttaactagtggcttttatataaaatgtgctcctgaagctacacaattttgaaagagtaacatttcttgctacaaaaactttcaaaggaatttatttaaaaaaatacaatctgtgaagattttagttgtgtgacgactattgctcacaccatcttttcattttatgctattaattgatatgtgggtaaaatgcaagattcttggttaaaagcttaccaaacttaaatttcactcatttatactgtatgtataacgaaaacataacgtctgatgttttcatcatgaatttgtttgtggtacatcaattcctatattgtctgatatttttccccttgctgttttcccttgtgttaacctgcaaagaacataggaaacactgtaaatcatattcctcattcactctattttataaagctttcatgtgtcactaaatttttcacagattatttcttacaaatttttggaagtgcgattagcctttataggttaagaatttacttttttttttttggcaaaaggtcatgtctcggtaattatttgtaaaaaaaaaaaaaacaacaaagtttacagccaaaaggtgaagaggatgaaaacgacaacattatccattccaacaaggctttaaatgataaaattcattggtatatttgcctaaaagaaaaatggtcttgttgacagatattgttttaaaatatgatactgattctccctgtggaatgtctgggaatcatttggagcactacttaaaacatggattgttgggttctaccccagaggctctgatttcgtaccactgaggtcaggactgaaaatatacattgctaacaagttcctaggtggtactgatgctgctagtccagggcccacactttgagaaccactaccttagcatattgaaacaggaagtgtcagcctctttccctctcgtattatcatatccagagaacctgtttttgcacagcccaactctcagcccacttattgacagctgttttattgtagctggaggctttacagtaagctgtttattgctgtttcccaacccagttgacagcatttagggaattaatttcttggcccctgtgtggttttttgggggtgggaagagggaagataaatgaaaatgttaaagtaaaagaaatagtcacccatttacatttgacaacttcttcaagtagtaaaacagtctgtaagagttgcactagacattggttctgggtaaactgtcatttaattttctaaaggaaatactcattttagagctttaaacatcctgacttttcacaatctagagtatttactcacatatatttttctatatattgaggaatgtatacactgaaaatgtgtatgcgtgctgtacttaagtgtatacatgtatttttacagtgtaaagggaatttcttctattccaaaccatttagagatactatattacatttatgattacttttcatttttgaataatctactacaaccactactgaaatgttattatgttatgtaaaatgcggaaggcagtcacagaattgatatttagaacagctagggaaaaaatgcaattgaaagtgaagggggcaaatgttaactaatgtgaggctaaccaaaatctttaagatattttcaattattaaattctggaatagatatatatagtgacagttgaacacaggtgacaactgatcccccaaatgcaaattgtttttaaaatgttatcggttgtgatttttatttctatggctctttggctaagtgccctatggtcatgaagtcagttttcatacttatgaggtagaagatacccagagcccttggatattaacacagatttttgaaatgaggataggccacccattcaaactggctatctttccatttgggtttgtaagataaatatttgactatttttctttccatcttgatattcctaagctataaaattcaagacgcattttggccttccattgctaataacattaagcagaataaaaatgaaaagttactattgtattaaacatagacatgtctgttgattcttgaatatttgttaacgtagagaaaatagtatatgtggtgacaatattctattctcttattatttgtttttgttgccattaattcaagatatagaaacaaggaacattaatgttctccttagtttcagaccagtcatcctatggtgagacagggcaggctttggtgtcattgaaattactttgaaaatattgtacttgtaataacatgttacattcttatggtgtaaacatattcttattatttaaataattgcaagctatcatttatcttcttatgatttcatacattaaattaaaatatgtgaaatagtaaagtagagggaatttagatttaaggaaaagcctcaaatctaaaatcaaattttctcataattaactatgatttatattgaaccttaaggtttcattttcatattgatgtgtgtaaaatatctataaattatacttatattattagatatggcattgtaacgcatcctttttcatattactaattttacactacagtactgaagtatgaaaatgacacctttaaatcattttgttttctgtaatcttatttccacaacaatttttgttgtcttatttagattgtttttatttctaatttttttttttcggttgggggaattcagaaatccaccaaatgctgaacgttacagttgtagccttggtcccactataccagtctgggtgtttacagggtttcagggccaagtcagatgtctgtattgctcttttacaatacttctcagtttgactttgttaaaggtgaactcttagcttgtatatagttaaaaacataacaaaactggaaatccagtggattgtttactactttgacttaaaatccttggtgcaatctttctttgaatttagtttggtgttttcttgaagataattctttattataactagaaattactctcttaatattagtaaatcatttaatatcttatatatttcactgagttggaaagtacaaattagttaatgcagatttttaaaggtttggcctttctgacactcaacttcacatttaatattttttccacaatttattacatataaggaccctaaccattatatcagatttattaaaatatgactctaatcacaggccaggtattagtgaaaatttggaaatgcaagtcaggaagaggcttattctaaagtttcatggaggcataaaagtcagactctttcgtaagtaataatgctaatgtcttatagactttgacatagtcagcgacccccaaatctacattatactacagaagtaaagacaaatgtaaaaataggatctctcatgtacataaggagatgtactctgtttttaagatttcattggttgttatttaagaaaactgtcaaatctgtcaaacatttcatttagaaaggaacacatgctttttgcctttgtttgatacaaacctattgggctgtcagtcaccagaaacatagaacaaaaaagatttattaccatgattgacattttgcttttgatttatattcttttcttctgtaagccaagactcattaaattttcaaattcctaaataagttaaacaactgtccttttttaacagtaaagagtgatacagaaataaactggaaaaacaacccatatttaatctttctcattcatatttttgtcctatagacagtttgtctctgatagacaagaatagtggcagaatcagtagaattttctgaggcatagcatataaatataagaaatgcagaactcaaagtcattcattagggatctgtttttacatatttattcattatttaaatggcatatgaaaatattttcccttgatcttttacagtttgattgattagagtgccataagcacatatcacgttttaaatgatgggcttgagaccacctgtacagctaagaatggcaaagatagaagcacagtcaaggtctttgaggaatatttgattgattctatcattttatactaattattctggatccttgagaaaatatatgaaatgaacttacctgttcttgaaaggagcctgctacgtacagcttcaccacttagtaatttatgtggatatttaattgtgtgggctgtaggaaagaatggaaatgtggtcaattttatcatgtttgtgtaatatcttgtattttaacattcttctatagtttgtctctctatccaaccatctctgcatttgagtattacactgctttgttaataaccactctctgggcctttttcagcctgttagcagttgattaagaaacactctaatccctttcaggatattgaggagctaatggattgcagactatttggatctttaagcttctattgtaaacggtatgaagaattgtcattgagctgatatttgcatatatctctcccagtgctagttactttgcctccttttttgtcctcttaatcttcagctttcattctgagaatatttattttagtcggaaataagcatgccagtgatagaaatttgggattcacctccagatgaatgccatcacagacagggaagctctggcacattttgcatagatctgtatgaacacagtgaacccttcataagctcttagattgcaggaaatcagtgctgaaaattaagtggggttttaaagatttgcaaagtagagagctttgtataatgctggtattgcaggtgcctattaaatatgaagtaaaggctttgtaatacaactagctaacacatttccctccacattagagtgatttatagcctagggaattagtcttgcctattttttccaaatgcagaaacactggatgtgactgaaagaataaaaatctcaaatacatgccttacaatggactgatttgctgttggatgattctaattattcaagatagatgatgcaggcttgtttgtacttccttgtggtatctctgatgcccatgatctggccttcatttctcctaagaagaaactctcaattgtgtatgcagactctcttctgaacctaaatcagattaacaccccaggtgtctataagactatatagcattaccataatgaagaggcctgggtaccaagtgaatgcttccatcctcataggaattactattgaatcatttctcaaactgtatttttagaattcatctttgctgcatttgtaaatatggtgtgtatttgtagcacagcattttgttctagacatacatggatttcaatatatttagcttcatgacaatgttcagtaaaatcccttgcagttctttaatacttaatgtctttgactagccctgttagatataaattggagcaaatagccatgcatattttaaaatgattttataaatcctatattttcacctattagaaaaagtgtgtaatccatatgcagcccacagtaggcacaggggcctgtgagagtcataatagatgattgatttagaaaagaaaacagtttttgtgcaagacaatagcaactgcaattcagtgaattaggtttttttttttcctcattaaacaaacctcaataaagaaaagaacggaaacacagaagcagttatgaaatgaagctgtatcttttatagaaggagaatgtcttctgctgacagtagtagttctatagtagacattttctggaaagaaaaatactggtggttttttggattcggtggatgcaaccaatctgtgcctctgtgtgatagcagctgcatgctgaggactttcaaatacacagctacataggattcggcaggaaactttttgtagaaggtgcaaatgacaaatggagacaaaatggagtgagttctgagttgtgagttgatgccctcctgtgtcatatattcatgtcattgaaccgattttcacattggatgtctagaatcacaatagccttccttctgtgtgtcagctgggaacacacctggactggctacttttctttgctccatttcttgtcattcactaggtggactatattcatgtatgttgttaatacatctgatttcttagtttcttgatggattttaaagtgatgtaatattatttctgcataatcttttccgtatatatatccatatatatatatatatatatatatgttgcttaagacaaccacaaagtgtgaaataaaatctatgatgtgtcctttcttgctagaaatagtaaattcatatttattctgacttatggtctcagataatatattttcctttgctattttttgtattgagtttttcttactgatgcctttttccaagttaaggaataatgttagatttaggtatatagagtaataatatttcaatgcattctcaacccattcaaatttccaacataaaagagatggtagaatttatacaaaatcatcattttttgccttaaaacttaaataggtatcaaaattgtattacaccatagtaaaaattgacacaatttttaggatattttagtatgacataaactcattttcattcttggtcttaaatggcaagattttctgccatgcagtggtagcaaaatatgttgaattcattgattgatttttaagcatgataataattaagtaaaagcttcttgacacctaaagtctctgttttagacaattaaattctgctttagctaagggttattgacttctgtatgatactgggagcaacactcctcagggtttaaactattcttgcaggaccatctgttatttgcagggactgtgcatcctctccagctgatactgtgtgaacccaggcgtatttcaggattgttcctcacatggccctggttcctgatgatcttttggtctcaaatggcaactcagtaaatccaaatactggtatgccactacttaaagtatgaaaatcttagagaatataagaaagttcctcaaagtaagagactgtgtcttacttacctttgtatttctaacactgaacccacaacagtgctgaaaagagtgaacttagtaggcattcagtaaattttgatgcaacctgaagatcagtgatcttgaaattttattttatatatataagattttccactgatttaatctttacaacaatcattcaagaaagacatcatttatgttcaaaatatattcttccatcacttagagatgtctgtgggtcccattttctcagtaattttggacatatcattatgtctgcccatcatatcatggtttttcatattaggaaataatgagaaggcaagaggtgagctaaacaaacaggatcaaattccttcacttccaagcctcttcaccccaaccttttatttaaacctttcagtacttagatcattgatttattacttctaaacataatgatcaatatatgtactttcataggtgcttgatagagatacgtgtttgtaagaaaaataccgtatcacattaaagttttcttaatagacttttgagccatccagacagtatgccagaatcaagtataaattctataaaaagaagcaaaataataactgaatagtgattaatgcagtgtctagcaactatattaattttagaaagataaacttggtgtctaatagaacttatagaatagttacacattctcaagtttccaatgcacctttgggattatttggcctatttaattctttttctgactgaagaaatggagactagagaactaatttgatatttggagtaacaaaaactgacttgatgaactactacataaagactgtgatactgggcacatcatttaaatgcactagtccttgctttccttgtctgcaaaatgggtgtaatcatgccaaatccatataaagttgtcctaagattaagtgaatatatatatatatatatatatatatatatatatatatctggctcgcaatagccagacactcagaaaatgttacctgtttttctacctcctgtccaagaataccagcttgccattgacagatgtttgcacattcatttagtgaatgctttcttgattttgtttttggttgttttcttgaatctgatttctattgtatctttttcacgactcacctgtgttcatctgcttttgtgttaaaacactatctggtttcagattatttaggacttttggaaaattgatcttcataacagtatctcaatatagcatatttgatgttgttttttatcttaatccctgttgtttcacatttgtataattgcttcgtctttcattttgagtattttacctatttcatttgcatgtcatgttttaaaattattctgttccttttagtgtttgtaatgaatttacgtccccatagattacccagaagctccacccatctgggaattttcaccgtatccatcactcctattacaaaatcacatataagagagaatctgtttcacagtcagtacttaacacagctggaatcatttgaaacctgctggttcttgcttccaattattccatagactggaaagcatccctgttgaagtaatggcatccatggtgtaatcaaaccagctaaaatgcctcaaagtatatggatcatatttctgagattgattgaattcatggtagaagcataatcaccaacagcttttactatttttcttaatttaacttatattcattttataagtaagtttttcatgtctcaatatacaagtttgtaatgtttgagtatgtgagtgacataataacataaatgagacacaacaaataaaaatattacacactacggtagtaccccaaaaataccttttgataatatcctggggccaaaatcatttccttttgttggaacagctgaaaccatcacgataaagttactgatttgtatttagagcagaatgtagtggagatttgttactagttcaattaactttatcaactaaataagaagtagatatagtcaaatttcaattggctttgttgtgattttgattgaataaattaaatatgtaacttcttgttgaacttaaccaccctctcagtgcaatacaattgttttggattggtcttttagtttagttctagttttatataagaagacagtttcataagacaagaatttaaaacaaaacaaacttaaaattaaaatactcattctttgtgcttagaaagcttaatctaacacataaaacctggaaaactggtgtgattttctttaggcttctgcttgttttatgctaagatgtgatatccattttatagcattgggataccaaacagggcagggacatagtgtggatattatcttgaatatcagacctcttagggttattacaaggattgtagcatggcatatagtacatgtttggtaaattctatttaatcccaccacataggcagacatggacctaatcaggcaaaatgttaaacacattttaaatggttaaaatcaggctttaaggatttggattcattgttttatttgaaatatttagcattctcatggcatcaagtatgtatacatgtatactgtatgaagcgatatatttattatatactgctaaatgtatattcaaaaggctaccattttatgtttttcatatcagtcgtttcctctattagcttttttttttcttttttttttttttttttttttttttttttttgtgacggagtctctgtcgtccaggctggagtgcagtggtgtgatcttggctcactgcaagctccgcctcccgggttcaagccattctcctgcctcagcctcccaagtagctgggactacaggcgcccgccaccacacccggctaattttttatatttttagtagagatggggtttcatcgtgttagccaggatggtctcgatctcctgacctcgtgatctgcccgcctcggcctcccaaagtgctgagattacaggggtgagccaccgcgccttctattagcttttataatggagaggtaactgtcctagaaagtccatgtaaattccagttcagataatgaacaattacttattctatgaagacatttatatttcctggactgtacctttcacatctttccctatgtgaatgggttccctgaagaactttttctgcctgctgagcacttatttggaggtaagtctaacaatgagatgatatccaaacttatcactagactactgaacgatattctattttccctaatggataccaatgcttattccagaattatattctatagttttaaattttcatgctttcaaaagtatctgacatttagctgtgaaattttctgctgccaaagaccttgtcatatgatccacggacagatacacagctaggctttttaaattttgtattaattctgttattcaacacacatctaataaataactgctgtgatccaggaacagcattagacaataggaaattttttttaagataaaaaaaattgtctttggtttaaaatattccattaaattttaagcacagtacttttttcccttggaatttccttattaaaaaaaatatgagttcactctcaattttaaatagatgtcatcatttccctgaaatatattttttaaagtctctctctctcacattttttttaactactgctggagacttgatctttcaatggggtaataagattctaagatctattactctaattataagaatgccaggtttaaatttatcctttggttaatttggagggaaatgtactttttcattcttaaaatcacactccttctacaggcaaaggtgttaataaaatatagtagcaagtaaaacttcatttttttactagatgagattagcatatttgctatattaaaaattactttaaaaacatggcacacatgaataatgttgaatgataacccaagctaaagtagacagtggttctctaaaaatggaatttcacttgtagagacatccattttgaaaagggctgtttcaagtcatgatattttgaaaaaatgttttagccttcgtacgttgaaaggacatgtttaccacagatatggaacatagatattaaattctggctggaataaatgtttggtttaattggcttctgcctccagatggttctgattttatcaagtccattttcttatgaatatttatcacagtacttcaaggaaccaatgcaatgatataaacgttgaaaacaagagacctttattttatatatatatgttttcctaaattgagaaacatacatatcctgaaaatttagttttctttcatcatcgaagaaaatgtcataattcggctattacagccaagacagactatgtttttttaactcaattatttctaaaacactaacttacatatggataaatgtttatataggaaggtcatccccaaatttcaaatttttatttaagccaaaaatttgtattttaaaaaataatgcatataatgcctcacctgcacattcttgtacaaacatattttaggagataaatctttattgccagaaaacatactattttaattgcaattagacttctgtgataaccatcaagctggtgcctaaatctaaaaggatctttccaactgttctgtggatgcttaggcttaggcaactatcaccaagtaattactataatttaaatgaactacgaaattgaaacctgctaaaatatgtagacctcaggaatcaaatgtgtattaacacttgttaattaaatattattggttaaaattaatttagaaattattattgggttgatatgaccaaccaaaaaactatatgtaaatcacttcttaatactatgaaaatatgaacagtttggtaaactaatttagaaccaagcaacaggatatattaagcttaggaagatacagacatttaaataaaggttggtatagaagtcacatgatagttgctctgtctgtagtaaccaatttctaaataaaatcaaaaatgtggcattctcaccacttttcacagtgacaattaacttggtgtttttacgtagtttcaattccttgcttattctgatttttataagtgactatgcaatgtattaccacataaaataaaacagtagtggttattaaaatcagtacttaaattttcccattttaaaaagtgtagaatacattattttctctctttttggctacaataatgtctattcaaaaccatttatactttgctagaattacacttagcatcttgagaattcagttttctcctctgaaaattagataattggactcaaccatttttttatttctattattaaaaattgaactacagcttttgttaattacttagggaaacattactccttggcaggttttctcttgccacccaacatccatctggcctacttctttctattatcagttgatatatgttcaaatagtgcacatcagtgttaacattggctcaagaaaaacaattacaaaataaatcacatggttcagtctctcctgacaatgaatgatttgcaatattcccattgtttgtatgatctatgttatcactctcttgcattagtgttgataacacagtattgcctctatcttttttgaggttgctctgtgattaattttccccttctgaactagaaaattaacttttttctcttgaattagaaatcaaaaaacagaactacaaaaccttgagcagattgttggcatttattatttgattggaaaaccatgaacttaaaatcattatgtagctgccatatttttatcagtaatattactcttataatgtttgattttattgtctatagtaacacattaaggtgactttagcatatttcaacttttgttaatgttggagaattacacatagttttgcaataatgtgtaaatgtaataaaaatatcaaacagtggtaattttgactgataatgttagttatcaggacaagtgttagaaaagcaaatttaatcaaatggtgcccactgattttataggcagtttcttcattcaaagtaaaagtgatgttaaattgaagaacttgtcagtctcatgctggaggaaaatcagctttaggattagaaaaaccaaactgcaaattagatgaaataccacattaattagatgaaataccacattaatgttaaaaaaaaccggtgttatttggttacatggaaataaaataaaacggttttgccatcaatgagtctaacacattttcttcacaacactgcagaaataagaacccacaggatggttctgaatcttgaacagcagcttaggaatacttactcgtctaataactcaatttgcttgcatttactactacttactgcattgtaccctttcatcttctaacaagtttaggaagaccaaattcttttggtgtttttgatagagatatggtaaagagactattttacactgtagatggatcggtctaggagtcactttgtaagtttggaaaattgacatcgatggaggagatgtattaaatagttccagaaatgccacattttggatgcaagacactttttaatcatattaagcagtctctttaatgctcacaccctgaatgccttccttaaaatgttctaaacacttccaatttgaagaggggttaaaatataaatgtggtaaacaaatcacagaaagaatatacattcttaaggaattgttcttcttatgttatggtcttccaagtgcgccaatgacatcggaagtatgtggtgctaaggtgaggcattctgtgtaatggcttagttgcaggactcaagtactgggaattcagtcaattctgctcttgtaatacattgtgttggctttcagaacaatactccagtgtttttcaggggaaggtatgagtgtttccctaatagaagagcagatgttgtagccaatactgagaggtaggaaagatatataatacttacacaatctaaaatttcacctaaagtaacgtttaaataaagtttgtttagtaatcatcagtgttctgttgtctgtaatgaccaacttcaccataaaatcagaaaggtggcaatgtcaacatcacaaacagtggcagcaaacatggtgctgttctaaatacagattgtgtatcccaagccctttgcttttttctatggatattcctccaactactcgtatcaaagatgtatgttctggtaaagccttctgtattggcagctcctgctgcttttctgtcatattcaaacatgaccaacagcaaatgtacttacattttttttcagccaattctttcttatttctagtgacagtagtaaatttacttatagcagtaaagaaaatatgagaaatacttttctgtagtgccaaatgttttaatcactgcctatatcagcctaattgtttcctaatcaaaaattgtgagaatctaatttttggtcaaaattgtttattatggagattttgcacatataggaaaaaagtgacataaatattattaatactaagtgacattaatatgtcattggggaataaccatatggctctctgaacatgatatgctttctaagtattcatccaacaaatatatggtcatttggaggctactaaaaataaagcccaccaattttttaatgttgataatgcctctgacaggaaattttaaggaatatgaaagtaaaacaaaaaaatagtttgtgtcaaatgaacacgcaaggatttttgcataagacacacattagctatttagggcattaattgattgatgaaatattagcagtatctggcaaggttagaagatggacagataaagaaaattctgtgagttcatagagcattgtcagagtgagcattccagggacaatacagtgtgaattacagctatttgattaatcgaatcagttctgtattgtaaaagtacaaagagatggtgttactggaatctgatttggaattggatgcttgtagattaataaactggtatagactgtgcttcccaatattttgcctcaaaaaagaataaattcattaggaattggaacaaaagcaatgttacataacctttgtagtattagagtagtctatatagggaaaaagctaataataaaaagtaatcaattcattaatctcaatggtttgctattggcattgaaactaattattgatcgcattgacatgattagtcatagctttattactagaaatgtgaacatgattttaaacatatgtaaaactaactggccaaaataatccacagttaatttcagctaaatagctaacaatttcacaggaaaagtggaagatatttgaggctttgtaaagagaagatcacagcattcaccttggtaccattatcttttgatttctagaaacacagtttgcaatgccttgaaagtagatgtcaaacaccagctaatgataataactgatatttattaagtactccatgtgcgtgaagttcctctcagcactttacatgtattaattcaaatagaaccaactactttctgaggaggatactgttattattgtccgtattttacagctgaggagaagttgaatgatttgcttcaggtcacagttctagtcaggggagaatagtttacggttccaaccctagcagtcttagacactgcgctctcttagctgctaattaatactgtctctatcatggaacttttatacaaaacataaacttgtagttagtcagcaaaagtaaattttgccaaaaagaaatttggccattttaacctttttttaaaggttaaaaaaaaaatcaccgaagtctaatttaaccttttttttttttttgcttcattattatacaaattttgccactgagcacatagcattatgacagaactattcctgagacatggggagatactttacagtttacaatgaacattcacagacagtatatgtgaaaagtagaaattagcatttgtatcttttaggcagtacgattcgagatatttttcacaaacgtgaattttagttgttaatttaaataaatttgctcatctcaaagcagagttttgtgattattcttattttatacaatgcctcatatcagataagaaaagatctagaagaggggaaagtcaaactctaatgataacaagtgtatctcagtcctagactacttgactggaatgatgctttcctttctttttaaatctttattccagcccctgtgcctgaatggttcagaagcaaccaccaggcatctctgcacaaatttgccagctaagatcagtataggccctcctccaacttatctgcaatgcactgggagaatatatcttcatatctatttagaaacatgcatataagttattttaatactatttatacaattttagcattttcctagagtaggttttccactttcatcacccacagctacaaaattattcagttattttctacagttttacaaatataccatattacgggctgcttaatatcttccttgtttaagactttaacagtatcagccgggcgtggtggctcacgcttgtaatcccagctctttgggaggcgggcagatcatgagctcaggagttcgagaccagcctggccaatatggtgaaaccctgtctctactaaaaatacaaaaattagttgggcgtggtggtgcgcgcctgtagtcccagctactcgggagactgaggcagaagaatcgcttgaatccaggaggcagagcttgcagtgagccgagatcatgccactgcactccagcctgggcaacagagtgagactctgtctcaaaacaagcaaacaaaaaaaaaaactttaacagtattttgtaaatgccagtgtggtggcttacacctttaatcccagcactttgtgaggccgaggcggatggatcacttgagttcaggagtttgagagctgcctagacaacatagcgagaccccatctctacaaaaaatacaaaaaatatccaggcgtggtgacgccttggcactagagcaagaccctgtctaaaacataaataagtacataaataaaaataaaattcatcaaccgcgtgttgaattctcaagattccccttaaacctgagaactggagagagccatttcagttatatagtaaaattaaatttgtttatcatggattattataatggacgtatattgataaaatgtctaggtgagaattttacagttgtaattggaggtccatttaaaggttaaaatgaaatagagagttatggatgcacagctttccatattgtgtttggcaaaggaaattgattctcggaatgatatgctaccctttttgtccactatgtgtagtgcatatggatgatggaatcactttcatgagtacagttcttatttagaacacacattccgtaatatccctagaaaataaaaaagatttatgtgttcaaaaggagtttcttgatatgagacaagcagactgactttcaattacaaacacttagaattctgaaccttgcatttttattgcgagaactcagttattttccaaagcttggtttgagagctattttcaggcagcagctttttcttgaagtcccttactgataagtatagtaagcagaaatatttcaattactctaattaaaaagcagtattcaacatgttgactgaaggtggagtttatgttgttcaccagacaatgagaaattgggaagggactattttagatagatcattgatgtgagaaagttaaattcacctgttaatttgtcaataaactagaacagcagggtttcctttgttaaaatataagataatatattggaaacgcataattcttagacatgaactcaaagacatgcaggcaggtttacttttagctcatggcatatgcaaagataggcatcaatttgtggtgaggatatgaggaagtttttatctgtacatttgtttaaagagtcatgtttagagaagcattttttaatagatactcttttcaatggaactcatatttaattagaccaaacataaaagccaacactttaagtaatctctttttagcagattttcatggaagagtgccaaattgttttggtttcactataggtttacagtcttctgatagaattcccagttgggatttgaaaaccaaactgtgtcatacagacatgaatacagtggcctaacgtgatgtgttgaattagctttctagatgacttaaagtatagctggggttttcctttatccagggactaacattcaaggttttgtgaaaaagaaaattaattttgcattgacattctggatgttggtgataatttgtagtgacattatgcctattggttgtgattgtgacaggcaggcagactggatccaaatggacattacaagagccaaattaaatagtctgagcattggaaatttctgccttaaggaaagcagaagcttttcagcatgcacttgttttctacctccacaattatggattaatatacatcaattctaggcagttgaggaatgacatgagaggattaatggaactggacaacattacacaagtgaagtgaaaattctgtaatgatttttctgaggtgatgtagtagacaaggcaaatgggcatcagctcctagactttgcacctttagaatttcaagaaaatgattgaaaagagaaatggaaaacaactatctaactaaagctggcataataatttttctcatcaaatatatacatcatttttcacaaataaggaggagttattcaactgagtaagccagtactgtgtgcagtgtatgattttatccaaaaattgtggccacttttatctcttaaaactgtttagagaaaaattgtgcttagtgtgtatccacaataagaaaaacagattagatgcaaaaataaatatacataaccagccttatatgtaatcatactcattttgctttatgaaatatctctgaggggaaaatattttttccatgtctttttgaagttttaataagattttttaaccccaatatattgagctgccctaatgcctactatttatttttttctcttctacaaagtttacctatcatatcatatttatggcaacattttctactactaagactgtggcggtttttttccaagttatctgaaaacttgactgtcattattgcaaattgattatttccataaaggtgctttaataaaatttctgttcttagactttaatttggtaagctcttacacatatttatacataatttgtgataggagttttaatctttagatttttacaatgtgattttctcatatctattcattggaagaggtagacttcttttctttaattgcatgcattttatcctttaaccacaaaatgtgtttaaaagctatgcaagaattagcaaaagtaaactacagcaatattaaaatgacttatttggtatcacctttacagacccagctcacttaggcaatggtattctagtaaattacaatattttttaaagcatagttttttttgttacctcttgaaatagtgattttaaagccaaaagggtcaagagtatgccaaatttaagatgattatttggaaaagagagatatcagcaacttaagtatgctgtatttaaggtgattgtaaaagagtttttttatatacaggacagcattaaaacagaattacaaagtctattaaccataatgaaggagttcaagatgcagataaaattaaatgattgtctttaagctttcaataaatttgttagccaatttaagaataattgcagcttatgaaagcttgtttatatttatctaatttcaaaaattaagaaagaattaaaggatatttgaagttcttattatgtagtttctaacattgtgagagaatggtcaaaagactgctatgtcttatttagtgtaaatgtgtacatactttacagttaaaggaattactgctttgctaccatcaaggtcttaaaaccctgtatcaaaacaacctagagatttgcttcattaactcctgttcatttcgcagggcaagaaataagatcctctttggcaatcacgtgttacctgaattatatttaatctctttattaccttggaaatataccaagacactcacatattcacatacacacagcacacacacatacaaccctgatgcaaatatggacaaaatgaacaccctcacttatacatcagtccatttcttcctctcataaattgaatgtgaatagctctgatggcatttctctctgactgaaaaataaggtgccatgcttactccatgcaaaacccctgttttacagttttatgcccctcactaaaaatagataaatctgcatttgtatgtgtcctctactcagcctccctcatgccgcctgacttcttgcagaaggtgtatatgcttttcattctgaccaataagaggcaacttggtgagttatagagattgactgggtgcttgacatgtggtgctgctccattaaaacagtgggcagttggtactggggaggtttaggagaatttaagttgtctttattgttattagatgtgctcttagatgtggtaatattctaatattctattaaaaaatataaaaatgcaacttcagttcacattataataggttttctcatattgcttttgtggtccagatgtgaaacataacaataataatatgtaattctataatcatcttctaatgttaccaggtaatttttgtagacagagccagataaccctattgctcattatttaagtgcaaagtacattttttcaatcattattgcctaagaaatttttaggagatgatggttgaatggtccttctcctcacctcaccacaccaagataggttggtatgtgtgtttgtgtttccttgctttcactttttaaaggatcctatagaaaataacagtattgtttccatttaaaaaaaaaacttgataatttatattccattttatttctgaaaaatagccacatttttacataccccaaataaatcgccatgtgtaactatgtgcaaaaaataattgaatgtggctgaaaacgatctcacttgttgtactataatgtatgaataataataaatgtaaaacccttgaaatcacattttcttataatactattctataggtaacacttacagtacagtatattaaattggtactttgtgaaatgaattcttgagatacttaggcactacacaaagcattattattaaagaattataggggaaattttcccaattgaaaattgataattaaaggtatttaaattatgtatgttgcagagcaggtaagaagttcaatgtagcaatatatttctattttgatttcaaattaagttttaattacacaaaaaattggctcaagaactaggtgatacattttagaaaattttaaatagccaaaataatgttgaaatatgttatatggataatttatcaataaaaattattactgttaaaaattggtagaattctttcctccctgtgataaatgatttaagttgaatgggaatttaagtaacatacagggatgcatcttaatacctatatttgctcaacagtggtaaacacacaattaaaacttgtcctcattaaaatggacttttgtacactataatttgaagtaagtaatgaatatataaagtatttaaagagttgtatatcaaaatgtataacgttccatttttggctatattttgtaaaacatttttggtgtaatcagtatgactatcacatatgtcaaatcaagtattctactatttatttaaacggatatatacctaatgtatttgaaagcttattgcactcataaaattgtatatattgtggcttcaaaagtctgtacttattcttgctttaaaaaagtagtatgtgcatttctttccaatttatttttaattaattatattaaggataacattctttactaaatgtaccttaaaattcacaataaagtttcagaaattgttttgta

SEQ ID NO: 172092 - DNA, 5709 bp, Homo sapiens
  Payload ID: 13810
  Gene Symbol: PCDH9
  Gene Name: protocadherin 9
  Uniprot ID: Q9HC56
  ENST ID: ENST00000377865
  CDS Start-End: 175-3888
gcagcatactgggaaaggggaaaggttgaggcaactaaccggctgtctccaaataagtgatgagatataatgcatcctccagtccatgcacgcttcctcttgcaatttgtgcatcattcctcagtggaaacctttaaaccctaaaatccaggaaaagaaaataaatacattatcatggacctgagggatttttacctgttggctgctctgattgcctgtttaaggctggattccgcaatagctcaagaacttatttacactattagagaggaattgcctgaaaatgtgcccataggaaacataccaaaggatctgaacatttctcacatcaatgctgccacagggaccagcgccagccttgtctacagactggtttctaaagctggggatgcccctttggtgaaagtttccagcagcactggggaaattttcacaacctccaacagaatagacagagaaaaactctgtgctggcgcctcatatgctgaggagaatgagtgtttctttgaacttgaggtggtgatcctccccaatgatttcttcaggctgatcaaaataaaaataattgtcaaggataccaatgataatgcccccatgtttccatctcctgtcatcaatatttccattccagaaaacactttgatcaacagccgctttccaattccatcagcaacagatcctgacacaggcttcaatggtgtacagcattatgaattgttaaatgggcagagtgtttttggactggatatcgtggaaactccagagggagagaagtggccacaactgattgttcagcaaaacttggatagagaacagaaagatacctatgtgatgaaaatcaaagtagaggatggaggcactccacagaaatccagtacggccatactgcaggtcacagtaagtgatgtaaatgacaacaggccagtgtttaaagagggtcaagtggaggtgcatattccagagaatgctcccgtaggtacctctgtaattcagctccatgccactgatgcagatataggcagtaatgctgaaatccggtacatttttggtgcccaggtcgcccctgcaaccaaaagactctttgctttaaataatactactgggctgattacagttcagaggtccttagatagagaggagacagccattcacaaagtgacagtgctggctagtgacggcagctccactcctgctcgagcaacggttaccatcaatgtcaccgatgtaaatgataaccctcctaatatagacctcaggtacattataagtcccatcaatggcaccgtgtatttatctgagaaagatcctgtcaatacaaagattgccctaattacagtttcagataaggacacagatgtgaatggcaaagtgatctgttttattgaaagagaggtcccatttcatttgaaggcggtatatgacaaccaatatttgttagagacctcttctttgttggactatgagggcaccaaagaattcagctttaaaattgttgcctctgattctgggaagcccagtttaaatcagactgccctggtaagggttaagcttgaggatgaaaatgacaacccaccaattttcaaccagcctgtaattgagctgtcagtttctgaaaacaaccgacgtgggttatacttaacaactattagtgccacagatgaagacagtgggaaaaatgcagacattgtttatcagcttggaccgaatgcctccttctttgatctggaccgaaaaacaggagttttgacagcctccagagtatttgacagagaagaacaagaacgattcatttttacagtaactgccagggacaatgggacccctcccctccaaagccaagcggctgtgattgttactgttctggatgagaatgacaatagccccaagtttactcataatcattttcaattttttgtgtctgagaatctgccaaagtatagtactgtgggggtaatcacagtgacagatgcagatgctggagagaataaagctgtgactctttccattctaaatgacaatgataattttgtgttggatccctattctggagtcataaagtcaaatgtctcatttgatagagagcagcagagttcctacacttttgatgtcaaagccactgatggaggacaaccacctcgttcctctactgcaaaagtaactatcaacgtcatggatgtcaatgacaacagcccagttgtcatttctccaccgtctaatacttcctttaagttggtgcccctctcagccattcctggctccgtggtagcagaagtttttgcagtggatgttgacactggaatgaacgctgaactaaagtatactatagtgagtggaaacaataaaggcttattccggattgatccagtaacaggtaacattactctggaagaaaaaccagcacctactgatgtgggattgcatcgtttggtggtcaacataagtgacctggggtaccctaagtctttgcacacgcttgtgcttgtattcctttatgttaacgacactgctggaaatgcctcctatatctatgacttgatccgcaggactatggagaccccgttggacaggaacataggggatagtagccaaccctatcaaaatgaggactatctaaccatcatgattgccatcatcgccggtgccatggtggtcattgttgtgatcttcgtcaccgttctggtgcgctgtcgccatgcatcaaggttcaaagcagctcagaggagcaagcaaggtgccgaatggatgtccccaaaccaggagaacaagcaaaacaagaaaaagaaaagaaagaaaaggaagtctcccaaaagctctcttttgaactttgttactatcgaagagtccaaacccgatgatgcagttcatgaacctatcaatgggacaataagcctgccggctgaactggaggagcaaagtataggaagatttgactggggcccggcacctccaacaacattcaagcctaacagtcctgacctggccaagcactacaaatctgcttctccacagcctgcttttcatctcaaaccagacactccagtttccgtgaaaaagcaccacgtgattcaggaactccctttggacaacacctttgttgggggttgtgacaccctttctaaacgctcttccactagttcagatcacttcagtgcctcagagtgcagttcccaaggaggcttcaagacaaagggccccttacacaccagacagtgtaactcacacagcaaaagtgacaatattcctgtcactcctcagaaatgtcccagctccacgggtttccacattcaggagaatgaagaaagccattacgagtcgcagcgccgtgttacgtttcatctccctgatggctcccaggaaagctgcagtgacagtggtctaggagaccatgagccggtgggtagtggaaccctgatctcacaccctcttcctctggttcagccacaggacgaattctatgaccaggcctctccggacaagaggactgaagcagatggcaactctgatcccaactctgatgggcctttgggtccccgaggattagctgaagctacagagatgtgcactcaagagtgcttggttttgggtcactctgataattgctggatgcctcctggcttgggtccatatcaacaccccaaatctcctctctcaacctttgcaccccagaaagaatgggtgaagaaggacaagcttgtgaatgggcacaccctgaccagagcctggaaagaagacagcaacaggaaccagttcaatgaccgtaagcagtatggctccaatgaaggccatttcaacaatggcagccacatgacagacattcctctggcaaatctgaagtcttataagcaagcaggaggtgctactgagagtcctaaggagcaccaactctaagaaaaggctatatgggacctaataactttaaatagacatgctaataccgtgtgcgtcagagctttatgtattcaatagatctctacaactatgccccttctagcagggatacctataactttgtgttagcaccatggagaatacaatgtttttgcaacatatgagagaagatagttctagccatgcaattttgtttactagaattgattacactctccagagatctctccattgtgcaaattttttttattattgcattttattttgaccctggactgctgctatgaacaatagaatatgcatttggaaagtaagaaagtttcatggattagagtgactgaaaaacatatccagttagaaaattgtgcttttttttttttttttttttttttttgtcattgatttgtgctgggactgctatacttgacattatactgcaaacaaaacttaaagagataagcattaaacctattgtgctgttaacaacgttagtggacacttgtaagtcaatcagtgttaaagtatttgtaaatagaagcaagctattattaacaacttttgtgtacttataatgttcacctaaaaatgttgtagcataattctgtgttttatggttgcttctgtccttctttttatttacctctttgttgttatttttgttgtttctttcagtgaggtgtttctgtgttagtagtctgtcttgacacacattgttcaaacaatctcaagcacttgtgtttaaaaaaggttctgaaatcttgcttctcatatgatagcttatgatgccggaattctgtaaacaataaagatgaaagaaaaaatgaaaactttatacaaaaaaggacttctgcaaaagcttggaaattcagaacctattttttatcatcttattttcaaagtaggcaaaagcaaaatcacttaattagtaccattaagtgagagagtaatggaaaactgttatccatcaaaagtgatataatatcctgtacttgtcactcatgtaaaactaatgtatcaaaattagcatatatggaagaaaaatcactattcaaaaatagtttcaattgggcaaatgtgtgtctacaactttgttgaaatggcagagtctgtgttgatcctcatatacaataatgttgttgtaacacaagtgttattagaccatagccacaaaatatttaatgtgttgtgccttcatgatgtaacagaacattctccaggtagggtagttgggggaaataaagggataaatctctaattattgctgtttaactgtttgttatcatagttggtcaatgcctggcaggtaccagcatattgtcacttaggtcaaaccaataaagtgacaactaatgttaataagatctcagttgcacgtgcaaacaaatccaaattcgaacattcttaggaggtttttgttaaggcatgacagatgatttaaacaaataaatagcatgcaacaaaatgtctttattgaaagaagtggaagttatcttaatgccacggttcaccatcaatttaaaagtaaaaaaaacaaaaaaaaaacaaaaaatttaaaaaaaaggtttgctaatctgatagttaatttgttcttaccaaaaaataaaattactttgtaaatagcagttcacatttttccacagtataatggaaaataatgggtaggggtgcattgcttattgaagtacatttttgtcggtttgtgaggggtgtttgatgactttgacagaataaatatctaaacaattatccttgttactgctttgccagttctacgttatttacaattattcagctcttgcaataaatgttctgaattcctga

SEQ ID NO: 172093 - DNA, 5072 bp, Homo sapiens
  Payload ID: 13810
  Gene Symbol: PCDH9
  Gene Name: protocadherin 9
  ENST ID: ENST00000456367
  CDS Start-End: 175-3762
gcagcatactgggaaaggggaaaggttgaggcaactaaccggctgtctccaaataagtgatgagatataatgcatcctccagtccatgcacgcttcctcttgcaatttgtgcatcattcctcagtggaaacctttaaaccctaaaatccaggaaaagaaaataaatacattatcatggacctgagggatttttacctgttggctgctctgattgcctgtttaaggctggattccgcaatagctcaagaacttatttacactattagagaggaattgcctgaaaatgtgcccataggaaacataccaaaggatctgaacatttctcacatcaatgctgccacagggaccagcgccagccttgtctacagactggtttctaaagctggggatgcccctttggtgaaagtttccagcagcactggggaaattttcacaacctccaacagaatagacagagaaaaactctgtgctggcgcctcatatgctgaggagaatgagtgtttctttgaacttgaggtggtgatcctccccaatgatttcttcaggctgatcaaaataaaaataattgtcaaggataccaatgataatgcccccatgtttccatctcctgtcatcaatatttccattccagaaaacactttgatcaacagccgctttccaattccatcagcaacagatcctgacacaggcttcaatggtgtacagcattatgaattgttaaatgggcagagtgtttttggactggatatcgtggaaactccagagggagagaagtggccacaactgattgttcagcaaaacttggatagagaacagaaagatacctatgtgatgaaaatcaaagtagaggatggaggcactccacagaaatccagtacggccatactgcaggtcacagtaagtgatgtaaatgacaacaggccagtgtttaaagagggtcaagtggaggtgcatattccagagaatgctcccgtaggtacctctgtaattcagctccatgccactgatgcagatataggcagtaatgctgaaatccggtacatttttggtgcccaggtcgcccctgcaaccaaaagactctttgctttaaataatactactgggctgattacagttcagaggtccttagatagagaggagacagccattcacaaagtgacagtgctggctagtgacggcagctccactcctgctcgagcaacggttaccatcaatgtcaccgatgtaaatgataaccctcctaatatagacctcaggtacattataagtcccatcaatggcaccgtgtatttatctgagaaagatcctgtcaatacaaagattgccctaattacagtttcagataaggacacagatgtgaatggcaaagtgatctgttttattgaaagagaggtcccatttcatttgaaggcggtatatgacaaccaatatttgttagagacctcttctttgttggactatgagggcaccaaagaattcagctttaaaattgttgcctctgattctgggaagcccagtttaaatcagactgccctggtaagggttaagcttgaggatgaaaatgacaacccaccaattttcaaccagcctgtaattgagctgtcagtttctgaaaacaaccgacgtgggttatacttaacaactattagtgccacagatgaagacagtgggaaaaatgcagacattgtttatcagcttggaccgaatgcctccttctttgatctggaccgaaaaacaggagttttgacagcctccagagtatttgacagagaagaacaagaacgattcatttttacagtaactgccagggacaatgggacccctcccctccaaagccaagcggctgtgattgttactgttctggatgagaatgacaatagccccaagtttactcataatcattttcaattttttgtgtctgagaatctgccaaagtatagtactgtgggggtaatcacagtgacagatgcagatgctggagagaataaagctgtgactctttccattctaaatgacaatgataattttgtgttggatccctattctggagtcataaagtcaaatgtctcatttgatagagagcagcagagttcctacacttttgatgtcaaagccactgatggaggacaaccacctcgttcctctactgcaaaagtaactatcaacgtcatggatgtcaatgacaacagcccagttgtcatttctccaccgtctaatacttcctttaagttggtgcccctctcagccattcctggctccgtggtagcagaagtttttgcagtggatgttgacactggaatgaacgctgaactaaagtatactatagtgagtggaaacaataaaggcttattccggattgatccagtaacaggtaacattactctggaagaaaaaccagcacctactgatgtgggattgcatcgtttggtggtcaacataagtgacctggggtaccctaagtctttgcacacgcttgtgcttgtattcctttatgttaacgacactgctggaaatgcctcctatatctatgacttgatccgcaggactatggagaccccgttggacaggaacataggggatagtagccaaccctatcaaaatgaggactatctaaccatcatgattgccatcatcgccggtgccatggtggtcattgttgtgatcttcgtcaccgttctggtgcgctgtcgccatgcatcaaggttcaaagcagctcagaggagcaagcaaggtgccgaatggatgtccccaaaccaggagaacaagcaaaacaagaaaaagaaaagaaagaaaaggaagtctcccaaaagctctcttttgaactttgttactatcgaagagtccaaacccgatgatgcagttcatgaacctatcaatgggacaataagcctgccggctgaactggaggagcaaagtataggaagatttgactggggcccggcacctccaacaacattcaagcctaacagtcctgacctggccaagcactacaaatctgcttctccacagcctgcttttcatctcaaaccagacactccagtttccgtgaaaaagcaccacgtgattcaggaactccctttggacaacacctttgttgggggttgtgacaccctttctaaacgctcttccactagttcagatcacttcagtgcctcagagtgcagttcccaaggaggcttcaagacaaagggccccttacacaccagacagtgtaactcacacagcaaaagtgacaatattcctgtcactcctcagaaatgtcccagctccacgggtttccacattcaggagaatgaagaaagccattacgagccacaggacgaattctatgaccaggcctctccggacaagaggactgaagcagatggcaactctgatcccaactctgatgggcctttgggtccccgaggattagctgaagctacagagatgtgcactcaagagtgcttggttttgggtcactctgataattgctggatgcctcctggcttgggtccatatcaacaccccaaatctcctctctcaacctttgcaccccagaaagaatgggtgaagaaggacaagcttgtgaatgggcacaccctgaccagagcctggaaagaagacagcaacaggaaccagttcaatgaccgtaagcagtatggctccaatgaaggccatttcaacaatggcagccacatgacagacattcctctggcaaatctgaagtcttataagcaagcaggaggtgctactgagagtcctaaggagcaccaactctaagaaaaggctatatgggacctaataactttaaatagacatgctaataccgtgtgcgtcagagctttatgtattcaatagatctctacaactatgccccttctagcagggatacctataactttgtgttagcaccatggagaatacaatgtttttgcaacatatgagagaagatagttctagccatgcaattttgtttactagaattgattacactctccagagatctctccattgtgcaaattttttttattattgcattttattttgaccctggactgctgctatgaacaatagaatatgcatttggaaagtaagaaagtttcatggattagagtgactgaaaaacatatccagttagaaaattgtgcttttttttttttttttttttttttttgtcattgatttgtgctgggactgctatacttgacattatactgcaaacaaaacttaaagagataagcattaaacctattgtgctgttaacaacgttagtggacacttgtaagtcaatcagtgttaaagtatttgtaaatagaagcaagctattattaacaacttttgtgtacttataatgttcacctaaaaatgttgtagcataattctgtgttttatggttgcttctgtccttctttttatttacctctttgttgttatttttgttgtttctttcagtgaggtgtttctgtgttagtagtctgtcttgacacacattgttcaaacaatctcaagcacttgtgtttaaaaaaggttctgaaatcttgcttctcatatgatagcttatgatgccggaattctgtaaacaataaagatgaaagaaaaaatgaaaactttatacaaaaaaggacttctgcaaaagcttggaaattcagaacctattttttatcatcttattttcaaagtaggcaaaagcaaaatcacttaattagtaccattaagtgagagagtaatggaaaactgttatccatcaaaagtgatataatatcctgtacttgtcactcatgtaaaactaatgtatcaaaattagcatatatggaagaaaaatcactattcaaaaatagtttcaattgggcaaatgtgtgtctacaactttgttgaaatggcagagtctgtgttgatcctcatatacaataatgttgttgtaacacaagtgttattagaccatagccacaaaatatttaatgtgttgtgccttcatgatgtaacagaacattctccaggtagggtagttgggggaaataaagggataaatctctaattattgctgtttaactgtttgttatcatagttggtcaatgcctggcaggtaccag

SEQ ID NO: 172094 - DNA, 6234 bp, Homo sapiens
  Payload ID: 13810
  Gene Symbol: PCDH9
  Gene Name: protocadherin 9
  Uniprot ID: Q9HC56
  ENST ID: ENST00000544246
  CDS Start-End: 802-4413
gggctgcggccgcccgcgccgcaagatgcaggccaatcagagcccgggggcggggcctgggcagtcacgccctccctctgggcttattgagagttatatcaagaaattcagttcagagagaggagagggagaaggagagaggggcagaggggaagggagagagggagagcacgcgagacggaaaggagcgcctcagagtctctgaagcacgcaagagataaccgattaggaatttttcgggcaactgtcacccggatagctgtcagagaatcatcatcaccgcaactctgacgtttcctacaagaagttagagacttaagcagtattggcatcggatggaaatggtatgcatgctgctgtggaaaatatccctgagctgaagaagtgcaactatgtgttgtgtgtgctaaatgcccagaagaacccagacccagtgggtaagagagacgaaatgtggagagaatgactaacgacaaatccgtgaatttgttctctggagttgctaatttgccagcccgaagcaacacattttacaaggaggaaacattttgctgcttctgatttctccccaaactggtgctaccagatgcatggctttctatgtgttggaacaaatcattcctaactgcagcatactgggaaaggggaaaggttgaggcaactaaccggctgtctccaaataagtgatgagatataatgcatcctccagtccatgcacgcttcctcttgcaatttgtgcatcattcctcagtggaaacctttaaaccctaaaatccaggaaaagaaaataaatacattatcatggacctgagggatttttacctgttggctgctctgattgcctgtttaaggctggattccgcaatagctcaagaacttatttacactattagagaggaattgcctgaaaatgtgcccataggaaacataccaaaggatctgaacatttctcacatcaatgctgccacagggaccagcgccagccttgtctacagactggtttctaaagctggggatgcccctttggtgaaagtttccagcagcactggggaaattttcacaacctccaacagaatagacagagaaaaactctgtgctggcgcctcatatgctgaggagaatgagtgtttctttgaacttgaggtggtgatcctccccaatgatttcttcaggctgatcaaaataaaaataattgtcaaggataccaatgataatgcccccatgtttccatctcctgtcatcaatatttccattccagaaaacactttgatcaacagccgctttccaattccatcagcaacagatcctgacacaggcttcaatggtgtacagcattatgaattgttaaatgggcagagtgtttttggactggatatcgtggaaactccagagggagagaagtggccacaactgattgttcagcaaaacttggatagagaacagaaagatacctatgtgatgaaaatcaaagtagaggatggaggcactccacagaaatccagtacggccatactgcaggtcacagtaagtgatgtaaatgacaacaggccagtgtttaaagagggtcaagtggaggtgcatattccagagaatgctcccgtaggtacctctgtaattcagctccatgccactgatgcagatataggcagtaatgctgaaatccggtacatttttggtgcccaggtcgcccctgcaaccaaaagactctttgctttaaataatactactgggctgattacagttcagaggtccttagatagagaggagacagccattcacaaagtgacagtgctggctagtgacggcagctccactcctgctcgagcaacggttaccatcaatgtcaccgatgtaaatgataaccctcctaatatagacctcaggtacattataagtcccatcaatggcaccgtgtatttatctgagaaagatcctgtcaatacaaagattgccctaattacagtttcagataaggacacagatgtgaatggcaaagtgatctgttttattgaaagagaggtcccatttcatttgaaggcggtatatgacaaccaatatttgttagagacctcttctttgttggactatgagggcaccaaagaattcagctttaaaattgttgcctctgattctgggaagcccagtttaaatcagactgccctggtaagggttaagcttgaggatgaaaatgacaacccaccaattttcaaccagcctgtaattgagctgtcagtttctgaaaacaaccgacgtgggttatacttaacaactattagtgccacagatgaagacagtgggaaaaatgcagacattgtttatcagcttggaccgaatgcctccttctttgatctggaccgaaaaacaggagttttgacagcctccagagtatttgacagagaagaacaagaacgattcatttttacagtaactgccagggacaatgggacccctcccctccaaagccaagcggctgtgattgttactgttctggatgagaatgacaatagccccaagtttactcataatcattttcaattttttgtgtctgagaatctgccaaagtatagtactgtgggggtaatcacagtgacagatgcagatgctggagagaataaagctgtgactctttccattctaaatgacaatgataattttgtgttggatccctattctggagtcataaagtcaaatgtctcatttgatagagagcagcagagttcctacacttttgatgtcaaagccactgatggaggacaaccacctcgttcctctactgcaaaagtaactatcaacgtcatggatgtcaatgacaacagcccagttgtcatttctccaccgtctaatacttcctttaagttggtgcccctctcagccattcctggctccgtggtagcagaagtttttgcagtggatgttgacactggaatgaacgctgaactaaagtatactatagtgagtggaaacaataaaggcttattccggattgatccagtaacaggtaacattactctggaagaaaaaccagcacctactgatgtgggattgcatcgtttggtggtcaacataagtgacctggggtaccctaagtctttgcacacgcttgtgcttgtattcctttatgttaacgacactgctggaaatgcctcctatatctatgacttgatccgcaggactatggagaccccgttggacaggaacataggggatagtagccaaccctatcaaaatgaggactatctaaccatcatgattgccatcatcgccggtgccatggtggtcattgttgtgatcttcgtcaccgttctggtgcgctgtcgccatgcatcaaggttcaaagcagctcagaggagcaagcaaggtgccgaatggatgtccccaaaccaggagaacaagcaaaacaagaaaaagaaaagaaagaaaaggaagtctcccaaaagctctcttttgaactttgttactatcgaagagtccaaacccgatgatgcagttcatgaacctatcaatgggacaataagcctgccggctgaactggaggagcaaagtataggaagatttgactggggcccggcacctccaacaacattcaagcctaacagtcctgacctggccaagcactacaaatctgcttctccacagcctgcttttcatctcaaaccagacactccagtttccgtgaaaaagcaccacgtgattcaggaactccctttggacaacacctttgttgggggttgtgacaccctttctaaacgctcttccactagttcagatcacttcagtgcctcagagtgcagttcccaaggaggcttcaagacaaagggccccttacacaccagacagtcgcagcgccgtgttacgtttcatctccctgatggctcccaggaaagctgcagtgacagtggtctaggagaccatgagccggtgggtagtggaaccctgatctcacaccctcttcctctggttcagccacaggacgaattctatgaccaggcctctccggacaagaggactgaagcagatggcaactctgatcccaactctgatgggcctttgggtccccgaggattagctgaagctacagagatgtgcactcaagagtgcttggttttgggtcactctgataattgctggatgcctcctggcttgggtccatatcaacaccccaaatctcctctctcaacctttgcaccccagaaagaatgggtgaagaaggacaagcttgtgaatgggcacaccctgaccagagcctggaaagaagacagcaacaggaaccagttcaatgaccgtaagcagtatggctccaatgaaggccatttcaacaatggcagccacatgacagacattcctctggcaaatctgaagtcttataagcaagcaggaggtgctactgagagtcctaaggagcaccaactctaagaaaaggctatatgggacctaataactttaaatagacatgctaataccgtgtgcgtcagagctttatgtattcaatagatctctacaactatgccccttctagcagggatacctataactttgtgttagcaccatggagaatacaatgtttttgcaacatatgagagaagatagttctagccatgcaattttgtttactagaattgattacactctccagagatctctccattgtgcaaattttttttattattgcattttattttgaccctggactgctgctatgaacaatagaatatgcatttggaaagtaagaaagtttcatggattagagtgactgaaaaacatatccagttagaaaattgtgcttttttttttttttttttttttttttgtcattgatttgtgctgggactgctatacttgacattatactgcaaacaaaacttaaagagataagcattaaacctattgtgctgttaacaacgttagtggacacttgtaagtcaatcagtgttaaagtatttgtaaatagaagcaagctattattaacaacttttgtgtacttataatgttcacctaaaaatgttgtagcataattctgtgttttatggttgcttctgtccttctttttatttacctctttgttgttatttttgttgtttctttcagtgaggtgtttctgtgttagtagtctgtcttgacacacattgttcaaacaatctcaagcacttgtgtttaaaaaaggttctgaaatcttgcttctcatatgatagcttatgatgccggaattctgtaaacaataaagatgaaagaaaaaatgaaaactttatacaaaaaaggacttctgcaaaagcttggaaattcagaacctattttttatcatcttattttcaaagtaggcaaaagcaaaatcacttaattagtaccattaagtgagagagtaatggaaaactgttatccatcaaaagtgatataatatcctgtacttgtcactcatgtaaaactaatgtatcaaaattagcatatatggaagaaaaatcactattcaaaaatagtttcaattgggcaaatgtgtgtctacaactttgttgaaatggcagagtctgtgttgatcctcatatacaataatgttgttgtaacacaagtgttattagaccatagccacaaaatatttaatgtgttgtgccttcatgatgtaacagaacattctccaggtagggtagttgggggaaataaagggataaatctctaattattgctgtttaactgtttgttatcatagttggtcaatgcctggcaggtaccagcatattgtcacttaggtcaaaccaataaagtgacaactaatgttaataagatctcagttgcacgtgcaaacaaatccaaattcgaacattcttaggaggtttttgttaaggcatgacagatgatttaaacaaataaatagcatgcaacaaaatgtctttattgaaagaagtggaagttatcttaatgccacggttcaccatcaatttaaaagtaaaaaaaacaaaaaaaaaacaaaaaatttaaaaaaaaggtttgctaatctgatagttaatttgttcttaccaaaaaataaaattactttgtaaatagcagttcacatttttccacagtataatggaaaataatgggtaggggtgcattgcttattgaagtacatttttgtcggtttgtgaggggtgtttgatgactttgacagaataaatatctaaacaattatccttgttactgctttgccagttctacgttatttacaattattcagctcttgcaataaatgttctgaattcctga

SEQ ID NO: 172095 - DNA, 461 bp, Homo sapiens
  Payload ID: 13810
  Gene Symbol: PCDH9
  Gene Name: protocadherin 9
  ENST ID: ENST00000614931
  CDS Start-End: 1-135
tgtaactcacacagcaaaagtgacaatattcctgtcactcctcagaaatgtcccagctccacgggtttccacattcaggagaatgaagaaagccattacgagggcacactcccttacttgagatattctctctgaataaactccagaccaatgctgtaaaatagaattgtaatatgagccacaaattcgcagcgccgtgttacgtttcatctccctgatggctcccaggaaagctgcagtgacagtggtctaggagaccatgagccggtgggtagtggaaccctgatctcacaccctcttcctctggttcagccacaggacgaattctatgaccaggcctctccggacaagaggactgaagcagatggcaactctgatcccaactctgatgggcctttgggtccccgaggattagctgaagctacagagatgtgcactcaagagtgcttggttttgggtca

SEQ ID NO: 172096 - DNA, 2726 bp, Homo sapiens
  Payload ID: 13811
  Gene Symbol: PCDHA1
  Gene Name: protocadherin alpha 1
  Uniprot ID: Q9Y5I3
  ENST ID: ENST00000378133
  CDS Start-End: 156-2579
agctactgatcactaaaagtgaaggaggaagctccattttgtcaccgcctgagagaagacagaaacggtaaagagataaatgattggaaatattagataaaatggcatgattttgaagtaagaggagagcataagaaaggtgtagtccttttgcaatggtgttttctaggagagggggcctgggagcccgggatctgcttctttggcttctgctcctcgcagcctgggaggtggggagcggccagctccactactcgatcccggaggaagccaaacacggcaccttcgttggccgcgttgctcaggacctgggactggagctggcggagctggtgcctcgcctgttccgggtggcgtccaaaacacacagggaccttctggaggtaaatctgcagaatggcattttgtttgtgaattctcggatcgatcgcgaggagctgtgccagtggagcgcggagtgcagcatccacctggagttgatcgccgacaggccgctgcaggttttccatgtggaggtgaaggtgaaagacattaacgataatccacccgtcttcaggggcagagaacaaataatatttattcctgaatctagactcctgaattcgcgttttccgatagaaggagctgctgatgcagacattggtgctaacgctcttctaacgtacacgctcagcccgagtgattatttctctttggatgtagaggcaagtgatgaactgagtaaatctctttggcttgaattgagaaaatatttggatagagaagaaacaccagaacttcacttattactgactgccactgatgggggcaaaccggagctgcaaggtacagttgagctgctgatcaccgtcctcgacgttaatgataacgccccactgtttgaccaggccgtatacagagtccacttgttagagactacagcaaatggaacattagtgaccacattaaatgcctctgatgctgacgaaggtgtaaatggtgaagtcgtcttttcctttgacagtggtatttctcgtgacattcaagaaaaattcaaagttgattccagctcaggagaaattaggttaattgataaactggattatgaagaaacaaaatcctacgaaattcaagtaaaggcagttgataaaggaagtcctccgatgtcaaatcactgtaaggttttggtgaaagtgctggatgtaaatgataatgctccagaactggcggtcacttcattgtatttgcctatcagagaggacgctccactcagcaccgtcatcgccctcatcaccgtgtctgaccgtgactcaggtgccaacgggcaggtgacttgctccttaatgccccacgtccccttcaagctggtgtccaccttcaagaattactactcgttggtgttggacagcgccctggatcgcgagagcctgtcggtctatgagctggtggtgaccgcgcgggacgggggctcgccttcgctgtgggccacggccagggtgtccgtggaggtggccgacgtgaatgacaacgcgcctgcgttcgcgcagcccgagtacacagtattcgtgaaggagaacaacccgccgggctgccacatcttcacggtgtctgcgcgggacgcggacgcgcaggagaacgcgctggtgtcctattcgctggtggaacggcgggtgggcgagcgcgcgctgtcgaactacgtgtcagtgcacgcggagagcggcaaggtgtacgcactgcagcccctggaccacgaggagctggagctgctgcagttccaggtgagcgcgcgggatgcgggcgtgccgcctctgggcagcaacgtgacgctgcaggtgttcgtgctggacgagaacgacaacgcgccggcgctgctggcgcctcgagtgggtggcactattggtgcagtcagtgagctggtgccgcgattggtgggtgcgggtcatgtggtggcgaaggtgcgcgcagtggacgccgactcgggctacaacgcgtggctgtcctatgaactgcagccggcagcaggcggcgcgcgcatcccgttccgcgtggggctgtacacgggcgagatcagcacgactcgtgtcctggacgaggctgacttgtcgcgctaccgccttctggtgctagtgaaggatcacggtgagccggcgctgacagccacggccactgtgcttgtatctctggtggagagcggccaggcgccaaaggcgtcttcgcgggcgtcggtgggtgtcgcgggcccagaggcggcgctggtggatgtcaacgtgtacctgatcatcgccatctgcgcggtgtccagcctgctggtgctcacactgctgctgtacacggcgctgcggtgctcagtgccgcccactgagggtgcgtatgtgccgggcaagcccactctggtgtgctccagcgcgttggggagctggtcgaactcacagcagaggcggcagagggtgtgctctagcgagggcccacccaagaccgacctcatggccttcagcccaggcctatctccaagtcttaacacgtcagaaagaaatgaacaaccagaagcaaatttggatctttctggtaatgtaagtccaactttcgagttttggctttaaatatttttcatatttaacttgtctaatcatcttttcaaatatcactttaaaaaatgtcttcaaggtgttcactaacgttgaaataaatcataccattgaatgtagatatcctattaatggcagttttgtcttgaatggaactagaaa

SEQ ID NO: 172097 - DNA, 2204 bp, Homo sapiens
  Payload ID: 13811
  Gene Symbol: PCDHA1
  Gene Name: protocadherin alpha 1
  Uniprot ID: Q9Y5I3
  ENST ID: ENST00000394633
  CDS Start-End: 1-2061
atggtgttttctaggagagggggcctgggagcccgggatctgcttctttggcttctgctcctcgcagcctgggaggtggggagcggccagctccactactcgatcccggaggaagccaaacacggcaccttcgttggccgcgttgctcaggacctgggactggagctggcggagctggtgcctcgcctgttccgggtggcgtccaaaacacacagggaccttctggaggtaaatctgcagaatggcattttgtttgtgaattctcggatcgatcgcgaggagctgtgccagtggagcgcggagtgcagcatccacctggagttgatcgccgacaggccgctgcaggttttccatgtggaggtgaaggtgaaagacattaacgataatccacccgtcttcaggggcagagaacaaataatatttattcctgaatctagactcctgaattcgcgttttccgatagaaggagctgctgatgcagacattggtgctaacgctcttctaacgtacacgctcagcccgagtgattatttctctttggatgtagaggcaagtgatgaactgagtaaatctctttggcttgaattgagaaaatatttggatagagaagaaacaccagaacttcacttattactgactgccactgatgggggcaaaccggagctgcaaggtacagttgagctgctgatcaccgtcctcgacgttaatgataacgccccactgtttgaccaggccgtatacagagtccacttgttagagactacagcaaatggaacattagtgaccacattaaatgcctctgatgctgacgaaggtgtaaatggtgaagtcgtcttttcctttgacagtggtatttctcgtgacattcaagaaaaattcaaagttgattccagctcaggagaaattaggttaattgataaactggattatgaagaaacaaaatcctacgaaattcaagtaaaggcagttgataaaggaagtcctccgatgtcaaatcactgtaaggttttggtgaaagtgctggatgtaaatgataatgctccagaactggcggtcacttcattgtatttgcctatcagagaggacgctccactcagcaccgtcatcgccctcatcaccgtgtctgaccgtgactcaggtgccaacgggcaggtgacttgctccttaatgccccacgtccccttcaagctggtgtccaccttcaagaattactactcgttggtgttggacagcgccctggatcgcgagagcctgtcggtctatgagctggtggtgaccgcgcgggacgggggctcgccttcgctgtgggccacggccagggtgtccgtggaggtggccgacgtgaatgacaacgcgcctgcgttcgcgcagcccgagtacacagtattcgtgaaggagaacaacccgccgggctgccacatcttcacggtgtctgcgcgggacgcggacgcgcaggagaacgcgctggtgtcctattcgctggtggaacggcgggtgggcgagcgcgcgctgtcgaactacgtgtcagtgcacgcggagagcggcaaggtgtacgcactgcagcccctggaccacgaggagctggagctgctgcagttccagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctg

SEQ ID NO: 172098 - DNA, 5263 bp, Homo sapiens
  Payload ID: 13811
  Gene Symbol: PCDHA1
  Gene Name: protocadherin alpha 1
  Uniprot ID: Q9Y5I3
  ENST ID: ENST00000504120
  CDS Start-End: 1-2853
atggtgttttctaggagagggggcctgggagcccgggatctgcttctttggcttctgctcctcgcagcctgggaggtggggagcggccagctccactactcgatcccggaggaagccaaacacggcaccttcgttggccgcgttgctcaggacctgggactggagctggcggagctggtgcctcgcctgttccgggtggcgtccaaaacacacagggaccttctggaggtaaatctgcagaatggcattttgtttgtgaattctcggatcgatcgcgaggagctgtgccagtggagcgcggagtgcagcatccacctggagttgatcgccgacaggccgctgcaggttttccatgtggaggtgaaggtgaaagacattaacgataatccacccgtcttcaggggcagagaacaaataatatttattcctgaatctagactcctgaattcgcgttttccgatagaaggagctgctgatgcagacattggtgctaacgctcttctaacgtacacgctcagcccgagtgattatttctctttggatgtagaggcaagtgatgaactgagtaaatctctttggcttgaattgagaaaatatttggatagagaagaaacaccagaacttcacttattactgactgccactgatgggggcaaaccggagctgcaaggtacagttgagctgctgatcaccgtcctcgacgttaatgataacgccccactgtttgaccaggccgtatacagagtccacttgttagagactacagcaaatggaacattagtgaccacattaaatgcctctgatgctgacgaaggtgtaaatggtgaagtcgtcttttcctttgacagtggtatttctcgtgacattcaagaaaaattcaaagttgattccagctcaggagaaattaggttaattgataaactggattatgaagaaacaaaatcctacgaaattcaagtaaaggcagttgataaaggaagtcctccgatgtcaaatcactgtaaggttttggtgaaagtgctggatgtaaatgataatgctccagaactggcggtcacttcattgtatttgcctatcagagaggacgctccactcagcaccgtcatcgccctcatcaccgtgtctgaccgtgactcaggtgccaacgggcaggtgacttgctccttaatgccccacgtccccttcaagctggtgtccaccttcaagaattactactcgttggtgttggacagcgccctggatcgcgagagcctgtcggtctatgagctggtggtgaccgcgcgggacgggggctcgccttcgctgtgggccacggccagggtgtccgtggaggtggccgacgtgaatgacaacgcgcctgcgttcgcgcagcccgagtacacagtattcgtgaaggagaacaacccgccgggctgccacatcttcacggtgtctgcgcgggacgcggacgcgcaggagaacgcgctggtgtcctattcgctggtggaacggcgggtgggcgagcgcgcgctgtcgaactacgtgtcagtgcacgcggagagcggcaaggtgtacgcactgcagcccctggaccacgaggagctggagctgctgcagttccaggtgagcgcgcgggatgcgggcgtgccgcctctgggcagcaacgtgacgctgcaggtgttcgtgctggacgagaacgacaacgcgccggcgctgctggcgcctcgagtgggtggcactattggtgcagtcagtgagctggtgccgcgattggtgggtgcgggtcatgtggtggcgaaggtgcgcgcagtggacgccgactcgggctacaacgcgtggctgtcctatgaactgcagccggcagcaggcggcgcgcgcatcccgttccgcgtggggctgtacacgggcgagatcagcacgactcgtgtcctggacgaggctgacttgtcgcgctaccgccttctggtgctagtgaaggatcacggtgagccggcgctgacagccacggccactgtgcttgtatctctggtggagagcggccaggcgccaaaggcgtcttcgcgggcgtcggtgggtgtcgcgggcccagaggcggcgctggtggatgtcaacgtgtacctgatcatcgccatctgcgcggtgtccagcctgctggtgctcacactgctgctgtacacggcgctgcggtgctcagtgccgcccactgagggtgcgtatgtgccgggcaagcccactctggtgtgctccagcgcgttggggagctggtcgaactcacagcagaggcggcagagggtgtgctctagcgagggcccacccaagaccgacctcatggccttcagcccaggcctatctccaagtcttaacacgtcagaaagaaatgaacaaccagaagcaaatttggatctttctggtaatccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatgaaa

SEQ ID NO: 172099 - DNA, 5254 bp, Homo sapiens
  Payload ID: 13812
  Gene Symbol: PCDHA10
  Gene Name: protocadherin alpha 10
  Uniprot ID: Q9Y5I2
  ENST ID: ENST00000307360
  CDS Start-End: 1-2847
atggtttccagatgtagctgcctgggggtccagtgtctgctgctctcgcttcttctcctcgcagcctgggaggtggggagcggccagctccactactcagtctacgaggaggccagacacggcaccttcgtgggccgcatcgcgcaggacctggggctggagctggcggagctggtgcagcgcctgttccgggtggcgtccaaaagacacggggaccttctggaggtaaatctgcagaatggcattttgtttgtgaattctcggattgaccgcgaggagctgtgcgggcggagcgtggagtgcagcatccacctggaggtgatcgtggacaggccgctgcaggttttccatgtggacgtggaagtgaaggacattaacgacaacccgcccaggttctccgtaacagaacaaaagctctcaatacctgaatccagactgcttgactctcgatttccactagaaggcgcatctgatgcggatgttggagagaacgcattgcttacttacaaactcagtccaaatgagtattttgttcttgatattataaacaaaaaagacaaagacaaattcccagtgcttgttctgcggaagctgctggatcgtgaagaaaatcctcagctaaagttgttgttgacagcaactgatggaggcaaacctgaatttaccggatctgtttctctgctgatcctggtgttagatgccaatgataacgcccctatctttgacagaccggtttatgaagttaagatgtatgaaaatcaagtgaaccaaacattagtaatacggctcaacgcttctgattcggatgaaggaataaacaaggaaatgatgtattcatttagctctttggtcccacccacgataagaaggaaattttggataaacgaaaggacgggagaaataaaagtaaatgatgctattgactttgaggacagtaacacttatgaaattcatgtagatgttacagataagggaaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagcgtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactctctggtggagcggcggttgggcgagcgctcgctgtcgagctacgtgtcggtgcacgcggagagcggcaaggtgtacgcgctgcagccgctggaccacgaggagctggagctgctacagttccaggtgagcgcgcgcgatgggggcgtgccgcctctgggcagcaacttgacgctgcaggtgttcgtgctggacgagaacgacaacgctcccgcgctgctggcgtctcccgctggcagcgcgggcggtgcagtcagtgagctggtgctgcggtcggtggttgcgggtcacgtggtggctaaggtgcgcgcagtggacgctgactctggatacaacgcgtggctgtcgtatgaattgcagtcggcggcggttggtgcacgcatcccgtttcgcgtggggctgtacacgggcgagatcagtacgacgcgcgctctggatgagactgactcgccacgccagcgcctactggtgctggtgaaggaccatggcgagccgtcgctgacggccacggccactgtgcttgtgtcgcttgtggagggcagccaggcacccaaggcctcgtcgcgggcttcagtgggcgtggcgcccgaggtggccctggtggatgtcaacgtgtacctgatcatcgccatctgcgcggtgtccagcttgctggtgctcacgctgctgctgtacactgcactgaggtgctcggcggcgcccaccgagggcgcatgtgggccggtgaagcccacgctggtgtgctctagcgcggtggggagctggtcttactcgcagcagaggcggcagagggtgtgttctggggagggcctgcccaaggcggacctcatggccttcagccccagccttccaccatgcccaatggtagatgtggacggggaagatcagtctattggaggggaccactctaggaagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 172100 - DNA, 3788 bp, Homo sapiens
  Payload ID: 13812
  Gene Symbol: PCDHA10
  Gene Name: protocadherin alpha 10
  Uniprot ID: Q9Y5I2
  ENST ID: ENST00000506939
  CDS Start-End: 40-2097
ccgctgattcgtcgatttgtaaaacaagagaaggataagatggtttccagatgtagctgcctgggggtccagtgtctgctgctctcgcttcttctcctcgcagcctgggaggtggggagcggccagctccactactcagtctacgaggaggccagacacggcaccttcgtgggccgcatcgcgcaggacctggggctggagctggcggagctggtgcagcgcctgttccgggtggcgtccaaaagacacggggaccttctggaggtaaatctgcagaatggcattttgtttgtgaattctcggattgaccgcgaggagctgtgcgggcggagcgtggagtgcagcatccacctggaggtgatcgtggacaggccgctgcaggttttccatgtggacgtggaagtgaaggacattaacgacaacccgcccaggttctccgtaacagaacaaaagctctcaatacctgaatccagactgcttgactctcgatttccactagaaggcgcatctgatgcggatgttggagagaacgcattgcttacttacaaactcagtccaaatgagtattttgttcttgatattataaacaaaaaagacaaagacaaattcccagtgcttgttctgcggaagctgctggatcgtgaagaaaatcctcagctaaagttgttgttgacagcaactgatggaggcaaacctgaatttaccggatctgtttctctgctgatcctggtgttagatgccaatgataacgcccctatctttgacagaccggtttatgaagttaagatgtatgaaaatcaagtgaaccaaacattagtaatacggctcaacgcttctgattcggatgaaggaataaacaaggaaatgatgtattcatttagctctttggtcccacccacgataagaaggaaattttggataaacgaaaggacgggagaaataaaagtaaatgatgctattgactttgaggacagtaacacttatgaaattcatgtagatgttacagataagggaaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagcgtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactctctggtggagcggcggttgggcgagcgctcgctgtcgagctacgtgtcggtgcacgcggagagcggcaaggtgtacgcgctgcagccgctggaccacgaggagctggagctgctacagttccagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagcca

SEQ ID NO: 172101 - DNA, 12358 bp, Homo sapiens
  Payload ID: 13812
  Gene Symbol: PCDHA10
  Gene Name: protocadherin alpha 10
  Uniprot ID: Q9Y5I2
  ENST ID: ENST00000562220
  CDS Start-End: 167-2701
agaacaaaggcatcagccagtttctcaaggactaggaagtagcgtcattctgagatctcagccatttcgataaaaaatagatataagaaataggacagaaaatgtcagatcgtatgtgcgttctagaccgctgattcgtcgatttgtaaaacaagagaaggataagatggtttccagatgtagctgcctgggggtccagtgtctgctgctctcgcttcttctcctcgcagcctgggaggtggggagcggccagctccactactcagtctacgaggaggccagacacggcaccttcgtgggccgcatcgcgcaggacctggggctggagctggcggagctggtgcagcgcctgttccgggtggcgtccaaaagacacggggaccttctggaggtaaatctgcagaatggcattttgtttgtgaattctcggattgaccgcgaggagctgtgcgggcggagcgtggagtgcagcatccacctggaggtgatcgtggacaggccgctgcaggttttccatgtggacgtggaagtgaaggacattaacgacaacccgcccaggttctccgtaacagaacaaaagctctcaatacctgaatccagactgcttgactctcgatttccactagaaggcgcatctgatgcggatgttggagagaacgcattgcttacttacaaactcagtccaaatgagtattttgttcttgatattataaacaaaaaagacaaagacaaattcccagtgcttgttctgcggaagctgctggatcgtgaagaaaatcctcagctaaagttgttgttgacagcaactgatggaggcaaacctgaatttaccggatctgtttctctgctgatcctggtgttagatgccaatgataacgcccctatctttgacagaccggtttatgaagttaagatgtatgaaaatcaagtgaaccaaacattagtaatacggctcaacgcttctgattcggatgaaggaataaacaaggaaatgatgtattcatttagctctttggtcccacccacgataagaaggaaattttggataaacgaaaggacgggagaaataaaagtaaatgatgctattgactttgaggacagtaacacttatgaaattcatgtagatgttacagataagggaaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagcgtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactctctggtggagcggcggttgggcgagcgctcgctgtcgagctacgtgtcggtgcacgcggagagcggcaaggtgtacgcgctgcagccgctggaccacgaggagctggagctgctacagttccaggtgagcgcgcgcgatgggggcgtgccgcctctgggcagcaacttgacgctgcaggtgttcgtgctggacgagaacgacaacgctcccgcgctgctggcgtctcccgctggcagcgcgggcggtgcagtcagtgagctggtgctgcggtcggtggttgcgggtcacgtggtggctaaggtgcgcgcagtggacgctgactctggatacaacgcgtggctgtcgtatgaattgcagtcggcggcggttggtgcacgcatcccgtttcgcgtggggctgtacacgggcgagatcagtacgacgcgcgctctggatgagactgactcgccacgccagcgcctactggtgctggtgaaggaccatggcgagccgtcgctgacggccacggccactgtgcttgtgtcgcttgtggagggcagccaggcacccaaggcctcgtcgcgggcttcagtgggcgtggcgcccgaggtggccctggtggatgtcaacgtgtacctgatcatcgccatctgcgcggtgtccagcttgctggtgctcacgctgctgctgtacactgcactgaggtgctcggcggcgcccaccgagggcgcatgtgggccggtgaagcccacgctggtgtgctctagcgcggtggggagctggtcttactcgcagcagaggcggcagagggtgtgttctggggagggcctgcccaaggcggacctcatggccttcagccccagccttccaccatgcccaatggtagatgtggacggggaagatcagtctattggaggggaccactctaggaaggtgggttattacgttttcattttccttttgtgctttatgaataatattttctcttaccgcattttctcaaatatgtatcagaatatttcatttttgtctacattccatttatgcttgaatatttctagtgatacctttgtaatataatttattccaggagttttaaaatttttttatcctacccagtgtgtcagcctttgattggtacttaaatttttttaaataacaatttattctgaatacactaatattttccaatacaaatatgtgatataggttgcagttctgacgatttactttcataatcacttttcgttacaaatatttgtgagattagtacttcatgttatttcatttccaatctaaattttgatttgattgtatttgcattaccaaaaaattccactgatctatatctcttcagtgaaaatgtgttttcctccatgtgtagaatatgtgtagcgtaccacagcttatactgccatagtagatttcaatgttcagtgattacagctttttctcaatagtgcagtaagtaggtgggcagttcattggtaaaaatttcttaatcttagcaattaagttaaatgctttgaactttaaaaacgttttccatttttattttagttgtagtggtacctgtgtcagtgtgtattattcacttagcagaagaaaatgtatgtttcttttatttacataattttatccagtagctcttcattatctgctcctttatcagcattaggcattgcttatgatattcaggtattagctctttcactttaaggaaggagtcatgcttatgtttaataatgaagagaatttgaacactttttacttttgagactgaaaatactttagtatgaattaatattaaaagtttgaggagaaaataaaattaatgttttctactgatctgatatattgtatagtttaatagcttctctagtcatcttaaacagggttgggttagatgatatagactcagaaatgaaagctaacttagttgcagagtgacaaaactacactatcaattgtgttttcctgaaattggttgttacctgatacccatgatttcatttttaaaaaaaatttattaattctagtgttaccaaacaccaatgccatgaatttgtcatcttgcctatggctcttagcaattacttttttctttcctttctctttgagtatggagattgaatttgttactcagtacgtgcttcacaaatagcttcaaataaaattaaaattattgttcaagtttaggaacaccaaaaaaaaattgtggcaagaatttaagcatggcattctttcagtgttaatactctccatgccctgtctccagctcttagaaattatagatgctaagttaatgcagagtttagaagtgtatttgttattttatcaaataggtttatgaaatatatacttccccctctgatattttgaaaaaaaatcttccttaatgtcttatattataagtaatataaaaaacttagtaaaaactcatatcaattgtaaaagtctcaggtatacaagtgcattaatctctccatcaatactaacttaaggccaggcatggtggctcacacctgtaatcccagcattttgagaggccaaggtgggaggatggtttgaggccaggagttcaagaccaacctgggcgacatagggatatcttgtactgtgtgtgtgtgtatatatatgtatatatgtgtatatatatatgtatatatatatgatgggctctccttacatatatatctatatatgtacttatgtatatataagccaggcatggtggtacatgcctttagtccctactgtagtgctacttgggagggtgaggtgggaggacggcttgagcctgggaagttgaggctgcagtgacccatgattgtgccactgcactccagcctggatgacaaagtgagaccctatttcaaaaattgaaaaaagcaaaagcaatagtaacaccattatcctgcaaatatgatctttttcatattaattcacgtgataatacagttggtgcagtagtactttatttaggatgtctacatacaagataaaactcttcatggaattctgatttgtaagacaaacccacctttgaagaggtactgatcatacacaagaaggtataggaaaggagttggaagctcacaaagagaaacataaacatatgcaggaatcaggaacgaagaagataagtgaaataatatgaaatcaaatgcacttatgttttgagcgacaggatattgttgttctccatgaaaagtttttttggtttttttgttttttattttttatttttttgagacggagtctcgctctgttgcccaggctggagtgcagtggcacgatctcggctcactgcaagctccgcctcccaggttcacgctattctcctgcctcagcctccggagtagctgggactacaggtgcccgccaacacgccaggctaattttttgtatttttagtagagacgaggtttcaccgtgttagccaggatggtctagatctcctgacctcgtgatccaccggcctcggcttcccaaagtgctggccgagtgccaccgcacccggccgaaaggtattttttttaacagaagaaaatcagattattcctagatcagaaagaagctccattgttcctgtactttaaaaactacaaacacccattaagaccacttggaacctcaggaacaaggaccaaaaggtctcagaggaactaagtctttctagtcatgaaatattgttttactaaccaaaagagaggcataattttagctgctagacaaagtggccaggaatcccggagcctacagcactggcttctgctccttgaattttgtgaagcgggaaaggaccagttccactacaccatcctggaagaggccaaggacggcacatagcgtcttcgcggtccctattgcgcaggacctgggtctggagcttgtggagctgataccgcgcctgtttcagttggattccaaaagccgcagaaaccttctggaggtaaatctgcagaatggcatttttgtgagttctctgatagacctcgaggagctgtgtgggaggatctcggagtgcagcatccacctggaagtgatcgtggacaagctgctacaggttttccatgtggaggtgaaagtgaagaacaataaagacaacctgccagtgttctcagcaacacaaaagaatctgtttctgaaacgagagctcttgattatcgtgtttcactagagggtgtctgtgatgccgacgtcggggccaatgctctgatgacttacatactgtgccgcaatgattatttttccctggaaataccaagagcaggtaaaaccacttgaaggtgtattttaaaaattctttcagataggtaagtcacttcagagctactcttggtgctcaaagcaactgatgggggcgaagctgagctgacaggcaccaaagcattatatatcacagcgctggatgtaaatgatgatgcccagtgtttgacaaaggagtctatcatgtgaaattactggaaaatgcaagagaaggtacactggttattagacttaaccccttggattttgacgagggttcaaaccgtcacattgtttctttgcaactgatgtctcccctaacatagaagccctttttcgcatagattcagacagtggataaataaatgtaaagataggttttgaggaaactaaataatgaaagattcaaatacaggcagttgacacaggcaattccccaatgtttgatcactgcacagacttgatagaagtcttggacatcaatgatagtgttccagagttagcagtaagtcactatcattccctgtacaggaggacgctccactgggtaccgtcatagccctaatcagtgtaattgaccctaacttcagtgccaagggacagacgacccgcaccctgactcctcacgtctcttcaagctggtgtctaccttcaaaaggcgctgcccagaaactattcgttggtactccacagcgccctggaccaagagagcaaatctatccattgttggtaatcgctcggaatggggactcgctttcattgttggccacagccatcgggtccgtggaagtggccgaacagtgaaccacaatgccctggcgttccagcagcccgagtacatggtgttcgtgaaaggtaacaacccgcggggctgccacgacttcacagtgtccgcgcgggaccgggacgcgcaggagaacgtgctggtgtcctactcgttgatggaacagcgggtgggcgagtgcgcgctgtctagctatgtgtgggtgcacgcggagagcggcaagaggtacgcgttgcagccactggactacgaggagctggagctgctgcagttctaggtgagagcgcgcgacgcgggcatgccgcctctgagcagcaatgtgacgctgccaggtattagtgctggaacgacaactttgtctgcgctgctggcgccttgggtgggctggcggcgctgtgagtgagctggtgcggtattcagtggatgcaggccacttggtggcgaaggtgcgcacggtggactccagctatgacgcctggttgtcgcaacagctgcatctgtcagctggcagcacccgttccacgtggggctctgcacgggcgagatcagcacgacgagtaccctggacgaggcgaaagctacgcgccaccgcctgctggtgctggtgaaggaccactgcgagctggcgctgactgccaccgtcaccgtggtggcgtcgctggcggagagcagccaagcgaggaaggtcccatcgcgggctttggcgggcgtcgaggtccgggaggcagcgctggtggatgtcaacgtgtacctgatcatcgccatctgcgtggtgtccagcctgttagtgctcacgttgctgctgtacacgacgctgcggtgcttggcgcagctcaccgagagctcgtgcatgccgggcaagcccacgctggtgtaccgcagcgtagtgggatctggtcttactcgcagcaaaggagattttactctggagagtcgcctcccaaggtcaacattacggcttttagtcctagtgttctcccatggttcagattttggagatggacttcaataggaaatttttgagaatataagtactgtaatcctggaaagtatttcattcctattaatgtccctcatagtgacattgataatgttcaccaagttattaatttgattgctttatttattttgcttttgctttttcttttgagatgctttatttaaagtacactggggccgggtgcggtagctcatgcctatttgtaatcccggcactttgggaagccgaggcgggcggatcactcgaggccaggagtttgagaccagcctggccaacatggtgaaactccatctctactaaagatataaaaaaattagctgggtgtggtggtgcgcacctgtaatcccagctactcaggaggctgaggcacaagaattgcttgaacctaggaggcagaggttgcggtgagcctagattaggccactgcactacagcctgggagacagggtgaaactctgtcttaaaaaaaaaagtacattggaagtctagccatcttaatcactttttactacagtcaccatgaacattctttaggaatattcttcagttgataagtataatgataatagtaataatgaattagactgagtggctgtttcctgtaaatgagaaagttaaatcttaccggaaggatcatgatgaataatgatccttatgagaaggtcaaatcttctcaattttgaagcaagttctttattcctattcattttcttattctgatttgtgtcctccattccttattgtttttatgtattcaaaaataccatgacaatatttaatatcataattatttgagtttaaaacatgtttaaatgtttatctttctataatcgataagtttatctctcacaaatggtgatgagcagggttgaggcagcttcgtccacaaacaattttgtttcttcatgatcaatatccatcttttttgagatgttgattgcagtgggtggaattttagccttgcctttaaaggtgattttacttcttaatttttgtcttcaatcttcttataatttcattttaggtcattgtcttcacaatcttcaactacttcagatagccaacaactttgttcttttttaaaaagaaaacaaaacaaaacaatgtcagctctacttaattacctgttgacttaattgctgctgtcctccagtttaagttgttgagctcttctactattttgggaagatttctttgagcaccgattatactcatttttctttcatttttggtacctggctgtatgaaaatattttagggtaggaaaattcacacttatttgggctttaagtataagagagtcttcccatacatgatgaagggtgataccattgtctgtgttcattaagctgcatggtcttcagaatggcattgctgagcttggcagggtgtctcaggcctgtaatcccagcattttgggaagccgagggaggaggatcgcttgagaccaggagtttgagaccagcctcggcaacatagtgagacccccatctctaccaaaaaatgtcattgtttttaataacttaagtataagaaccatgggatattaataaaggcacttccacttgacaattgtggtgttaattataccttagaatttaacattgtatacttttgatatatttgatgcaaaatattttttgccttcacaccatattaatgtgaattgctttctttaaagggatcccagagaacacgtatttatagctgtaaggatgtgtatcaaattatatgtaaaattactttgctctttttggctctaattacaaatgagatggcctttaattctgtgtaaagaaatagtatatttacatattgcaggataaccatgttataggtagggtaaagttaatataaatgctgaaaaggaattagtagtgtctacctagaaaaataacttctgagaagatgatttctatgaagataaacattaaggaaatcttcagaaaagggaaaaccctgtcctactttatggtgctggaattctcttcatccatagctataggacaagagccaatattgatcagtaactcatgataataaatcaccattgtttgagcagtttattaatatatttgttagacatcatgaagggacttaaatacattatttcatttaatacttataacaatttctaaagtacatatgactgttccaatttgaaagataaaataagagaagctgagatgtgtatctattttatccagtgccagtacatggtggagatattattcaaatgtgtatctttcaggcttcagactcattcttttatccactataatgtagagctttctttagtaagtcatttctctgctcaaacatggtctcggctaggaaaatcaagcacaaattgtgtacaggcaaatctttctttctgttgtgcttagaagaaacttcatgattgtcttcatcattaattttgtacaatgtgtgattgagatggcactaagtttttttatgttaagtgatttttttcttgtaagagttcgtgatcatcattatcatttgttttaatcaatgccacactgagataggtattttggttatgtaattgttaagtaattaagagttgccttataagaactacgtatctgttgtttggaagtgatataagtaagaatcgtttaacatgtaagaaaagtcagaaaactgtggtttccaatatccttgtggaacacctaaactaaatactatataccaaaaatgacacccttctttctttactgtgaataaagacagtgtttgggacaagtatagatgttgatattattatttcagggaccctgaacttggccaaaggattcaagaaatgtttacaatattgcatacttcaataacaattttaaagacatagattcccatgaaaatcttcaaatgtgtgtaggtctttcagtcttcttcagtcttattgttggctgggaagctcataacaactgacaaatgatttgtgaccaaataactgtttttacttgactaagccatgatagagcagaattagcatcacggaataaatcctataattttgttaatacagtggttggataatgtaattctaatctgttggttttggagaacctcctggggttctgacaacggtgtcaaaatttatttatgtgttttcaagaaataatagcactaggtctgttagaatatcagtggatgacgtgcactagtaagacattaaactatgcactctaatacttatatgactaacaggacatacaggcagattgtatgtcctgactgatatagtaaaagtcaggcacaaagttccttaatcttcaattgattttacaaaatcagttaacaataactgtattgaaatgacttcttggtattagcctatacccagatattaggctgatcctcaaagatgagttcaaagggcgcataatctcttcactaggggctggttgagatggtgacatctgaaatatcacagccaaaatgcaaaagatgggtcattgattcatacactatatcaaactcttttatgacttggcgtttgttcagtactactttatatattcacaaaatactgtattgttggaaattaacacctaaattaacatattgttttaattcaaatatgtgatattatcatttttccagagtaaaccttctaaggttcatttccctacctcgcaagactccacattccatgtaacatcttcatccccaattcccataataaggtgattgaggatctgttgtttccttttgttcaaaataaacctgatgtgcttcaaatatcatgttgaatatactgtcatctggtctaatgttatgttttgattagaggctactatgattgattattttacagatgcgtaatggaattaacggttataaaagttgatatgtctcctttaattttttaatacagaattttgcatttacctgaattagagttctagtgttatgacaacattgggaaaagagtaaatatgaaaaaagtagaacaaaatctcaaattaatagttgaatatatatataaaatattagcatacacatatgataactttttcatatgcccttgcagtatttttagattggagataaaccatcaaaactatagaacaaaatatttaagctagagtgatatttattctaaatcactttctactctaaaattttgttgcatcttctttttttcctcctaaatcctaagggtatatgaaaagacaaagaaaattcaagcaagttacaacttcaggcaaagaaaactctcataagcaattcctgtattttacttagcattttctatgaaattccatttccacaagcactaaggtaatttaccatttagttgaattgtttgattaattttctatgttttaagcacaatatcaggtacttacagaaggtataattaaaaatcacttcccttgttttccatgaacttctgctcccaaacccaaaattctttcaacaagaaacaaactattttcatgaatataactgaattagattaaggaaaccaatgttggtgacttggaaataccaatatggcacaaagatgttcagggtgattttatttattttataaaatgataataaaatttattttatagttgaaaagcctatttctgtcatatcattgattctgttacataaagtgctaaattttgatatctcatattatgctactatggcttacattagaaataatatatgtcaaataaaaactcatctagatcaa

SEQ ID NO: 172102 - DNA, 6115 bp, Homo sapiens
  Payload ID: 13813
  Gene Symbol: PCDHA11
  Gene Name: protocadherin alpha 11
  Uniprot ID: Q9Y5I1
  ENST ID: ENST00000398640
  CDS Start-End: 859-3708
ttttcctttgtggattcttttttaaaactaccaagtttgagaatatgaatatatttgtttttcatattgttctgcaatgaatataaagtcacttataatcagaaagcaattaaatgtaaataacagtaaagaatgagaactatagaaaatagatatgaaaatgcaagcccacagagatgagaatagatcatgtggaacataaacactaaagagctgcttttataaaacttcaattttttctttgagttccctagcagccaaagtaacaagggagactgaaagtaaaacaattcaaatttgatagtatttttatatgaggaacaacactttcaggaaatgtttaaccctagtttttcatgaggccaccttaacaactgaattctctttctctctcactctgtgtataagtattttagataagtaaaagaacaatgttataatgttaagtcaaacatagacacaataatttaaatttgatgttaatcgagaaatacaatgccatttccatatatatttagtttcaatatgacttataatctgaatattccataaataagcacgttggaaatatttgggggaagaaacccaaaacacgtgaaattctgtggtggtaaatgcagtgcacagtactcacagttttaggcgcaaggtgtcgctctttacttggtggaaagttcatttaaaggttggtctgaacagtgaggcactcccatacaaaggaactccatcataccggatgccaccgtttaaggatcctttgaaacttcttaagaattcaacgagatttttaacctgaaactgaagaatctggtactgtaagtgtaaagaagcttattttggaagccaatttcgtatgcgatgtttggttttcagagaaggggattgggcaccccacgactacagctctggcttctcctcctcgaattctgggaggtggggagcggccagctccactactccgtctcggaggaggccaaacacggcaccttcgtgggccgcatcgcgcaggacctggggctggagctggcggagctggtgcagcgcctgttccgggtggcgtccaaaacacatggggaccttctggaggtaaatctgcagaatggcattttgtttgtgaattctcggatcgaccgcgaggagctgtgcgggcagagcgcggagtgcagcatccacctggaggtgatcgtggacaggccgctgcaggttttccatgtgaacgtggaggtgaaggacattaacgacaacccgccggtgttctcgctcagagaacaaaagctgctgattgcggaatctaagcaatcggactcgcgttttccactagagggagcttctgatgctgacattgaagagaatgctctattgacctacaggctaagtaaaaatgagtatttttctttagattcaccaacaaatggtaagcagattaaaagactgtcacttattttaaagaagtctctggatagagagaaaactccggaacttaatttgctgctaacagctacagacgggggaaaaccagagcttactggcaccgttcggctgttagtccaagtcttggatgtcaacgacaatgatccagagtttgataaatcagaatataaggtgagccttatggaaaatgctgctaaagaaactcttgtgctcaaactaaacgccacagaccgagacgaaggagtcaatggagaggtaacatactccttaatgtcaattaagcccaatggaagacacttatttacactagatcaaaataatggagaagtgagggtcaatggaactttagattatgaagaaaacaagttttataaaattgaagtacaggctacagataaggggactcccccaatggcaggtcactgtacagtctgggtggaaatcttggacaccaacgataactctcctgaagtcgccgtgacttccttgtccctcccagtacgagaggacgctcagcccagcacggtcattgccctgatcagcgtgtctgaccgtgactcaggtgtcaacggacaggtgacctgctcgctgacgccccacgttcccttcaagctggtgtccaccttcaagaattactactcgttggtgctggacagcgccctggaccgcgagaacgtgtgggcctatgaactggtggtgactgcgcgggatgggggttcgccttctctgtgggccacggccagggtatccgtggaggtggccgacgtgaacgacaatgcgcctgcgttcgcacagcccgagtacaccgtgttcgtgaaggagaacaacccaccaggctgccacatcttcacagtgtcggcgcgggacgcggacgcgcaggagaacgcgctggtgtcctactcgctggtggagcggcggttgggcgaccgcgcgctgtcgagctacgtgtcggtgcacgcggagagcggcaaggtgtacgcgctgcagccgttggaccacgaggagctggagctgctacagttccaggtgagcgcgcgcgatgcgggcgtgccgcctctgagcagcaacgtgacgctgcaggtgttcgtgctggacgagaacgacaacgcgccggcactgctggcgactcaggctggcagcgcgggaggcgcagttaacaagctagtaccgcggtcggtgggtgcgggccacgtggtggcgaaggtgcgcgcagtggatgcggactcaggctacaacgcgtggctttcatatgaattgcagccggcggcgggcggctcgcgcatcccgttccgcgtggggctgtacacgggcgagataagcacaacgcgtgccctggacgaggcagactcgccgcgccaccgacttctagtactggtgaaggatcacggtgagccggcgctgacggccacggccaccgtgctggtgtcgttggtggagagcggacaggcgccaaaggcctcttcccggactttggcgggcgccgcgagcccagaggctgcgctggtggatgtcaacgtgtacctgatcatcgccatctgcgtggtgtccagcctcctggtactcacgctgctgctgtatacggcgctgtggtggtcggcaacgcccactgagggcgcgtgcgcgccggggaagcccacgctggtgtgctcccgcgcggtggggagctggtcatactcgcagcagaggcggcagagggtgtgctctgaggagggcccacctaagacggacctcatggccttcagccccagtcttcctctaggtctgaataaagaggaggaaggggaaagacaggagccagggtcaaatcaccccggacagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 172103 - DNA, 700 bp, Homo sapiens
  Payload ID: 13813
  Gene Symbol: PCDHA11
  Gene Name: protocadherin alpha 11
  ENST ID: ENST00000617408
  CDS Start-End: 1-598
ggtgtccagcctcctggtactcacgctgctgctgtatacggcgctgtggtggtcggcaacgcccactgagggcgcgtgcgcgccggggaagcccacgctggtgtgctcccgcgcggtggggagctggtcatactcgcagcagaggcggcagagggtgtgctctgaggagggcccacctaagacggacctcatggccttcagccccagtcttcctctaggtctgaataaagaggaggaaggggaaagacaggagccagggtcaaatcaccccggacagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccgaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggcc

SEQ ID NO: 172104 - DNA, 3418 bp, Homo sapiens
  Payload ID: 13813
  Gene Symbol: PCDHA11
  Gene Name: protocadherin alpha 11
  Uniprot ID: Q9Y5I1
  ENST ID: ENST00000616325
  CDS Start-End: 922-3354
tgctactatggcttacattagaaataatatatgtcaaataaaaactcatctagatcaatagacttttcctttgtggattcttttttaaaactaccaagtttgagaatatgaatatatttgtttttcatattgttctgcaatgaatataaagtcacttataatcagaaagcaattaaatgtaaataacagtaaagaatgagaactatagaaaatagatatgaaaatgcaagcccacagagatgagaatagatcatgtggaacataaacactaaagagctgcttttataaaacttcaattttttctttgagttccctagcagccaaagtaacaagggagactgaaagtaaaacaattcaaatttgatagtatttttatatgaggaacaacactttcaggaaatgtttaaccctagtttttcatgaggccaccttaacaactgaattctctttctctctcactctgtgtataagtattttagataagtaaaagaacaatgttataatgttaagtcaaacatagacacaataatttaaatttgatgttaatcgagaaatacaatgccatttccatatatatttagtttcaatatgacttataatctgaatattccataaataagcacgttggaaatatttgggggaagaaacccaaaacacgtgaaattctgtggtggtaaatgcagtgcacagtactcacagttttaggcgcaaggtgtcgctctttacttggtggaaagttcatttaaaggttggtctgaacagtgaggcactcccatacaaaggaactccatcataccggatgccaccgtttaaggatcctttgaaacttcttaagaattcaacgagatttttaacctgaaactgaagaatctggtactgtaagtgtaaagaagcttattttggaagccaatttcgtatgcgatgtttggttttcagagaaggggattgggcaccccacgactacagctctggcttctcctcctcgaattctgggaggtggggagcggccagctccactactccgtctcggaggaggccaaacacggcaccttcgtgggccgcatcgcgcaggacctggggctggagctggcggagctggtgcagcgcctgttccgggtggcgtccaaaacacatggggaccttctggaggtaaatctgcagaatggcattttgtttgtgaattctcggatcgaccgcgaggagctgtgcgggcagagcgcggagtgcagcatccacctggaggtgatcgtggacaggccgctgcaggttttccatgtgaacgtggaggtgaaggacattaacgacaacccgccggtgttctcgctcagagaacaaaagctgctgattgcggaatctaagcaatcggactcgcgttttccactagagggagcttctgatgctgacattgaagagaatgctctattgacctacaggctaagtaaaaatgagtatttttctttagattcaccaacaaatggtaagcagattaaaagactgtcacttattttaaagaagtctctggatagagagaaaactccggaacttaatttgctgctaacagctacagacgggggaaaaccagagcttactggcaccgttcggctgttagtccaagtcttggatgtcaacgacaatgatccagagtttgataaatcagaatataaggtgagccttatggaaaatgctgctaaagaaactcttgtgctcaaactaaacgccacagaccgagacgaaggagtcaatggagaggtaacatactccttaatgtcaattaagcccaatggaagacacttatttacactagatcaaaataatggagaagtgagggtcaatggaactttagattatgaagaaaacaagttttataaaattgaagtacaggctacagataaggggactcccccaatggcaggtcactgtacagtctgggtggaaatcttggacaccaacgataactctcctgaagtcgccgtgacttccttgtccctcccagtacgagaggacgctcagcccagcacggtcattgccctgatcagcgtgtctgaccgtgactcaggtgtcaacggacaggtgacctgctcgctgacgccccacgttcccttcaagctggtgtccaccttcaagaattactactcgttggtgctggacagcgccctggaccgcgagaacgtgtgggcctatgaactggtggtgactgcgcgggatgggggttcgccttctctgtgggccacggccagggtatccgtggaggtggccgacgtgaacgacaatgcgcctgcgttcgcacagcccgagtacaccgtgttcgtgaaggagaacaacccaccaggctgccacatcttcacagtgtcggcgcgggacgcggacgcgcaggagaacgcgctggtgtcctactcgctggtggagcggcggttgggcgaccgcgcgctgtcgagctacgtgtcggtgcacgcggagagcggcaaggtgtacgcgctgcagccgttggaccacgaggagctggagctgctacagttccaggtgagcgcgcgcgatgcgggcgtgccgcctctgagcagcaacgtgacgctgcaggtgttcgtgctggacgagaacgacaacgcgccggcactgctggcgactcaggctggcagcgcgggaggcgcagttaacaagctagtaccgcggtcggtgggtgcgggccacgtggtggcgaaggtgcgcgcagtggatgcggactcaggctacaacgcgtggctttcatatgaattgcagccggcggcgggcggctcgcgcatcccgttccgcgtggggctgtacacgggcgagataagcacaacgcgtgccctggacgaggcagactcgccgcgccaccgacttctagtactggtgaaggatcacggtgagccggcgctgacggccacggccaccgtgctggtgtcgttggtggagagcggacaggcgccaaaggcctcttcccggactttggcgggcgccgcgagcccagaggctgcgctggtggatgtcaacgtgtacctgatcatcgccatctgcgtggtgtccagcctcctggtactcacgctgctgctgtatacggcgctgtggtggtcggcaacgcccactgagggcgcgtgcgcgccggggaagcccacgctggtgtgctcccgcgcggtggggagctggtcatactcgcagcagaggcggcagagggtgtgctctgaggagggcccacctaagacggacctcatggccttcagccccagtcttcctctaggtctgaataaagaggaggaaggggaaagacaggagccagggtcaaatcaccccggacaggtgagttttctacagattccacctatcaggaagtgtatgtgaaattatttaaaatccagttttttttcacggattttttaagggaaagttttatgaataaccagtg

SEQ ID NO: 172105 - DNA, 5233 bp, Homo sapiens
  Payload ID: 13814
  Gene Symbol: PCDHA12
  Gene Name: protocadherin alpha 12
  Uniprot ID: Q9UN75
  ENST ID: ENST00000398631
  CDS Start-End: 1-2826
atggtgattatcggaccaagaggcccgggatcccagcgtctgctgctctcgcttctgctccttgcagcctgggaggtggggagcggccagctccactactccgtctacgaggaggccaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgagaagctgtgcgggcggagcgcggagtgcagtatccacctggaggtgatcgtggacaggccgctgcaggttttccatgtggacgtggaggtgaaggacattaacgacaacccgccggtgttcagagaaagggaacaaaaggtacctgtttctgaatctgcgcctctggactctcattttcctctagagggcgcttctgatgcggatatcggcgtaaactctcttttgacctatgcgttaagtctaaatgagaattttgagcttaaaataaaaacaaaaaaagataaaagtatattgcctgaattagttcttcggaagttattggacagagagcaaacgccaaaactcaatttattgctgatggtaatcgatggcggtaaaccagaactaacagggtctgtccagattcaaataaccgtcctggatgtgaatgacaatggtccggcgtttgataagcccagctataaagtagtgttgtctgaaaatgtccaaaacgacacaagagtgatccaactaaatgcttccgatccagacgaaggacttaatggagaaatttcctatgggatcaaaatgattttgccagtgagtgagaaatgtatgttttcaataaatccagacacaggtgaaattagaatttatggtgaactggattttgaagagaataatgcctatgaaattcaggttaacgccattgataaagggattccttccatggcaggtcacagcatggtcctggtggaagttctggacgtgaatgacaatgtccctgaagtaatggttacttcactgtcgctccctgtgcaagaggatgctcaggtgggtaccgtcattgccctgattagcgtgtcggatcgtgactctggagccaatggacaggtcatctgctcactgacacctcatgttcccttcaagctggtgtccacctacaagaattactactcgttggtgctggacagcgccctggaccgcgagagcgtgtcggcctatgagctggtggtgactgcgcgggatgggggctcgccttcgctgtgggccacggctagagtgtccgtggaggtggccgacgtgaacgacaatgcgcctgcgttcgcgcagcccgagtacacagtgttcgtgaaggagaacaacccgccgggctgccacatcttcacggtgtcggcatgggacgcggacgcgcagaagaacgcgctggtgtcctactcgctggtggagcggcgggtgggcgagcacgcactgtcgagctacgtgtcggtgcacgcggagagcggcaaggtgtacgcgctgcagccgctagaccacgaggagctggagctgctgcagttccaggtgagcgcgcgcgacgccggcgtgccgcctctgggcagcaacgtgacgctgcaggtgttcgtgctggacgagaacgacaacgcgccggcactgctggcgactccggctggcagcgcaggaggcgcagttagcgagttggtaccgcggtcggtgggtgcgggccacgtggtggcgaaagtgcgcgcggtggacgctgactccggctataacgcttggctgtcctacgagttgcaaccggcggcggtcggcgcgcacatcccgttccacgtggggctgtacactggcgagatcagcacgacacgcatcctggatgaggcggacgctccgcgccaccgcctgctggtgctggtgaaggaccacggtgagcccgcgctgacgtccacggccacggtgctggtgtcgctggtggagaacggccaggccccaaagacgtcgtcgcgggcctcagtgggcgctgtggatcccgaagcggctctggtggatattaacgtgtacctcatcatcgccatctgtgcggtgtccagcctgctggtgctcacgctgctgctgtacactgcgctgcgttgctcagcgccgcccaccgtgagccggtgcgcgccgggcaagcccacgctggtgtgctccagcgccgtggggagttggtcttactcgcagcagaggaggcagagggtgtgctctgcagagagcccgcccaagacggacctcatggccttcagcccaagccttcagctgtctcgagaagattgtttaaatcctcccagtgaaccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 172106 - DNA, 2588 bp, Homo sapiens
  Payload ID: 13814
  Gene Symbol: PCDHA12
  Gene Name: protocadherin alpha 12
  Uniprot ID: Q9UN75
  ENST ID: ENST00000613593
  CDS Start-End: 172-2550
gcacccacattccaatcattcacggaataggatcgactccataatgactgtgatgctggaaaaaatttactaaatatgtacttacagaaaagggtgactgctcataaaatacctcaggcaagcgatcccttaaaactgattgtcccaactcagaggccctcattttctgcaatggtgattatcggaccaagaggcccgggatcccagcgtctgctgctctcgcttctgctccttgcagcctgggaggtggggagcggccagctccactactccgtctacgaggaggccaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgagaagctgtgcgggcggagcgcggagtgcagtatccacctggaggtgatcgtggacaggccgctgcaggttttccatgtggacgtggaggtgaaggacattaacgacaacccgccggtgttcagagaaagggaacaaaaggtacctgtttctgaatctgcgcctctggactctcattttcctctagagggcgcttctgatgcggatatcggcgtaaactctcttttgacctatgcgttaagtctaaatgagaattttgagcttaaaataaaaacaaaaaaagataaaagtatattgcctgaattagttcttcggaagttattggacagagagcaaacgccaaaactcaatttattgctgatggtaatcgatggcggtaaaccagaactaacagggtctgtccagattcaaataaccgtcctggatgtgaatgacaatggtccggcgtttgataagcccagctataaagtagtgttgtctgaaaatgtccaaaacgacacaagagtgatccaactaaatgcttccgatccagacgaaggacttaatggagaaatttcctatgggatcaaaatgattttgccagtgagtgagaaatgtatgttttcaataaatccagacacaggtgaaattagaatttatggtgaactggattttgaagagaataatgcctatgaaattcaggttaacgccattgataaagggattccttccatggcaggtcacagcatggtcctggtggaagttctggacgtgaatgacaatgtccctgaagtaatggttacttcactgtcgctccctgtgcaagaggatgctcaggtgggtaccgtcattgccctgattagcgtgtcggatcgtgactctggagccaatggacaggtcatctgctcactgacacctcatgttcccttcaagctggtgtccacctacaagaattactactcgttggtgctggacagcgccctggaccgcgagagcgtgtcggcctatgagctggtggtgactgcgcgggatgggggctcgccttcgctgtgggccacggctagagtgtccgtggaggtggccgacgtgaacgacaatgcgcctgcgttcgcgcagcccgagtacacagtgttcgtgaaggagaacaacccgccgggctgccacatcttcacggtgtcggcatgggacgcggacgcgcagaagaacgcgctggtgtcctactcgctggtggagcggcgggtgggcgagcacgcactgtcgagctacgtgtcggtgcacgcggagagcggcaaggtgtacgcgctgcagccgctagaccacgaggagctggagctgctgcagttccaggtgagcgcgcgcgacgccggcgtgccgcctctgggcagcaacgtgacgctgcaggtgttcgtgctggacgagaacgacaacgcgccggcactgctggcgactccggctggcagcgcaggaggcgcagttagcgagttggtaccgcggtcggtgggtgcgggccacgtggtggcgaaagtgcgcgcggtggacgctgactccggctataacgcttggctgtcctacgagttgcaaccggcggcggtcggcgcgcacatcccgttccacgtggggctgtacactggcgagatcagcacgacacgcatcctggatgaggcggacgctccgcgccaccgcctgctggtgctggtgaaggaccacggtgagcccgcgctgacgtccacggccacggtgctggtgtcgctggtggagaacggccaggccccaaagacgtcgtcgcgggcctcagtgggcgctgtggatcccgaagcggctctggtggatattaacgtgtacctcatcatcgccatctgtgcggtgtccagcctgctggtgctcacgctgctgctgtacactgcgctgcgttgctcagcgccgcccaccgtgagccggtgcgcgccgggcaagcccacgctggtgtgctccagcgccgtggggagttggtcttactcgcagcagaggaggcagagggtgtgctctgcagagagcccgcccaagacggacctcatggccttcagcccaagccttcagctgtctcgagaagattgtttaaatcctcccagtgaagtaagttattaatattatttagatatatttgtttccttgaagaacttccg

SEQ ID NO: 172107 - DNA, 5260 bp, Homo sapiens
  Payload ID: 13815
  Gene Symbol: PCDHA13
  Gene Name: protocadherin alpha 13
  Uniprot ID: Q9Y5I0
  ENST ID: ENST00000289272
  CDS Start-End: 1-2853
atgctgtcttcctggcaaggaggcccaagaccgcggcaactactgctctggcttctgatcctcgcagcctgggagacgggtagtggccagctccactactccgtccccgaggaagcaaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgaggagctgtgtgggcggagcgcggagtgcagcatccacctggaggtgatcgtggacaggcctctgcaggttttccatgtggaggtgaaggtgagggacattaacgacaacccgcccatattccctgaaagcaagaaacgaataatcattgcagaatctagacctccggaaactcgatttccactagatggcgcatccgatgcagatattggagtaaactcggcattgacctaccgactggatcccaacgattatttcactttggacgcacaaaacagtcttgagcaaatgtcttcattatcacttgtactgaggaaaacactggacagagaggaaattcaggaacatagtttattactgacagccagtgatggaggtaaacccgagctgactggcacagttcagctgctcatcacgattctggacgtgaatgacaacgccccggaattttaccaatccgtttataaagtgacggtgttagagaacgccttcaatggaacattagtgatcaagctaaatgccacagatcctgatgatggtacaaatggagatatagtttactcatttagaaggcctgtatggcctgcagtggtatatgcatttaccataaatccgaacaatggagaaattaggacaaaaggcaaactagatttcgaagaaaagaaattatatgaaatatccgtggaggcagttgacaaaggaaatattccaatggcgggtcattgtacccttttggtggaagtactagatgtaaatgataacgccccagaggttaccatcacttctttgtcactccccatcagagaagacactcagcctagcgccattattgccctaatcagtgtgtccgatcgtgactctggctcaaatggacaggtcacctgcaccttgacgccgcatgtccccttcaagctggtgtccacctacaagaactactactcattagtgctggacagcgccctggaccgcgagagcgtatcagcctatgaactggtggtgaccgcgcgggacgggggctcgccttcgctgtgggccacggccagcgtgtcggtgggggtggccgacgtgaacgacaacgcgccggcgttcgcgcagcccgagtacacggtgttcgtgaaggaaaacaatccgccgggctgccacatcttcacggtgtctgctcaggacgcggacgcacaggagaacgcgctggtctcctactcgctggtggagcggcgggtgggcgagcgtgcgctgtcgagctacgtgtcggtgcacgcggagagcggcaaggtgtacgcgctgcagccgttggaccacgaggagctggagctgttgcagttccaggtgagcgcgcgcgactctggcgtgccgcctctgggcagcaacgtgacgctgcaggtgttcgtgctggacgagaacgacaacgctccggcgctgctgacgcccggggctggcagcgcgggaggcacagtgagcgagctgatgccgcggtcggtgggtgcaggccacgtggtggcgaaggtgcgcgcggtggacgccgattcgggctacaatgcgtggctttcgtatgaattgcagctggcggcggtcggcgcgcgcatcccgttccgcgtggggctgtacactggcgagatcagcacgacgcgccctctggacgaggtggacgcgccgcaccaccgccttctggtgctggtgaaggaccacggtgagcccgcgctgacggccacggcaacggtgctgttgtcgctggtggagagcggccaagcgccacaggcttcgtcgagggcgtcggcaggcgctgtgggtccagaagcggcgctggtggatgtcaatgtttacttgatcattgccatctgcgcggtgtccagcctgttggtgctcacgttgctgctgtatactgcgctgcggtgctcggcaccgcccaccgagggcgcgtgcgcgccgggcaagcccactctagtgtgctccagcgcggcagggagttggtcgtactcgcagcagaggcggccgagggtgtgctctggggagggcccgcataagacggacctcatggccttcagtcccagccttcctccttgtctgggttctgcagagggaacaggccagagggaggaggactcagaatgcttgaaagagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 172108 - DNA, 4884 bp, Homo sapiens
  Payload ID: 13815
  Gene Symbol: PCDHA13
  Gene Name: protocadherin alpha 13
  ENST ID: ENST00000409494
  CDS Start-End: 62-2776
gacagtttgaggtaaggcgttgtatatattgcagatagctctgaggtttttggagtgtaccatgctgtcttcctggcaaggaggcccaagaccgcggcaactactgctctggcttctgatcctcgcagcctgggagacgggtagtggccagctccactactccgtccccgaggaagcaaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgaggagctgtgtgggcggagcgcggagtgcagcatccacctggaggtgatcgtggacaggcctctgcaggttttccatgtggaggtgaaggtgagggacattaacgacaacccgcccatattccctgaaagcaagaaacgaataatcattgcagaatctagacctccggaaactcgatttccactagatggcgcatccgatgcagatattggagtaaactcggcattgacctaccgactggatcccaacgattatttcactttggacgcacaaaacagtcttgagcaaatgtcttcattatcacttgtactgaggaaaacactggacagagaggaaattcaggaacatagtttattactgacagccagtgatggaggtaaacccgagctgactggcacagttcagctgctcatcacgattctggacgtgaatgacaacgccccggaattttaccaatccgtttataaagtgacggtgttagagaacgccttcaatggaacattagtgatcaagctaaatgccacagatcctgatgatggtacaaatggagatatagtttactcatttagaaggcctgtatggcctgcagtggtatatgcatttaccataaatccgaacaatggagaaattaggacaaaaggcaaactagatttcgaagaaaagaaattatatgaaatatccgtggaggcagttgacaaaggaaatattccaatggcgggtcattgtacccttttggtggaagtactagatgtaaatgataacgccccagaggttaccatcacttctttgtcactccccatcagagaagacactcagcctagcgccattattgccctaatcagtgtgtccgatcgtgactctggctcaaatggacaggtcacctgcaccttgacgccgcatgtccccttcaagctggtgtccacctacaagaactactactcattagtgctggacagcgccctggaccgcgagagcgtatcagcctatgaactggtggtgaccgcgcgggacgggggctcgccttcgctgtgggccacggccagcgtgtcggtgggggtggccgacgtgaacgacaacgcgccggcgttcgcgcagcccgagtacacggtgttcgtgaaggaaaacaatccgccgggctgccacatcttcacggtgtctgctcaggacgcggacgcacaggagaacgcgctggtctcctactcgctggtggagcggcgggtgggcgagcgtgcgctgtcgagctacgtgtcggtgcacgcggagagcggcaaggtgtacgcgctgcagccgttggaccacgaggagctggagctgttgcagttccaggtgagcgcgcgcgactctggcgtgccgcctctgggcagcaacgtgacgctgcaggtgttcgtgctggacgagaacgacaacgctccggcgctgctgacgcccggggctggcagcgcgggaggcacagtgagcgagctgatgccgcggtcggtgggtgcaggccacgtggtggcgaaggtgcgcgcggtggacgccgattcgggctacaatgcgtggctttcgtatgaattgcagctggcggcggtcggcgcgcgcatcccgttccgcgtggggctgtacactggcgagatcagcacgacgcgccctctggacgaggtggacgcgccgcaccaccgccttctggtgctggtgaaggaccacggtgagcccgcgctgacggccacggcaacggtgctgttgtcgctggtggagagcggccaagcgccacaggcttcgtcgagggcgtcggcaggcgctgtgggtccagaagcggcgctggtggatgtcaatgtttacttgatcattgccatctgcgcggtgtccagcctgttggtgctcacgttgctgctgtatactgcgctgcggtgctcggcaccgcccaccgagggcgcgtgcgcgccgggcaagcccactctagtgtgctccagcgcggcagggagttggtcgtactcgcagcagaggcggccgagggtgtgctctggggagggcccgcataagacggacctcatggccttcagtcccagccttcctccttgtctgggttctgcagagggaacaggccagagggaggaggactcagaatgcttgaaagagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccgaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 172109 - DNA, 2427 bp, Homo sapiens
  Payload ID: 13815
  Gene Symbol: PCDHA13
  Gene Name: protocadherin alpha 13
  Uniprot ID: Q9Y5I0
  ENST ID: ENST00000617769
  CDS Start-End: 1-2424
atgctgtcttcctggcaaggaggcccaagaccgcggcaactactgctctggcttctgatcctcgcagcctgggagacgggtagtggccagctccactactccgtccccgaggaagcaaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgaggagctgtgtgggcggagcgcggagtgcagcatccacctggaggtgatcgtggacaggcctctgcaggttttccatgtggaggtgaaggtgagggacattaacgacaacccgcccatattccctgaaagcaagaaacgaataatcattgcagaatctagacctccggaaactcgatttccactagatggcgcatccgatgcagatattggagtaaactcggcattgacctaccgactggatcccaacgattatttcactttggacgcacaaaacagtcttgagcaaatgtcttcattatcacttgtactgaggaaaacactggacagagaggaaattcaggaacatagtttattactgacagccagtgatggaggtaaacccgagctgactggcacagttcagctgctcatcacgattctggacgtgaatgacaacgccccggaattttaccaatccgtttataaagtgacggtgttagagaacgccttcaatggaacattagtgatcaagctaaatgccacagatcctgatgatggtacaaatggagatatagtttactcatttagaaggcctgtatggcctgcagtggtatatgcatttaccataaatccgaacaatggagaaattaggacaaaaggcaaactagatttcgaagaaaagaaattatatgaaatatccgtggaggcagttgacaaaggaaatattccaatggcgggtcattgtacccttttggtggaagtactagatgtaaatgataacgccccagaggttaccatcacttctttgtcactccccatcagagaagacactcagcctagcgccattattgccctaatcagtgtgtccgatcgtgactctggctcaaatggacaggtcacctgcaccttgacgccgcatgtccccttcaagctggtgtccacctacaagaactactactcattagtgctggacagcgccctggaccgcgagagcgtatcagcctatgaactggtggtgaccgcgcgggacgggggctcgccttcgctgtgggccacggccagcgtgtcggtgggggtggccgacgtgaacgacaacgcgccggcgttcgcgcagcccgagtacacggtgttcgtgaaggaaaacaatccgccgggctgccacatcttcacggtgtctgctcaggacgcggacgcacaggagaacgcgctggtctcctactcgctggtggagcggcgggtgggcgagcgtgcgctgtcgagctacgtgtcggtgcacgcggagagcggcaaggtgtacgcgctgcagccgttggaccacgaggagctggagctgttgcagttccaggtgagcgcgcgcgactctggcgtgccgcctctgggcagcaacgtgacgctgcaggtgttcgtgctggacgagaacgacaacgctccggcgctgctgacgcccggggctggcagcgcgggaggcacagtgagcgagctgatgccgcggtcggtgggtgcaggccacgtggtggcgaaggtgcgcgcggtggacgccgattcgggctacaatgcgtggctttcgtatgaattgcagctggcggcggtcggcgcgcgcatcccgttccgcgtggggctgtacactggcgagatcagcacgacgcgccctctggacgaggtggacgcgccgcaccaccgccttctggtgctggtgaaggaccacggtgagcccgcgctgacggccacggcaacggtgctgttgtcgctggtggagagcggccaagcgccacaggcttcgtcgagggcgtcggcaggcgctgtgggtccagaagcggcgctggtggatgtcaatgtttacttgatcattgccatctgcgcggtgtccagcctgttggtgctcacgttgctgctgtatactgcgctgcggtgctcggcaccgcccaccgagggcgcgtgcgcgccgggcaagcccactctagtgtgctccagcgcggcagggagttggtcgtactcgcagcagaggcggccgagggtgtgctctggggagggcccgcataagacggacctcatggccttcagtcccagccttcctccttgtctgggttctgcagagggaacaggccagagggaggaggactcagaatgcttgaaagaggtaagcttatattttaaaaaattgtcttagtaa

SEQ ID NO: 172110 - DNA, 2626 bp, Homo sapiens
  Payload ID: 13816
  Gene Symbol: PCDHA2
  Gene Name: protocadherin alpha 2
  Uniprot ID: Q9Y5H9
  ENST ID: ENST00000378132
  CDS Start-End: 114-2588
acttcagagaagcggaggaataagagaagcagcaggactttaacagagactagaatatttaaatttttgcaaaacatgctcttctaatttgatcaaaacattgaggattggtaatggcgtcttctatcagaaggggccgaggggcctggacacggctgctctcgcttctgctcctcgcagcctgggaggtggggagcggccagctccgctactccgtccccgaggaggccaaacacggcaccttcgtgggccgcatcgcgcaggacctggggctggagctggaggagctggtgccgcgcctgttccgggtggcgtccaaaagacacggggaccttctggaggtaaatctgcagaatggcattttgtttgtgaattctcggatcgaccgggaggagctgtgcgggcggagcgcggaatgtagcatccacgtggaggtgatcgtggacaggccgctgcaggttttccatgtggaagtggaggtgaaggacattaacgacaacccgccaatatttccaatgacagtaaagactatccggtttcccgaatcaaggctgcttgattctcggtttcctctagagggagcatctgatgcagatataggagtaaatgctcttctctcctacaagctcagctccagtgagtttttcttcctagatatacaggcaaatgatgaactaagcgaatctttgtctctcgtgctggggaaatcgctggacagagaggaaactgctgaggttaatttgttactggtggctactgatgggggcaaacctgagctcacgggcaccgttcaaatacttattaaggtattagatgtaaatgacaatgaaccaacttttgcccaatcagtttacaaagtaaaattgttagagaatacggcaaatgggaccttagtggttaagttaaacgcttctgatgcagatgaaggaccgaacagcgagattgtgtattcactcggtagtgatgtgtcctccactatacagactaagtttaccatagatcccatctcaggggaaatcagaactaagggaaaattagattatgaagaagcaaagtcctacgagattcaggtcactgcaactgacaaaggaaccccttcaatgtcaggacattgtaaaatttcattaaaacttgtggacatcaatgataacacaccagaagtctcaataacgtctctctcacttcccatctcagagaacgcttccctgggcactgtcattgctctcatcacggtgtcggatcgcgactctggtacgaatggacatgtcacctgctccctgacgccccacgtccctttcaagctggtgtccaccttcaagaattactactcgttggtgctggacagcgccctggaccgcgagagcgtgtcagcctatgagctggtggtgaccgcacgggacgggggctcgccttcactgtgggccaccaccagcgtgtccatcgaggtggccgacgtgaacgacaacgcgccggcgttcgcacagcctgagtacacagtattcgtgaaggagaacaacccgccgggctgccacatcttcacggtgtcagcgtgggatgcggacgcgcaggagaacgcgctggtgtcctactcgctggtggagcggcgggtgggcgagcgcgcgttgtcgagctacgtttcggtgcacgcggagagcggcaaggtgtacgcgctgcagccgctggaccacgaggaagtggagctgctgcagttccaggtgagcgcgcgggatgcgggcgtgccgcctctgggcagcaacgtgacgctgcaggtgttcgtgctggacgagaacgacaacgcgccggcactgttggcgcctagggctggcaccgctgctggcgcagtgagtgagctggtgccgtggtcggtgggtgcagggcacgtggtggcgaaggtgcgcgcagtggacgctgactcaggctacaacgcgtggctttcgtacgagcttcagctgggtactggcagcgctcgcatcccgttccgcgtggggctatacacgggtgagatcagcacgacacgtgccctagacgaggctgactcccctcgacaccgcctactcgtgctggtgaaggaccacggcgaaccagcgttgacagccacggccaccgtgttagtgtcgttggtggaaagtggccaggcacccaaggcctcgtcgcgggcgtgggtgggcgccgcgggctcagaggctacgctggtggatgtcaacgtgtacctgatcatcgccatctgcgcggtatccagcctgttggtgctcacggtgctgctgtacactgcgctgcggtgctcggtgccacccaccgagggtgcgcgcgcgccaggaaagcccacgctggtgtgctccagcgccgtggggagctggtcttactcgcagcagaggcggcagagggtgtgctctggggaggacccccccaagacggacctcatggccttcagccctagcttatctcaaggtccagactccgcagaagagaaacagctctcagaatcagaatacgtaggaaaggtgagtcttttactttttcttgccaattctaaaattgttctttttaaaaaattctatatgatttctactagttatttagattcatagttcttcatttattttatatcatcctaccgtgcgatttt

SEQ ID NO: 172111 - DNA, 3056 bp, Homo sapiens
  Payload ID: 13816
  Gene Symbol: PCDHA2
  Gene Name: protocadherin alpha 2
  Uniprot ID: Q9Y5H9
  ENST ID: ENST00000520672
  CDS Start-End: 107-2533
agaagcggaggaataagagaagcagcaggactttaacagagactagaatatttaaatttttgcaaaacatgctcttctaatttgatcaaaacattgaggattggtaatggcgtcttctatcagaaggggccgaggggcctggacacggctgctctcgcttctgctcctcgcagcctgggaggtggggagcggccagctccgctactccgtccccgaggaggccaaacacggcaccttcgtgggccgcatcgcgcaggacctggggctggagctggaggagctggtgccgcgcctgttccgggtggcgtccaaaagacacggggaccttctggaggtaaatctgcagaatggcattttgtttgtgaattctcggatcgaccgggaggagctgtgcgggcggagcgcggaatgtagcatccacgtggaggtgatcgtggacaggccgctgcaggttttccatgtggaagtggaggtgaaggacattaacgacaacccgccaatatttccaatgacagtaaagactatccggtttcccgaatcaaggctgcttgattctcggtttcctctagagggagcatctgatgcagatataggagtaaatgctcttctctcctacaagctcagctccagtgagtttttcttcctagatatacaggcaaatgatgaactaagcgaatctttgtctctcgtgctggggaaatcgctggacagagaggaaactgctgaggttaatttgttactggtggctactgatgggggcaaacctgagctcacgggcaccgttcaaatacttattaaggtattagatgtaaatgacaatgaaccaacttttgcccaatcagtttacaaagtaaaattgttagagaatacggcaaatgggaccttagtggttaagttaaacgcttctgatgcagatgaaggaccgaacagcgagattgtgtattcactcggtagtgatgtgtcctccactatacagactaagtttaccatagatcccatctcaggggaaatcagaactaagggaaaattagattatgaagaagcaaagtcctacgagattcaggtcactgcaactgacaaaggaaccccttcaatgtcaggacattgtaaaatttcattaaaacttgtggacatcaatgataacacaccagaagtctcaataacgtctctctcacttcccatctcagagaacgcttccctgggcactgtcattgctctcatcacggtgtcggatcgcgactctggtacgaatggacatgtcacctgctccctgacgccccacgtccctttcaagctggtgtccaccttcaagaattactactcgttggtgctggacagcgccctggaccgcgagagcgtgtcagcctatgagctggtggtgaccgcacgggacgggggctcgccttcactgtgggccaccaccagcgtgtccatcgaggtggccgacgtgaacgacaacgcgccggcgttcgcacagcctgagtacacagtattcgtgaaggagaacaacccgccgggctgccacatcttcacggtgtcagcgtgggatgcggacgcgcaggagaacgcgctggtgtcctactcgctggtggagcggcgggtgggcgagcgcgcgttgtcgagctacgtttcggtgcacgcggagagcggcaaggtgtacgcgctgcagccgctggaccacgaggaagtggagctgctgcagttccaggtgagcgcgcgggatgcgggcgtgccgcctctgggcagcaacgtgacgctgcaggtgttcgtgctggacgagaacgacaacgcgccggcactgttggcgcctagggctggcaccgctgctggcgcagtgagtgagctggtgccgtggtcggtgggtgcagggcacgtggtggcgaaggtgcgcgcagtggacgctgactcaggctacaacgcgtggctttcgtacgagcttcagctgggtactggcagcgctcgcatcccgttccgcgtggggctatacacgggtgagatcagcacgacacgtgccctagacgaggctgactcccctcgacaccgcctactcgtgctggtgaaggaccacggcgaaccagcgttgacagccacggccaccgtgttagtgtcgttggtggaaagtggccaggcacccaaggcctcgtcgcgggcgtgggtgggcgccgcgggctcagaggctacgctggtggatgtcaacgtgtacctgatcatcgccatctgcgcggtatccagcctgttggtgctcacggtgctgctgtacactgcgctgcggtgctcggtgccacccaccgagggtgcgcgcgcgccaggaaagcccacgctggtgtgctccagcgccgtggggagctggtcttactcgcagcagaggcggcagagggtgtgctctggggaggacccccccaagacggacctcatggccttcagccctagcttatctcaaggtccagactccgcagaagagaaacagctctcagaatcagaatacgtaggaaagatatggaacttcaatcttcaaatccagcttgcctcttgaaactattgtctaacaagactcttggcaaagacattttgaagactttggaattttcacttcacagatgtactgatgctatgccaaataaatattgaatagctaccaaataaacattgttttctattctgctgcattccccatctgtacattaaaatacctggtaaatgaaaatattacaaatgaaatgggtgaaaatggaattcttcctccttttttccaatgtgcttgatgtcaatgatcattttgtaaaaatatagtttgggtccccacatagtgaaagtactctggtttctgtttgattcagaaatttggtgggttttttgttgttgttttggtttttgtgtgtgtgtgtttgtgtgagtgtagttcttcaatagagagggagcgtaaagctattttcactagattgattttttgtttagacaaacaggatgaaaataactttatggatataggaggcaaggaaagtttttaaatggctaccattatgtctttatatattaaatttctttatgtaagaaaa

SEQ ID NO: 172112 - DNA, 5254 bp, Homo sapiens
  Payload ID: 13816
  Gene Symbol: PCDHA2
  Gene Name: protocadherin alpha 2
  Uniprot ID: Q9Y5H9
  ENST ID: ENST00000526136
  CDS Start-End: 1-2847
atggcgtcttctatcagaaggggccgaggggcctggacacggctgctctcgcttctgctcctcgcagcctgggaggtggggagcggccagctccgctactccgtccccgaggaggccaaacacggcaccttcgtgggccgcatcgcgcaggacctggggctggagctggaggagctggtgccgcgcctgttccgggtggcgtccaaaagacacggggaccttctggaggtaaatctgcagaatggcattttgtttgtgaattctcggatcgaccgggaggagctgtgcgggcggagcgcggaatgtagcatccacgtggaggtgatcgtggacaggccgctgcaggttttccatgtggaagtggaggtgaaggacattaacgacaacccgccaatatttccaatgacagtaaagactatccggtttcccgaatcaaggctgcttgattctcggtttcctctagagggagcatctgatgcagatataggagtaaatgctcttctctcctacaagctcagctccagtgagtttttcttcctagatatacaggcaaatgatgaactaagcgaatctttgtctctcgtgctggggaaatcgctggacagagaggaaactgctgaggttaatttgttactggtggctactgatgggggcaaacctgagctcacgggcaccgttcaaatacttattaaggtattagatgtaaatgacaatgaaccaacttttgcccaatcagtttacaaagtaaaattgttagagaatacggcaaatgggaccttagtggttaagttaaacgcttctgatgcagatgaaggaccgaacagcgagattgtgtattcactcggtagtgatgtgtcctccactatacagactaagtttaccatagatcccatctcaggggaaatcagaactaagggaaaattagattatgaagaagcaaagtcctacgagattcaggtcactgcaactgacaaaggaaccccttcaatgtcaggacattgtaaaatttcattaaaacttgtggacatcaatgataacacaccagaagtctcaataacgtctctctcacttcccatctcagagaacgcttccctgggcactgtcattgctctcatcacggtgtcggatcgcgactctggtacgaatggacatgtcacctgctccctgacgccccacgtccctttcaagctggtgtccaccttcaagaattactactcgttggtgctggacagcgccctggaccgcgagagcgtgtcagcctatgagctggtggtgaccgcacgggacgggggctcgccttcactgtgggccaccaccagcgtgtccatcgaggtggccgacgtgaacgacaacgcgccggcgttcgcacagcctgagtacacagtattcgtgaaggagaacaacccgccgggctgccacatcttcacggtgtcagcgtgggatgcggacgcgcaggagaacgcgctggtgtcctactcgctggtggagcggcgggtgggcgagcgcgcgttgtcgagctacgtttcggtgcacgcggagagcggcaaggtgtacgcgctgcagccgctggaccacgaggaagtggagctgctgcagttccaggtgagcgcgcgggatgcgggcgtgccgcctctgggcagcaacgtgacgctgcaggtgttcgtgctggacgagaacgacaacgcgccggcactgttggcgcctagggctggcaccgctgctggcgcagtgagtgagctggtgccgtggtcggtgggtgcagggcacgtggtggcgaaggtgcgcgcagtggacgctgactcaggctacaacgcgtggctttcgtacgagcttcagctgggtactggcagcgctcgcatcccgttccgcgtggggctatacacgggtgagatcagcacgacacgtgccctagacgaggctgactcccctcgacaccgcctactcgtgctggtgaaggaccacggcgaaccagcgttgacagccacggccaccgtgttagtgtcgttggtggaaagtggccaggcacccaaggcctcgtcgcgggcgtgggtgggcgccgcgggctcagaggctacgctggtggatgtcaacgtgtacctgatcatcgccatctgcgcggtatccagcctgttggtgctcacggtgctgctgtacactgcgctgcggtgctcggtgccacccaccgagggtgcgcgcgcgccaggaaagcccacgctggtgtgctccagcgccgtggggagctggtcttactcgcagcagaggcggcagagggtgtgctctggggaggacccccccaagacggacctcatggccttcagccctagcttatctcaaggtccagactccgcagaagagaaacagctctcagaatcagaatacgtaggaaagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 172113 - DNA, 5260 bp, Homo sapiens
  Payload ID: 13817
  Gene Symbol: PCDHA3
  Gene Name: protocadherin alpha 3
  Uniprot ID: Q9Y5H8
  ENST ID: ENST00000522353
  CDS Start-End: 1-2853
atgttgttctcctggcgagaagatcctggagcccagtgcctgctgctttctcttctgctcctcgcagcctcggaggtggggagcggccagctccactactccgtctctgaggaggccaagcatggcaccttcgtgggccgcatcgcgcaggacctggggctggagctggcggagctggtgccgcgcctgttccgggtggcgtccaaaagacacggggaccttctggaggtaaatctgcagaatggcattttgtttgtgaattctcggatagaccgcgaggaactgtgcgggcggagcgcggagtgcagcatccacctggaggtgatcgtggacaggccgctgcaggttttccatgtggaggtggaagtgaaggacattaatgacaacgcgccagtttttccaatggctgtaaagaatctgtttatttccgaatcccgacagcctggctctcggttttcgctagagggcgcatcagatgcagatatcggaacaaattcgttgttgacttacagtcttgattccactgaatattttaccttggacgttaaaagaaatgatgaggaaattaaatcccttggactcgtgttgaaaaaaaatttaaatcgagaggacactcctaagcattatttactaataacagcaattgatggtgggaaaccagagctcactggcacgactcaactaaagatcactgttttagatgtaaacgacaacgccccagcgtttgagaggacgatctataaagtcagattactcgaaaatgcaccaaatggtaccctagtggtgaccgttaacgccaccgatttggatgaaggagtaaataaggatatcgcgtattctttcaatacggacatgtcagcagatattctgtcaaaattccatttagatccagtcaatggacaaatcagtgtaaagggtaacatagatttcgaggaaagtaagtcatatgaaatccaggtagaagccacggataaaggaaatcccccaatgtcagatcactgcacagttctactcgaaattgtggacatcaatgataatgtacctgagttagttattcaatcactatctttacctgtattagaagactctccacttagcacagtcatcgctctgatcagcgtgtccgaccgcgactcaggagtcaatggacaggtcacctgctcgctgacgccccacgtccccttcaagctggtgtccaccttcaagaattactactcattggtgctggacagccctctggaccgcgagagcgtgtcggcctatgagctggtggtgactgctcgggacgggggctcgccttcactgtgggccacggccagcgtgtccgtggaggtggccgacgtgaacgacaatgcgccggcattctcgcagtccgagtacacggtgttcgtgaaggagaacaacccgccgggctgccacatcttcacggtgtctgcgcgggacgcggacgcgcaggagaacgccctggtgtcctactcgctggtggaacggcgggtgggggagcgcgcgctgtcgagctacgtgtcggtacacgcggagagcggcaaggtgtacgcgctgcagccgctggaccacgaggagctagagctgctgcagttccaggtgagtgcgcgcgatgcgggcgtgccgcctctgggcagcaacgtgacgctgcaggtgttcgtgctggacgagaacgacaacgcgccggcactgctgatgcctcgggtgggtggcatcggtggcgcagtgagcgagctggtgccgcggtcagtgggtgcgggccacgtggtagcgaaggtgcgcgcagtggatgcagactcaggctacaacgcgtggctttcgtatgagctgcagcctgggaccggcggtgcgcgcatcccgtttcgcgtggggctgtacacgggagagatcagcacgacccgtgccctggacgaggtggacgccccgcgccatcgcctactggtgctggtgaaggaccacggtgaaccctcattgaccgccacggccactgtgctggtgtcgctggtggagagtggccaggcacccaaggcctcgtcccaggcgtccgctggcgccacgggcccggaagctgcactggtggatgtcaacgtgtacttgatcgtcgccatctgcgcggtgtccagtctgttggtgctcacactgctgctatatactgctctgcggtgctccgcgccgccaaccgaaggcgactgtgggccgggcaagcccacgctggtgtgctccagcgcggtggggagctggtcatactcgcagcagaggcagcagagggtgtgctctggagaggggttgcccaagaccgacctcatggcttttagccctagccttcctccttgtccaattagccgggatagagaggagaaacaggatgtggacgttgatctctcagccaaaccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 172114 - DNA, 4594 bp, Homo sapiens
  Payload ID: 13817
  Gene Symbol: PCDHA3
  Gene Name: protocadherin alpha 3
  Uniprot ID: Q9Y5H8
  ENST ID: ENST00000532566
  CDS Start-End: 171-2645
ctttctccacaaaagaaataacagcgtgcattacgtattcagatactgctttgcttcatcctctctaaaatttaacaccgaggagtttaagaaatgaagataaggaactcgaattatttttaaactttggatcaatgtaaaggcaatctaatatttggaaaatacttgcaatgttgttctcctggcgagaagatcctggagcccagtgcctgctgctttctcttctgctcctcgcagcctcggaggtggggagcggccagctccactactccgtctctgaggaggccaagcatggcaccttcgtgggccgcatcgcgcaggacctggggctggagctggcggagctggtgccgcgcctgttccgggtggcgtccaaaagacacggggaccttctggaggtaaatctgcagaatggcattttgtttgtgaattctcggatagaccgcgaggaactgtgcgggcggagcgcggagtgcagcatccacctggaggtgatcgtggacaggccgctgcaggttttccatgtggaggtggaagtgaaggacattaatgacaacgcgccagtttttccaatggctgtaaagaatctgtttatttccgaatcccgacagcctggctctcggttttcgctagagggcgcatcagatgcagatatcggaacaaattcgttgttgacttacagtcttgattccactgaatattttaccttggacgttaaaagaaatgatgaggaaattaaatcccttggactcgtgttgaaaaaaaatttaaatcgagaggacactcctaagcattatttactaataacagcaattgatggtgggaaaccagagctcactggcacgactcaactaaagatcactgttttagatgtaaacgacaacgccccagcgtttgagaggacgatctataaagtcagattactcgaaaatgcaccaaatggtaccctagtggtgaccgttaacgccaccgatttggatgaaggagtaaataaggatatcgcgtattctttcaatacggacatgtcagcagatattctgtcaaaattccatttagatccagtcaatggacaaatcagtgtaaagggtaacatagatttcgaggaaagtaagtcatatgaaatccaggtagaagccacggataaaggaaatcccccaatgtcagatcactgcacagttctactcgaaattgtggacatcaatgataatgtacctgagttagttattcaatcactatctttacctgtattagaagactctccacttagcacagtcatcgctctgatcagcgtgtccgaccgcgactcaggagtcaatggacaggtcacctgctcgctgacgccccacgtccccttcaagctggtgtccaccttcaagaattactactcattggtgctggacagccctctggaccgcgagagcgtgtcggcctatgagctggtggtgactgctcgggacgggggctcgccttcactgtgggccacggccagcgtgtccgtggaggtggccgacgtgaacgacaatgcgccggcattctcgcagtccgagtacacggtgttcgtgaaggagaacaacccgccgggctgccacatcttcacggtgtctgcgcgggacgcggacgcgcaggagaacgccctggtgtcctactcgctggtggaacggcgggtgggggagcgcgcgctgtcgagctacgtgtcggtacacgcggagagcggcaaggtgtacgcgctgcagccgctggaccacgaggagctagagctgctgcagttccaggtgagtgcgcgcgatgcgggcgtgccgcctctgggcagcaacgtgacgctgcaggtgttcgtgctggacgagaacgacaacgcgccggcactgctgatgcctcgggtgggtggcatcggtggcgcagtgagcgagctggtgccgcggtcagtgggtgcgggccacgtggtagcgaaggtgcgcgcagtggatgcagactcaggctacaacgcgtggctttcgtatgagctgcagcctgggaccggcggtgcgcgcatcccgtttcgcgtggggctgtacacgggagagatcagcacgacccgtgccctggacgaggtggacgccccgcgccatcgcctactggtgctggtgaaggaccacggtgaaccctcattgaccgccacggccactgtgctggtgtcgctggtggagagtggccaggcacccaaggcctcgtcccaggcgtccgctggcgccacgggcccggaagctgcactggtggatgtcaacgtgtacttgatcgtcgccatctgcgcggtgtccagtctgttggtgctcacactgctgctatatactgctctgcggtgctccgcgccgccaaccgaaggcgactgtgggccgggcaagcccacgctggtgtgctccagcgcggtggggagctggtcatactcgcagcagaggcagcagagggtgtgctctggagaggggttgcccaagaccgacctcatggcttttagccctagccttcctccttgtccaattagccgggatagagaggagaaacaggatgtggacgttgatctctcagccaaagtgagtaatttttatttattctttccaaaatgtctttgtttttcattcctcaatgtttccactcctctggaaatacattaatagttaagtatgaattatgtgattcataattagacttttccagttttgtggttttgtggttaaaacggtaagatttttgttgctaatttttgaaccaaatcagcagtaagttatgatatccacacttgtaattttgttttgttattaggtgcagtagtagaattattttattgctaaatgcctgggtataagacaaatattttttcttagatgaattgcattatttagagaatctgacttcgacttgttttatacttatccctatacaatgcttcttcaatatcttttgccacttttcatttggacttcctactacctgttagtacaaatgttacttgctcattttatgagttcacctaatgcttataactccctattgattatgcttttccaccttcagtttcaaaaattagatcattacacctgttgtcttttatggaacctcttttattctcttattcacttgtttggagtctcaatccttattttttacttgaatatgattcattttaggccttgtgctctaatttggcaataccgtttattgtttcttgatttcccagttgggaaaaaaatcgagaataacaattgcatttagaattgcatctttgttcatctttagtttatcactactttatttaatactactttaataatactactgtattatatgttaaaatttattactaataactaaaatatcaatatgaagtgaaaatttaatagttgtatagtatatttatatattcattttaaaagaatgttttaaatcttgttaaaaataattttcaatctgaacaatatcttgaaaataattatggtatctaattttaaaactatccctactagcaaaactttttattcattagtgtcttttgcataccatactaaggatgctaatatgaaataagtttgataagccaatgttataatgttattactggttaacttctctgaatagcatcctgcctattaatgtgtgccatgcaataagtagaaaactccaaataaccagaaccaaatgaaattgaaggtagacttttttctaatcactacccctacatatttggttatctcctctagcaattagttggactcccatttaagtttccctaccactggagagaaatagtaaccaactgaaacctggttaatactcattgacagtgtgggaggtctaacacgtaaaatagatatttttcttgactcctctccttcccctcacttccattttctttatttccttttttggcactatcctttgttgctcccttgtccatgaagtagtagccatagtgtgtccatctcaggtcagtattttaaaaatttagttctgttatcagcttcttgaatataatagagtcagccaaagtacttgtcttcccagatatggaacttcaatcttcaaatccagcttgcctcttgaaactattgtctaacaagactcttggcaaagacattttgaagactttggaattttcacttcacagatgtactgatgctatgccaaataaatattgaatagctaccaaataaacattgttttctattctgctgcattccccatctgtacattaaaatacctggtaaatgaaaatattacaaatgaaatgggtgaaaatggaattcttcctccttttttccaatgtgcttgatgtcaatgatcattttgtaaaaatatagtttgggtccccacatagtgaaagtactctggtttctgtttgattcagaaatttggtgggttttttgttgttgttttggtttttgtgtgtgtgtgtttgtgtgagtgtagttcttcaatagagagggagcgtaaagctattttcactagattgattttttgtttagacaaacaggatgaaaataactttatggatataggaggcaaggaaagtttttaaatggctaccattatgtctttatatattaaatttctttatgtaagaaaa

SEQ ID NO: 172115 - DNA, 2328 bp, Homo sapiens
  Payload ID: 13818
  Gene Symbol: PCDHA4
  Gene Name: protocadherin alpha 4
  ENST ID: ENST00000378125
  CDS Start-End: 1-2328
gtagtttacagtagagtcggccaggaatcccggcgtctgctgctcttacttcttctcctcgcagcctgggaggcagggaacggtcagctccactactcggtctccgaggaggccaaacacggcaccttcgtgggccgcatcgcgcaggacctgggactggagctggcggagctggtgccgcgcctgttccgggtggcgtccaagggccgcggaggccttctggaggtaaatctgcagaatggcattttgtttgtgaattctcggatcgaccgggaggagctgtgccggcggagcgcggagtgcagcatccacctggaggtgatcgtagacaggccgctgcaggttttccatgtggacgtggaggtgagggacattaacgataacccgccggtgttcccagcaacacaaaagaacctgtccatcgcggaatccaggccgcttgactctcggtttccactagagggcgcctcggatgcagatatcggggagaacgccctgctcacttacagactgagcccaaatgaatacttttctctggaaaaaccacctgatgacgagctggtaaaaggtcttgggcttatattacggaaatctttagacagagaagaagctccggagatttttttagtgctcacagccactgatggaggcaaacccgagttgactggcaccgttcagttactcatcacagtactggatgccaatgacaatgccccagcttttgacagaaccatttataaggtgagattactagaaaatgttcctaatggaacattggtaattaaacttaacgcctcagatttagacgaaggattgaatggggacattgtttattcattctcaaatgatatttcgccaaatgtgaaatccaagtttcacatagatccaattactggacaaattattgtaaagggatatattgactttgaagaaagcaaatcctatgaaattattgtagagggcattgataagggacagctcccactttctggccattgtagagttattgtggaagtagaagacaacaacgataatgtcccagatttggaattcaagtctttatcacttccaattagagaggacgctccactgggtacagtcatcgccctgatcagcgtgtccgacaaagacatgggtgtcaatgggctggtcacctgctccttgacgtcccacgtccccttcaagctggtgtccaccttcaagaattactactcgttggtgctggacagtgccctggaccgcgagagcgtgtcagcctatgagctggtggtgaccgcgcgagacgggggctcgccttcgctgtgggccacggccagtgtttctgtggaggtggctgatgtgaacgacaacgctccggcgttcgcgcagcccgagtacacagtgttcgtgaaggagaacaacccgccgggctgccacatcttcactgtgtctgcgtgggacgcggacgcgcaggagaacgcgctggtgtcctactcgctggtagagcggcgggtaggggagcgcgcgctgtcgagctacgtttcggtgcatgcggagagcggcaaggtgtacgcgctgcagccgctggaccacgaggagctagagctgctgcagtttcaggtgaccgctcgcgatgccggcgtgccacctctgggcagcaacgtgacgctgcaggtgttcgtgctggacgaaaacgacaacgcgccagcactgctagcgcctcgggcgggtggcactggtggcgcagtgagcgagctggtgccatggtcggtgggtgtgggccacgtggtggcaaaggtgcgcgcggtggatgctgactcgggctacaacgcgtggctttcgtacgagctgcagccggggactggtggcgcgcgcatcccgttccgcgtggggctgtacactggcgagatcagcacaacgcgtgccctggacgaaacggacgctccgcgccaccgcctactggtactggtgaaggaccacggcgagcccgcgctgacggccacggccactgtgctggtgtcacttgtggagagtggacaggcgccaaaggcctcctcacgggcgttggtgggcgctgtgggtcccgatgctgcgctggtggatgtcaacgtatacctgatcattgccatctgcgcggtgtccagccttttggtgctcacgctgctgctgtacaccgcgctgcggtgctctgcgctgcccaccgagggcgcgtgcgctccgggcaagcccacgctggtgtgctccagtgcggtggggagctggtcatactcgcagcagaggaggccgagggtgtgctctggtgagggcccacccaagaccgacctcatggccttcagccccagtttacct

SEQ ID NO: 172116 - DNA, 4163 bp, Homo sapiens
  Payload ID: 13818
  Gene Symbol: PCDHA4
  Gene Name: protocadherin alpha 4
  ENST ID: ENST00000512229
  CDS Start-End: 115-2820
actctttggagtctgaaatatggaggatgcagctgcacttgactgaccgattaaaagatttcccttgactttgagaaacgatatttaatcagaacaaaatactgtgcactaaagatggagttttcctggggaagcggccaggaatcccggcgtctgctgctcttacttcttctcctcgcagcctgggaggcagggaacggtcagctccactactcggtctccgaggaggccaaacacggcaccttcgtgggccgcatcgcgcaggacctgggactggagctggcggagctggtgccgcgcctgttccgggtggcgtccaagggccgcggaggccttctggaggtaaatctgcagaatggcattttgtttgtgaattctcggatcgaccgggaggagctgtgccggcggagcgcggagtgcagcatccacctggaggtgatcgtagacaggccgctgcaggttttccatgtggacgtggaggtgagggacattaacgataacccgccggtgttcccagcaacacaaaagaacctgtccatcgcggaatccaggccgcttgactctcggtttccactagagggcgcctcggatgcagatatcggggagaacgccctgctcacttacagactgagcccaaatgaatacttttctctggaaaaaccacctgatgacgagctggtaaaaggtcttgggcttatattacggaaatctttagacagagaagaagctccggagatttttttagtgctcacagccactgatggaggcaaacccgagttgactggcaccgttcagttactcatcacagtactggatgccaatgacaatgccccagcttttgacagaaccatttataaggtgagattactagaaaatgttcctaatggaacattggtaattaaacttaacgcctcagatttagacgaaggattgaatggggacattgtttattcattctcaaatgatatttcgccaaatgtgaaatccaagtttcacatagatccaattactggacaaattattgtaaagggatatattgactttgaagaaagcaaatcctatgaaattattgtagagggcattgataagggacagctcccactttctggccattgtagagttattgtggaagtagaagacaacaacgataatgtcccagatttggaattcaagtctttatcacttccaattagagaggacgctccactgggtacagtcatcgccctgatcagcgtgtccgacaaagacatgggtgtcaatgggctggtcacctgctccttgacgtcccacgtccccttcaagctggtgtccaccttcaagaattactactcgttggtgctggacagtgccctggaccgcgagagcgtgtcagcctatgagctggtggtgaccgcgcgagacgggggctcgccttcgctgtgggccacggccagtgtttctgtggaggtggctgatgtgaacgacaacgctccggcgttcgcgcagcccgagtacacagtgttcgtgaaggagaacaacccgccgggctgccacatcttcactgtgtctgcgtgggacgcggacgcgcaggagaacgcgctggtgtcctactcgctggtagagcggcgggtaggggagcgcgcgctgtcgagctacgtttcggtgcatgcggagagcggcaaggtgtacgcgctgcagccgctggaccacgaggagctagagctgctgcagtttcaggtgaccgctcgcgatgccggcgtgccacctctgggcagcaacgtgacgctgcaggtgttcgtgctggacgaaaacgacaacgcgccagcactgctagcgcctcgggcgggtggcactggtggcgcagtgagcgagctggtgccatggtcggtgggtgtgggccacgtggtggcaaaggtgcgcgcggtggatgctgactcgggctacaacgcgtggctttcgtacgagctgcagccggggactggtggcgcgcgcatcccgttccgcgtggggctgtacactggcgagatcagcacaacgcgtgccctggacgaaacggacgctccgcgccaccgcctactggtactggtgaaggaccacggcgagcccgcgctgacggccacggccactgtgctggtgtcacttgtggagagtggacaggcgccaaaggcctcctcacgggcgttggtgggcgctgtgggtcccgatgctgcgctggtggatgtcaacgtatacctgatcattgccatctgcgcggtgtccagccttttggtgctcacgctgctgctgtacaccgcgctgcggtgctctgcgctgcccaccgagggcgcgtgcgctccgggcaagcccacgctggtgtgctccagtgcggtggggagctggtcatactcgcagcagaggaggccgagggtgtgctctggtgagggcccacccaagaccgacctcatggccttcagccccagtttacctgactctagggacagagaagatcagctgcagacaactgaggaatcctttgcaaagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccgaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatc

SEQ ID NO: 172117 - DNA, 5251 bp, Homo sapiens
  Payload ID: 13818
  Gene Symbol: PCDHA4
  Gene Name: protocadherin alpha 4
  Uniprot ID: Q9UN74
  ENST ID: ENST00000530339
  CDS Start-End: 1-2844
atggagttttcctggggaagcggccaggaatcccggcgtctgctgctcttacttcttctcctcgcagcctgggaggcagggaacggtcagctccactactcggtctccgaggaggccaaacacggcaccttcgtgggccgcatcgcgcaggacctgggactggagctggcggagctggtgccgcgcctgttccgggtggcgtccaagggccgcggaggccttctggaggtaaatctgcagaatggcattttgtttgtgaattctcggatcgaccgggaggagctgtgccggcggagcgcggagtgcagcatccacctggaggtgatcgtagacaggccgctgcaggttttccatgtggacgtggaggtgagggacattaacgataacccgccggtgttcccagcaacacaaaagaacctgtccatcgcggaatccaggccgcttgactctcggtttccactagagggcgcctcggatgcagatatcggggagaacgccctgctcacttacagactgagcccaaatgaatacttttctctggaaaaaccacctgatgacgagctggtaaaaggtcttgggcttatattacggaaatctttagacagagaagaagctccggagatttttttagtgctcacagccactgatggaggcaaacccgagttgactggcaccgttcagttactcatcacagtactggatgccaatgacaatgccccagcttttgacagaaccatttataaggtgagattactagaaaatgttcctaatggaacattggtaattaaacttaacgcctcagatttagacgaaggattgaatggggacattgtttattcattctcaaatgatatttcgccaaatgtgaaatccaagtttcacatagatccaattactggacaaattattgtaaagggatatattgactttgaagaaagcaaatcctatgaaattattgtagagggcattgataagggacagctcccactttctggccattgtagagttattgtggaagtagaagacaacaacgataatgtcccagatttggaattcaagtctttatcacttccaattagagaggacgctccactgggtacagtcatcgccctgatcagcgtgtccgacaaagacatgggtgtcaatgggctggtcacctgctccttgacgtcccacgtccccttcaagctggtgtccaccttcaagaattactactcgttggtgctggacagtgccctggaccgcgagagcgtgtcagcctatgagctggtggtgaccgcgcgagacgggggctcgccttcgctgtgggccacggccagtgtttctgtggaggtggctgatgtgaacgacaacgctccggcgttcgcgcagcccgagtacacagtgttcgtgaaggagaacaacccgccgggctgccacatcttcactgtgtctgcgtgggacgcggacgcgcaggagaacgcgctggtgtcctactcgctggtagagcggcgggtaggggagcgcgcgctgtcgagctacgtttcggtgcatgcggagagcggcaaggtgtacgcgctgcagccgctggaccacgaggagctagagctgctgcagtttcaggtgaccgctcgcgatgccggcgtgccacctctgggcagcaacgtgacgctgcaggtgttcgtgctggacgaaaacgacaacgcgccagcactgctagcgcctcgggcgggtggcactggtggcgcagtgagcgagctggtgccatggtcggtgggtgtgggccacgtggtggcaaaggtgcgcgcggtggatgctgactcgggctacaacgcgtggctttcgtacgagctgcagccggggactggtggcgcgcgcatcccgttccgcgtggggctgtacactggcgagatcagcacaacgcgtgccctggacgaaacggacgctccgcgccaccgcctactggtactggtgaaggaccacggcgagcccgcgctgacggccacggccactgtgctggtgtcacttgtggagagtggacaggcgccaaaggcctcctcacgggcgttggtgggcgctgtgggtcccgatgctgcgctggtggatgtcaacgtatacctgatcattgccatctgcgcggtgtccagccttttggtgctcacgctgctgctgtacaccgcgctgcggtgctctgcgctgcccaccgagggcgcgtgcgctccgggcaagcccacgctggtgtgctccagtgcggtggggagctggtcatactcgcagcagaggaggccgagggtgtgctctggtgagggcccacccaagaccgacctcatggccttcagccccagtttacctgactctagggacagagaagatcagctgcagacaactgaggaatcctttgcaaagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 172118 - DNA, 10557 bp, Homo sapiens
  Payload ID: 13818
  Gene Symbol: PCDHA4
  Gene Name: protocadherin alpha 4
  Uniprot ID: Q9UN74
  ENST ID: ENST00000618834
  CDS Start-End: 152-2548
aaaattccttctattcttactggaaggaaccatatacactctttggagtctgaaatatggaggatgcagctgcacttgactgaccgattaaaagatttcccttgactttgagaaacgatatttaatcagaacaaaatactgtgcactaaagatggagttttcctggggaagcggccaggaatcccggcgtctgctgctcttacttcttctcctcgcagcctgggaggcagggaacggtcagctccactactcggtctccgaggaggccaaacacggcaccttcgtgggccgcatcgcgcaggacctgggactggagctggcggagctggtgccgcgcctgttccgggtggcgtccaagggccgcggaggccttctggaggtaaatctgcagaatggcattttgtttgtgaattctcggatcgaccgggaggagctgtgccggcggagcgcggagtgcagcatccacctggaggtgatcgtagacaggccgctgcaggttttccatgtggacgtggaggtgagggacattaacgataacccgccggtgttcccagcaacacaaaagaacctgtccatcgcggaatccaggccgcttgactctcggtttccactagagggcgcctcggatgcagatatcggggagaacgccctgctcacttacagactgagcccaaatgaatacttttctctggaaaaaccacctgatgacgagctggtaaaaggtcttgggcttatattacggaaatctttagacagagaagaagctccggagatttttttagtgctcacagccactgatggaggcaaacccgagttgactggcaccgttcagttactcatcacagtactggatgccaatgacaatgccccagcttttgacagaaccatttataaggtgagattactagaaaatgttcctaatggaacattggtaattaaacttaacgcctcagatttagacgaaggattgaatggggacattgtttattcattctcaaatgatatttcgccaaatgtgaaatccaagtttcacatagatccaattactggacaaattattgtaaagggatatattgactttgaagaaagcaaatcctatgaaattattgtagagggcattgataagggacagctcccactttctggccattgtagagttattgtggaagtagaagacaacaacgataatgtcccagatttggaattcaagtctttatcacttccaattagagaggacgctccactgggtacagtcatcgccctgatcagcgtgtccgacaaagacatgggtgtcaatgggctggtcacctgctccttgacgtcccacgtccccttcaagctggtgtccaccttcaagaattactactcgttggtgctggacagtgccctggaccgcgagagcgtgtcagcctatgagctggtggtgaccgcgcgagacgggggctcgccttcgctgtgggccacggccagtgtttctgtggaggtggctgatgtgaacgacaacgctccggcgttcgcgcagcccgagtacacagtgttcgtgaaggagaacaacccgccgggctgccacatcttcactgtgtctgcgtgggacgcggacgcgcaggagaacgcgctggtgtcctactcgctggtagagcggcgggtaggggagcgcgcgctgtcgagctacgtttcggtgcatgcggagagcggcaaggtgtacgcgctgcagccgctggaccacgaggagctagagctgctgcagtttcaggtgaccgctcgcgatgccggcgtgccacctctgggcagcaacgtgacgctgcaggtgttcgtgctggacgaaaacgacaacgcgccagcactgctagcgcctcgggcgggtggcactggtggcgcagtgagcgagctggtgccatggtcggtgggtgtgggccacgtggtggcaaaggtgcgcgcggtggatgctgactcgggctacaacgcgtggctttcgtacgagctgcagccggggactggtggcgcgcgcatcccgttccgcgtggggctgtacactggcgagatcagcacaacgcgtgccctggacgaaacggacgctccgcgccaccgcctactggtactggtgaaggaccacggcgagcccgcgctgacggccacggccactgtgctggtgtcacttgtggagagtggacaggcgccaaaggcctcctcacgggcgttggtgggcgctgtgggtcccgatgctgcgctggtggatgtcaacgtatacctgatcattgccatctgcgcggtgtccagccttttggtgctcacgctgctgctgtacaccgcgctgcggtgctctgcgctgcccaccgagggcgcgtgcgctccgggcaagcccacgctggtgtgctccagtgcggtggggagctggtcatactcgcagcagaggaggccgagggtgtgctctggtgagggcccacccaagaccgacctcatggccttcagccccagtttacctgactctagggacagagaagatcagctgcagacaactgaggaatcctttgcaaaggttagtgtataacatccttttgtttaattttcgtattgtttttctctatcaacttcttcgtaaatttatttctaagagtcaaatttccctgggttaaaattttacctctttttacatatccattttaactaaagtcttttggaattataggacatcagagcaatatatattgccttccttcattttatgctgcattattcaatgcatattaacagaactgtaatttctagtaaattttcactatattcaccctctttgtttttggtaataatcaacattttagaaaacattttactattatttaacctattacatataaacaaatgtgcacaggctgaaataataaagctccataaattgtatgaaagtgaaaagctccgttgcctccatcgctgaagcccctcgcatgcacctgccaaatcacttcccttatttttcctccagtgtaaccgcacatttgccttttataactgtttgttcggggcctgttttgggaacgttatctaattggacttgcacaacatgtattgtctgtgcatttgtgtgttatttgtatttatcactcattgtttatgaaattatccatgttgttatatgtagttgtagtttatttatttctgtttctagtactatttcataaatatactataccttatttattctactgttcaggaatttgcattgtgcctcaatgtctatttcaaataatgccatcataaatatattgtacatttctttgatgcccatgtacacagatttctctcaggtttttgcctaagagttgtgtttgtgggtcacagaatatgtgtgtatctttgtcttttgtagctaacaccaaccaattttccaagatgtttttacctgtttacattcctagtagtgcataaggctttctgctgggccacatcatctctacatttgtcaggttattttcatgttagccattttactgggtgacttttgtaatctcattttgaaattattttatatttaaatgaagttgagtacctttctattttattttggcaatttttataccttattttgtgcaatagctgctcaaatctcctatttctctagtctgttgtttttcttttcttttttctcttctttttgcttccatagaactttatttatttccttatcttgtttttcttattacttaaacaaatcttgtattctgaacataactcctttttttagtagttttcaacctcatggctagtttttaattcttttttgtcttttggtgaatagaaagtcataattttgattaaactcaatttatcaatttttgcttctgatcctatttcacaaagataattttctgtggtatcttttatttcattgtttacattacatctacaatccatttggaatatacatatttttatcattgttgtgaggtaggggtcaagatttatttttatttcttcttattatttttattatactttaagttctaggatacatgtgcacaacgtgcaggtttgttacataggtatacatgtgtgccatgttcgtttgctgcacccatcaactcatcatttacattaggtatttctcctaatgctatccctcccccagtcccccacacctcaacaggccccagtgtgtgatgttccccaccctgtgtccaagtgctctcgttgttcaattcccacctatgagtgagaacatgcagtgtttggttttctgtgcttgtgatagtttgctcagaatgacggtttccagcttcatccatgtctctacaaaggacatgaactcacccttttttacggctgcatagtcttccatggtgtatatgtgtcacattttcttaatccggtctatcattgatggacatttgggttggttccaagtctttgctattgtgaatagtgtcgcaataaacatacatgtgcatgtgtctttatagtagcatgatttataatcctttagatatatacccagtaatgggtcaaatggtatttctagttccagatccttgaggaatcgccacactgtcttccacaatggttgaactagtttacactcccaccaacggtgtaaaagcgttactatttctccacatcctctccagcatgtgttgtttcctgactttttaatgattgccattctaactggtgtgagatggtatctcattgtggttttgatttgcatttctctgatgaccagtgatgatgggcattttttcatgtgtctgttggctgcataaatgtcttcttttgagaagtgtctgttcatatcctttgcccactttttgatagggttttttgtttttttcttgtaaatgtgtttaggttctttgtagattctggatattagccctttgtcagatgggtagattgcaaaaattttctcccattctgtaggttgcctgttcactctgattgtagtttcttttgaagatttattttttactaccatttttttgttggacttttaaaatgagtttggaagtgttccctctccttcaattttttttttttggaagagtttgaaaacaattatcattgattcttctttaaaagtttggtagaattctccaggaaagatatctggttttgggcttttgttgttgttgttgttaggaggtttggattactgattcaatctccttactagttacagctttgtttagattttttatgattatgtcttggtagtttgtatgtttctaggaattaatcaatttcttctaggttattgaattttttggtatatgattttaaaagcctcttataattgtggcatcaggtgtaatgccacctcttttgtttctgacttccagtctttttgtttttttcttagtctagctaaggggcttgtcagttttgttgttttttcaaaaaatcaactaagtttaaaaacttaatttaaactttttttcatttatttttgctctaatctttattatagtatttcctccctttgctttgggcttcctcatttgtcctttttttctagttccttgagttgttaagttttttatttgagatctttcttctttcttcatttttagtgtaggcatttacaactcccttctttgtttttgttttcatgtttaagagacaagatctcactatgatgtacagaggcacgatcatagctccctgcaagtgatccttgtgccttggattcccaaagcactgggattacaggcgtgagccactgagcttgcccagcttaatattccttcttagtactgcttttgttgtatcctgtaagtttttattgtgttgtgttttcatttttgtttatcttaacatattttctaattcatcttttgatttcccctttcattcaaatgaaattttgaacagaatttcgttcaaaattctgttgtttaatttctacatatttgcagattttccagttttaattccagtattgatttctagttttattccactgtggtcagaaaagatatttagtaggatttcaaccttcttgaatttgttaagacttgttttgtgacctgacgtgtgatttatcctggaaaatgctctgagtgtgcttgagaagactgtatatttgctgctgttgggtggaattttctgtatatgtctgttagttccatttcagctatagtgttgttcaagtcctctgcttccttgctgattttctgtctgaatgttctattccttattgaaagtaggataccaaaatctcctactacagtcattggagatacattctgagaattgtatcattctgagatttcatcactgtgcaaacatgagagtgtacttacatatttacacaaacctagatagtatagcctactacagacctaggttacatgatctattgcttctaggctacaaacctgtacatatgttaactgtactgaatactatagggaattgtaacacaatggtaagtatttgtatacctaaatatatctaaacatctaaaaggtacagtaaaaacattgtacagatttttaaaatggtacacctgaatagggtacttaccctatgaatggagactgcggggctggaaatttatctgcatgagtcaatgagtgaatggtgagtgaatgtgaaggcccaggacattactgtgcactaatgtagactttaaagcactatacatttaggctacactcaatttatcaaaaaattttctttttacaggctggtcatggtggctcatgcctgtaatcccagcactttgggaggctgaggaaggaggatcacttaagcccaggagttcaagaccagcctgggcaatatagtgagaccctgtctctagaaaataatttttaaaaattagctaggtgtggtgacacacacttgtagttccagctactcaggaggctgaagtgggaggatccttgacttgaggaggtcaaggctacagtgagctatggtcgtgccactgcactccagcctgagcaacagagtgagactctgtctcaattttttttctttcttcagtaataaattaaccttagcttactgtaacttttcaactttgtaaacttaaattttttaaccttttgactcttttgtaataacgcttagcttaaaacacaaacacattgtacagctgtacaaaaatattttctctttatatccttattttacaagtttttttgacttttaatttttttatttttttcacttttacttagtgtttttttttgttgttgttgttaaaaatgaagatataaacacccatactagcctaggactgtattgggtcaggatcatcaatatcattgtcttccacctccatatcttgtcccactggaaggtcttctggggcagttacacatgcgatgctatcatctcctatgataacaatatcttctagtggaatacttcccaaaagactttcctgaggctgttttgtggtgaccttttttcttttttttttttgagttaatgtattttttataagtagaaagagtacactgtaaaataccactaaaaagtatagtaaatacataaagcagtaacatttactatctgtatcaagtattatgtactgtaaattactgtacataattgtatgtgctatcttgtacttttatataactggtagtgcaataggtttgtttacaccaacatcaccacaaacatgtgagtaatgtgctacaacattatgactgctacatcatcactaggtgataggaatttttcagctccattataatcttatgggactactcttgtacatgtggtctgttattggttgaaacgttgttatacaacacttgactttattgtattgctatctatttctccatttctgtgaatgtttgcctcatatatttaggtgttttaatgttgggtgcatatgtatttataattgctatgtccttctggtgaattgaccttttatcattatataatgtccttctttgtctcttatgacactttttgacttaaagactattttgtgtgatgtagctgtttccacatttgcactcttttggttacaatttgcatgaaatttttttaatatcctttaactttcaggctatccaggtctttaaatctaaagcaaatctcttgtagttagcatataattgggtctttaaaaaaaatcaattcaaccactttgtatcttttgattgggggagtttatcccatttttatttaaagtaattattgatagggcataacttactgttgcctctttgttaattgttgtttgcagcttgtagactttttgctcctctttcctcctcttactgtcttcctttgtgttttattgagaattgtaatgctatgtttttgttcctttcctgttttcttttgtatatcttccataggtattttctttgtggttaccatggggcttacattttaaaactcttataaaaatgtattttaaactgatagcatctttactacaatcacaaaacaaaactcattatgtttacttctcccctacccaaattttatgttattgatgtcataaatacatctttttatattgtgtatacattattttatagttagtttttctgtacttttgtcttttaatcagattttaaaatatcagattttaaagtgacttttgtaccaccattacagtattatagtattctgtttttatctatatatttatctttactagtgagctttatactttaataaaatacctatgtatttctgtttagcatcccctaattttaactcaaaaggccccctcttaacatttcttgtaaggcaagtctaattgtgatcaccttcagcttttgtttaactgggaaggtctttatctctttttcatttttgaagacaaactttggtggatttggtattcttggctggcagttctttttcttttcagcactttcagtataacatctcacccctttctggatggcaaggtttctactgagaaatctactggtagagttaggggtgttcttttgtacgtgatgaggcatttttcttttgctgctttctaaattcttaacatttcttggatcttgatgtccatttccttcctcatatttgggaagttttcagatgtaattttaaaaaataagctgtctgtccttttctcttatggcttcttcttttgaaactgtcataatgagtagagcagcctgctcgaggatgtcctatcaatttcttaggctttctttactctctttcatttcttgctctttttgctactctgtctggataatttcaaatgatgtgtccttgagttcactgactcattcttctacttgattaagtctgctgttgaacatgtctgtaaaattttcagttcaattattgtattcttcagttccaaaatttctttttagttcttttgaatattttctatctgctgaaattctgattctgcttatgcattattttcctgagctcactgaacatctttatgacaattattttgaatactttgtcaagtaattcacatagctctatttctttaggtttggtttctggaggtgtgtttgtgtgtgtgtgtgtgtgtgtgtgtgggcacgcactatttgattgggccatgtttcctgttttctcatattccttattactttgtgttgatatctatacatttcaaaaaaacaaaaaacaacaacacaccagctacctcttccagtctttatggactggatttgtacatggaaagatctttactaatcaggctggctagagattctagggacctctcaaaccttttctgtggatgcatcttctatggacttgtgtgtataattcctaattagagggatctgccagcttttttttttaagatgctctaatctttttccctctgtggtgtctgtgtgctgtactgtgggccctctggagcagcagtattcactcagctcttttaggttctgagaagccctcagttatagattctgctgaatcctatcagtgcctggagtcaagtgagacagaaacttggactgcccactaaaattcaggaactttggatgcattttactctctctttccctcatgagagagagagtgctgagctgagtttctctctgtgtgctgtatcacaggtcctgaggagcatcagcccgccacccagctctttattattctgagctgccctcaggattttagaatatgccaggttccatcagtgctctgagatatgcaagacagctcccctgaaaagtcagaacactgaatgcatgctttactttctctttcccttctcagggagaagacaggagctgggaatttccccctgtttgaatggaactgtgctgctggatgggactatagggaaagtgccccagaaaagtgcccagctagttttacacttgcttggagcccaggaccctcttaactggtttcggcacttatcaccatgggaattggtccttgtattgttgttgagttggtatacctgtggagggtctggggattcctataacagcatcttgctgatgtcactacctctgttatctttttaagctatatatgcttttacaaattattttattgatttcctcttttgttgattataacacacatccttgacttattacctcaattaaatcaataattttaataattcca

SEQ ID NO: 172119 - DNA, 4157 bp, Homo sapiens
  Payload ID: 13819
  Gene Symbol: PCDHA5
  Gene Name: protocadherin alpha 5
  Uniprot ID: Q9Y5H7
  ENST ID: ENST00000529619
  CDS Start-End: 140-2812
aagaaccttccatttttggctgtgccaagaagctcagaaaggcgataatataaaaaatatatagttaattgggaattgaatttacaaaatacattgtgtggtgatgcaatagaaagctcataattggaacgagattgagatggtatattcccggagaggaagtctgggatcccggctcctgctgctctggcttctccttgcctactggaaggcagggagcggccagctccactactcgatcccggaggaagccaaacacggaaccttcgttggccgcatcgcgcaggacctagggctggagctggcggagctggtgccgcgcctgttccgggtggcgtccaagggccgcggggaccttctggaggtaaatctgcagaatggcattttgtttgtgaattctcggatcgaccgggaggagctgtgccggcggagggcggagtgcagcatccacctggaggtgatcgtggacaggccgctgcaggttttccatgtggaggtggcagtgaaggacatcaatgacaatccgcccaggttctccagacaagaacaaagattattcattttagagtcaagaatgccagattcgcggtttccgctagagggcgcgtcggatttggatattggagcaaatgcacaattgagatacaggttaaatccaaacgaatattttgacttagatgttaaaacaaatgaagaagaaacgaactttttagagctggttttgaggaaatccttagatagagaagaaacacaagaacaccgtttattagtgattgcaactgatggaggaaaacccgaactaacaggtacagttcagttgttgatcaatgtattggatgctaatgataacgccccagaatttgataaatccatttataatgtcagattgttggaaaatgcaccaagtgggacattagttattaaactgaacgcctcagatgcagatgagggcatcaataaggaaatagtgtatttctttagtaatcttgttcttgacgatgtaaagtccaaatttataattaattctaatactggtgaaataaaagttaacggggaactggattatgaagactataactcatatgaaattaatattgatgccatggataaaagtacattcccattatcaggacactgtaaagtagtagtgaaactcctggatgtgaatgataataccccagagatggccataaccacccttttcctgcctgtcaaagaggacgctccactcagcacggtcattgctctgatcagcgtgtctgaccgtgactcaggtgccaacgggcaggtgacctgctccctaatgccccacgttcccttcaagctggtgtccaccttcaagaattactactcgttggtgctggacagcgccctggaccgcgagagcgtgtcggtctatgagctggtggtgaccgcgcgggacgggggctcgccttcgctgtgggccaccgccagcgtgtctgtggaagtggccgacgtgaacgacaacgctccggcgttcgcgcagccccagtataccgtgttcgtgaaggagaacaacccgccaggctgccacatcttcacggtgtctgcacgggacgcggacgcgcaggagaacgccctggtgtcctactcgctggtggagcggcgggtgggcgagcgcccgctgtcgagttacgtttcggtgcacgcggagagcggcaaggtgtacgcgctgcagccgctggaccacgaggaagtggagctgctgcagttccaggtgagcgcgcgcgacgcgggcgtgccgcctctgggcagcaacgtgacgctgcaggtgttcgtgctggacgagaacgacaacgcgccggcgctgctggtgcctcgagtgggtggcaccggcggcgcagtgagcgagctggtgccgaggtcagtgggtgcgggccacgtggtggcgaaggtgcgcgcagtggaccctgattcgggctacaacgcttggctttcgtatgagctgcagccagcgcctggcagtgcgcgcatcccgttccgcgtggggctgtacacaggcgagatcagcacaacacgctctctggatgagaccgaagcaccgcgccaccgccttctggtgctggtgaaggaccatggagagcccccgctgacagccacagccacagtgctggtgtcgctggtggaaagtggccaggcgccgaaggcctcatcgcgggcgtcggcgggcgctgtgggtcccgaggctgccctggtggatgtcaacgtgtacctgatcatcgccatctgtgcggtgtccagcctgctggtgctcacgctgctgctgtacaccgcgctgcggtgctcggcgcagcccaccgaggccgtgtgcacacggggcaagcccactctgttgtgctccagcgcggtggggagctggtcgtactcgcagcagaggagacagagggtgtgctctggggaagctccacccaaaacagacctcatggccttcagtccaagccttcctcagggtcccacctctacagacaacccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccgaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaa

SEQ ID NO: 172120 - DNA, 5218 bp, Homo sapiens
  Payload ID: 13819
  Gene Symbol: PCDHA5
  Gene Name: protocadherin alpha 5
  Uniprot ID: Q9Y5H7
  ENST ID: ENST00000529859
  CDS Start-End: 1-2811
atggtatattcccggagaggaagtctgggatcccggctcctgctgctctggcttctccttgcctactggaaggcagggagcggccagctccactactcgatcccggaggaagccaaacacggaaccttcgttggccgcatcgcgcaggacctagggctggagctggcggagctggtgccgcgcctgttccgggtggcgtccaagggccgcggggaccttctggaggtaaatctgcagaatggcattttgtttgtgaattctcggatcgaccgggaggagctgtgccggcggagggcggagtgcagcatccacctggaggtgatcgtggacaggccgctgcaggttttccatgtggaggtggcagtgaaggacatcaatgacaatccgcccaggttctccagacaagaacaaagattattcattttagagtcaagaatgccagattcgcggtttccgctagagggcgcgtcggatttggatattggagcaaatgcacaattgagatacaggttaaatccaaacgaatattttgacttagatgttaaaacaaatgaagaagaaacgaactttttagagctggttttgaggaaatccttagatagagaagaaacacaagaacaccgtttattagtgattgcaactgatggaggaaaacccgaactaacaggtacagttcagttgttgatcaatgtattggatgctaatgataacgccccagaatttgataaatccatttataatgtcagattgttggaaaatgcaccaagtgggacattagttattaaactgaacgcctcagatgcagatgagggcatcaataaggaaatagtgtatttctttagtaatcttgttcttgacgatgtaaagtccaaatttataattaattctaatactggtgaaataaaagttaacggggaactggattatgaagactataactcatatgaaattaatattgatgccatggataaaagtacattcccattatcaggacactgtaaagtagtagtgaaactcctggatgtgaatgataataccccagagatggccataaccacccttttcctgcctgtcaaagaggacgctccactcagcacggtcattgctctgatcagcgtgtctgaccgtgactcaggtgccaacgggcaggtgacctgctccctaatgccccacgttcccttcaagctggtgtccaccttcaagaattactactcgttggtgctggacagcgccctggaccgcgagagcgtgtcggtctatgagctggtggtgaccgcgcgggacgggggctcgccttcgctgtgggccaccgccagcgtgtctgtggaagtggccgacgtgaacgacaacgctccggcgttcgcgcagccccagtataccgtgttcgtgaaggagaacaacccgccaggctgccacatcttcacggtgtctgcacgggacgcggacgcgcaggagaacgccctggtgtcctactcgctggtggagcggcgggtgggcgagcgcccgctgtcgagttacgtttcggtgcacgcggagagcggcaaggtgtacgcgctgcagccgctggaccacgaggaagtggagctgctgcagttccaggtgagcgcgcgcgacgcgggcgtgccgcctctgggcagcaacgtgacgctgcaggtgttcgtgctggacgagaacgacaacgcgccggcgctgctggtgcctcgagtgggtggcaccggcggcgcagtgagcgagctggtgccgaggtcagtgggtgcgggccacgtggtggcgaaggtgcgcgcagtggaccctgattcgggctacaacgcttggctttcgtatgagctgcagccagcgcctggcagtgcgcgcatcccgttccgcgtggggctgtacacaggcgagatcagcacaacacgctctctggatgagaccgaagcaccgcgccaccgccttctggtgctggtgaaggaccatggagagcccccgctgacagccacagccacagtgctggtgtcgctggtggaaagtggccaggcgccgaaggcctcatcgcgggcgtcggcgggcgctgtgggtcccgaggctgccctggtggatgtcaacgtgtacctgatcatcgccatctgtgcggtgtccagcctgctggtgctcacgctgctgctgtacaccgcgctgcggtgctcggcgcagcccaccgaggccgtgtgcacacggggcaagcccactctgttgtgctccagcgcggtggggagctggtcgtactcgcagcagaggagacagagggtgtgctctggggaagctccacccaaaacagacctcatggccttcagtccaagccttcctcagggtcccacctctacagacaacccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 172121 - DNA, 4248 bp, Homo sapiens
  Payload ID: 13819
  Gene Symbol: PCDHA5
  Gene Name: protocadherin alpha 5
  Uniprot ID: Q9Y5H7
  ENST ID: ENST00000614258
  CDS Start-End: 173-2623
acagtgagtagattttccttagacagaaaggaaaagaaccttccatttttggctgtgccaagaagctcagaaaggcgataatataaaaaatatatagttaattgggaattgaatttacaaaatacattgtgtggtgatgcaatagaaagctcataattggaacgagattgagatggtatattcccggagaggaagtctgggatcccggctcctgctgctctggcttctccttgcctactggaaggcagggagcggccagctccactactcgatcccggaggaagccaaacacggaaccttcgttggccgcatcgcgcaggacctagggctggagctggcggagctggtgccgcgcctgttccgggtggcgtccaagggccgcggggaccttctggaggtaaatctgcagaatggcattttgtttgtgaattctcggatcgaccgggaggagctgtgccggcggagggcggagtgcagcatccacctggaggtgatcgtggacaggccgctgcaggttttccatgtggaggtggcagtgaaggacatcaatgacaatccgcccaggttctccagacaagaacaaagattattcattttagagtcaagaatgccagattcgcggtttccgctagagggcgcgtcggatttggatattggagcaaatgcacaattgagatacaggttaaatccaaacgaatattttgacttagatgttaaaacaaatgaagaagaaacgaactttttagagctggttttgaggaaatccttagatagagaagaaacacaagaacaccgtttattagtgattgcaactgatggaggaaaacccgaactaacaggtacagttcagttgttgatcaatgtattggatgctaatgataacgccccagaatttgataaatccatttataatgtcagattgttggaaaatgcaccaagtgggacattagttattaaactgaacgcctcagatgcagatgagggcatcaataaggaaatagtgtatttctttagtaatcttgttcttgacgatgtaaagtccaaatttataattaattctaatactggtgaaataaaagttaacggggaactggattatgaagactataactcatatgaaattaatattgatgccatggataaaagtacattcccattatcaggacactgtaaagtagtagtgaaactcctggatgtgaatgataataccccagagatggccataaccacccttttcctgcctgtcaaagaggacgctccactcagcacggtcattgctctgatcagcgtgtctgaccgtgactcaggtgccaacgggcaggtgacctgctccctaatgccccacgttcccttcaagctggtgtccaccttcaagaattactactcgttggtgctggacagcgccctggaccgcgagagcgtgtcggtctatgagctggtggtgaccgcgcgggacgggggctcgccttcgctgtgggccaccgccagcgtgtctgtggaagtggccgacgtgaacgacaacgctccggcgttcgcgcagccccagtataccgtgttcgtgaaggagaacaacccgccaggctgccacatcttcacggtgtctgcacgggacgcggacgcgcaggagaacgccctggtgtcctactcgctggtggagcggcgggtgggcgagcgcccgctgtcgagttacgtttcggtgcacgcggagagcggcaaggtgtacgcgctgcagccgctggaccacgaggaagtggagctgctgcagttccaggtgagcgcgcgcgacgcgggcgtgccgcctctgggcagcaacgtgacgctgcaggtgttcgtgctggacgagaacgacaacgcgccggcgctgctggtgcctcgagtgggtggcaccggcggcgcagtgagcgagctggtgccgaggtcagtgggtgcgggccacgtggtggcgaaggtgcgcgcagtggaccctgattcgggctacaacgcttggctttcgtatgagctgcagccagcgcctggcagtgcgcgcatcccgttccgcgtggggctgtacacaggcgagatcagcacaacacgctctctggatgagaccgaagcaccgcgccaccgccttctggtgctggtgaaggaccatggagagcccccgctgacagccacagccacagtgctggtgtcgctggtggaaagtggccaggcgccgaaggcctcatcgcgggcgtcggcgggcgctgtgggtcccgaggctgccctggtggatgtcaacgtgtacctgatcatcgccatctgtgcggtgtccagcctgctggtgctcacgctgctgctgtacaccgcgctgcggtgctcggcgcagcccaccgaggccgtgtgcacacggggcaagcccactctgttgtgctccagcgcggtggggagctggtcgtactcgcagcagaggagacagagggtgtgctctggggaagctccacccaaaacagacctcatggccttcagtccaagccttcctcagggtcccacctctacagacaacgtgagttttctaatattaacatccatctttccctcccaattttcaaatattaaatgtcacattcacccactttttttgtatttaaaaattatgtcttagtacacaaatattgtggtacacaattattgcactaattcatgtattatatgctttttatgaggcttttctgctggggtaatagattcatcagctttctgtgatattaagtgtttttaaaataatattttatattagcatttgaattttgcatctctaaaaatgtaggataataattgtaagacatagtttggagtcattctcaaagtttcagtttatgactacatgaaaatttattttattttattgttattttttagagaccctttgttgcttagtctgcagtgatctgatcatagctcaccgaagcctgaaactcctgggctcaagtgatcctcctatctcagccgcccaagtagctggactacatgcacatgctaattaaagttttttttttttttttttttttattttctgtagagataggggtcttgctactttgcccaggctggtcttgaactcctggtttgaagccatgctcccgtctcagcctcccgaagtactaagattacaggattgagcaagagtgcctggcctataaaaatgttttaacaccacccttccaattttgcctttttgtttctattgaatttaaattaattattattttattacactaatttagtttgttttcaattgtatttttgcagcatatggtttatttcaactttgcctaagcagttcacctgtatacccatgatgaatttgataattgtaatttaaaaattatatttttcattttattgattttttgaataggaaacacatatacatggtttactgttctaaaggtgcaaaagaatacagttaaattttccctttcacctccttcatgaagccaaaacattctctggtatccttctagagatttttttcatatacaaataaacttccctacccccttaaaaaacatatgagtattgattttaatcttgcttttttcatttactaatgtatcttgatgatcatgaattatcattactgaagtagatttgtttttcttttatctggatctatggtgttccattgtgtaggtatgtgattggttatttttcccttaacattaacatttagtggaacaatgatttaattttctggaaatttgcatatttttcaatatatctaatatatattagatatataaatatctaaaatatctaatatatatctaatatattatatattttatataatatatataataaatatataataataatatatatcagatattttgatacagaattttgctcttgttgcccaaacgagtgcaatggtacaatcttggcctcccaggttcaagcgattctcctgccttatcttcccaagtagctgggattacaggcatgtgcccacacctggctaattttttgtatttactagagacggggtttcaccatgttggtcatggtggtctcgaactcctaatctcaggtgatttacccgcctcggcctcccaaagtgctgggattgcaggcatgagccatcgcgcctggcctaaattattatattgatgaggagtaactgtgaatctcctcagttgtgcaaattctactatattttggttgggaaattttactgcttgttgttacttttagattaaaaaaataaatataccatgatacaaa

SEQ ID NO: 172122 - DNA, 3267 bp, Homo sapiens
  Payload ID: 13820
  Gene Symbol: PCDHA6
  Gene Name: protocadherin alpha 6
  Uniprot ID: Q9UN73
  ENST ID: ENST00000378126
  CDS Start-End: 135-2546
ctattactgcatcattccctgactgttgaatgatggcggacgcagaagaaatggattaataaattccggaacatacagtattttatctttatgcggaagatcttctaatggaaataaaaccagaggtatttgacatggtgtttaccccggaggatagattgggaaagcaatgtctgctcctcccgcttctgctcctcgcagcctggaaggtggggagcggccagctccactactccgtacccgaggaggccaaacacggcaccttcgtgggccggatcgcgcaggacctggggctggagctggcggagctggtgccgcgcctgttcaggatggcctccaaagaccgcgaggaccttctggaggtaaatctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgagggacattaacgacaacccgcccttgttcccggtagaggaacaaagagtgctgatttacgaatctaggctgccagattctgtgtttccactggagggcgcgtccgatgcagatgttggctcaaattccatcttaacctataaactcagttctagcgaatacttcgggctagatgtgaaaataaacagtgatgacaataaacaaattgggctcttattaaagaaatccttggacagagaggaagctcctgcacacaacttattcctgacagccacagatgggggcaaacctgagctcacaggcactgttcagctgctggtcacagtgctggatgtgaatgataatgctcccactttcgaacagtctgaatacgaagtaagaatattcgaaaatgcagacaacggaacaacagttatcagactgaatgcttctgatcgggatgaaggagcgaatggggcaatttcatattcttttaatagccttgttgcagccatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgaactgctcgctgacgcctcacgtccctttcaagctggtgtccaccttcaagaattactactcgttggtgctggacagtgccctggaccgcgagagcgtgtcggcctatgagttggtggtaaccgcgcgggacgggggctcgccttcgctgtgggccaccgccagcttgtctgtggaggtggccgacatgaatgacaatgctccggcgttcgcgcagcccgagtacacagtgttcgtgaaggagaacaacccgccgggctgccacatcttcacggtgtctgcgcgagacgcggacgcgcaggagaacgcgctggtgtcctactcgctggtggagcggcgggtgggcgagcgcgcgttgtcgagctacatttcggtgcacgcggagagcggcaaggtgtacgcgctgcagccgctggaccacgaggagctagagctgctgcagtttcaggtgagcgcgcgcgacgcgggcgtgccgcctctgggcagcaacgtgacgctgcaggtgttcgtgctggacgagaacgacaacgcgccggcgctgctggcgcctcgggtgggtggtactggtggtgcagtgagcgagctggtgccgcggtcactgggtgcaggccaagtggtggcgaaggtgcgcgcagttgacgccgactcaggctacaacgcgtggctttcgtatgagctgcagcccccggcaagcagcgctcgcttcccgtttcgcgtggggctgtacacgggcgagatcagcaccactcgtgtcctggacgaagcggactctccgcgccaccggctgctggtgctggtgaaagaccacggtgagccggcgctgacagcgacggccacggttctggtgtcgctggtggagagtggccaggctccaaaggcgtcatcacgggcgtcggtgggcgccgcgggcccagaggcggcgctggtggatgtcaacgtgtacctgatcatcgccatctgcgcggtatccagcctgctggtcctcacgctactgctgtacacagcgctgcggtgctcggcgccacccaccgagggcgcgtgcacggcggacaagcccacgctggtgtgctccagcgcagtggggagctggtcgtactcgcagcagaggcggcagagggtgtgctccggggagggcccacccaagatggatctcatggcctttagccccagcctttcaccttgtcctattatgatgggtaaggcggagaatcaggatttaaatgaagatcatgatgccaaagtaagtgaattttcataattaacagttaatttttattttaaatttataattgttttcctcatatttgtcttctatatttctgtttttaatttttaattaattttacaaaattacatattttcattttattgtgtttcttattttaatctctttgcttctttaatattcataatttaagtgaaattagaaatcactgtccacaatctgcacctcagaatttttgtcttcaaaccaaaatattcttggatatgtcgttttctgttgcattttaattcagaatcatagtagcatttttttctgattaattatatgggattttcatttgtttgcctttgagctttaggataatttttttacatatactcttttttgatcatatattgaaatttgagcaccagtgtatcacttatgtttttacactttccatttcaatgtttttctgtcgacacttttattaagctaacgctttgattttatccattttgtgtaagaactctgatcatcatagtttttatctgtggttcccttttcagacttgtgattccgggaggcaatagtgttcatttattgtcccccttttaaaccattgaggaataaaggacaaaaacaatagttatcagcctgaatacttctggttgttatggttattgatttatttactaccgatctaaataatggaaaaatagtgattcaacagaatttagaccttgtgatcaagtaaatttatatgaaaactgca

SEQ ID NO: 172123 - DNA, 5374 bp, Homo sapiens
  Payload ID: 13820
  Gene Symbol: PCDHA6
  Gene Name: protocadherin alpha 6
  Uniprot ID: Q9UN73
  ENST ID: ENST00000529310
  CDS Start-End: 115-2967
gactgttgaatgatggcggacgcagaagaaatggattaataaattccggaacatacagtattttatctttatgcggaagatcttctaatggaaataaaaccagaggtatttgacatggtgtttaccccggaggatagattgggaaagcaatgtctgctcctcccgcttctgctcctcgcagcctggaaggtggggagcggccagctccactactccgtacccgaggaggccaaacacggcaccttcgtgggccggatcgcgcaggacctggggctggagctggcggagctggtgccgcgcctgttcaggatggcctccaaagaccgcgaggaccttctggaggtaaatctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgagggacattaacgacaacccgcccttgttcccggtagaggaacaaagagtgctgatttacgaatctaggctgccagattctgtgtttccactggagggcgcgtccgatgcagatgttggctcaaattccatcttaacctataaactcagttctagcgaatacttcgggctagatgtgaaaataaacagtgatgacaataaacaaattgggctcttattaaagaaatccttggacagagaggaagctcctgcacacaacttattcctgacagccacagatgggggcaaacctgagctcacaggcactgttcagctgctggtcacagtgctggatgtgaatgataatgctcccactttcgaacagtctgaatacgaagtaagaatattcgaaaatgcagacaacggaacaacagttatcagactgaatgcttctgatcgggatgaaggagcgaatggggcaatttcatattcttttaatagccttgttgcagccatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgaactgctcgctgacgcctcacgtccctttcaagctggtgtccaccttcaagaattactactcgttggtgctggacagtgccctggaccgcgagagcgtgtcggcctatgagttggtggtaaccgcgcgggacgggggctcgccttcgctgtgggccaccgccagcttgtctgtggaggtggccgacatgaatgacaatgctccggcgttcgcgcagcccgagtacacagtgttcgtgaaggagaacaacccgccgggctgccacatcttcacggtgtctgcgcgagacgcggacgcgcaggagaacgcgctggtgtcctactcgctggtggagcggcgggtgggcgagcgcgcgttgtcgagctacatttcggtgcacgcggagagcggcaaggtgtacgcgctgcagccgctggaccacgaggagctagagctgctgcagtttcaggtgagcgcgcgcgacgcgggcgtgccgcctctgggcagcaacgtgacgctgcaggtgttcgtgctggacgagaacgacaacgcgccggcgctgctggcgcctcgggtgggtggtactggtggtgcagtgagcgagctggtgccgcggtcactgggtgcaggccaagtggtggcgaaggtgcgcgcagttgacgccgactcaggctacaacgcgtggctttcgtatgagctgcagcccccggcaagcagcgctcgcttcccgtttcgcgtggggctgtacacgggcgagatcagcaccactcgtgtcctggacgaagcggactctccgcgccaccggctgctggtgctggtgaaagaccacggtgagccggcgctgacagcgacggccacggttctggtgtcgctggtggagagtggccaggctccaaaggcgtcatcacgggcgtcggtgggcgccgcgggcccagaggcggcgctggtggatgtcaacgtgtacctgatcatcgccatctgcgcggtatccagcctgctggtcctcacgctactgctgtacacagcgctgcggtgctcggcgccacccaccgagggcgcgtgcacggcggacaagcccacgctggtgtgctccagcgcagtggggagctggtcgtactcgcagcagaggcggcagagggtgtgctccggggagggcccacccaagatggatctcatggcctttagccccagcctttcaccttgtcctattatgatgggtaaggcggagaatcaggatttaaatgaagatcatgatgccaaaccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 172124 - DNA, 2231 bp, Homo sapiens
  Payload ID: 13820
  Gene Symbol: PCDHA6
  Gene Name: protocadherin alpha 6
  Uniprot ID: Q9UN73
  ENST ID: ENST00000527624
  CDS Start-End: 28-2088
atggaaataaaaccagaggtatttgacatggtgtttaccccggaggatagattgggaaagcaatgtctgctcctcccgcttctgctcctcgcagcctggaaggtggggagcggccagctccactactccgtacccgaggaggccaaacacggcaccttcgtgggccggatcgcgcaggacctggggctggagctggcggagctggtgccgcgcctgttcaggatggcctccaaagaccgcgaggaccttctggaggtaaatctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgagggacattaacgacaacccgcccttgttcccggtagaggaacaaagagtgctgatttacgaatctaggctgccagattctgtgtttccactggagggcgcgtccgatgcagatgttggctcaaattccatcttaacctataaactcagttctagcgaatacttcgggctagatgtgaaaataaacagtgatgacaataaacaaattgggctcttattaaagaaatccttggacagagaggaagctcctgcacacaacttattcctgacagccacagatgggggcaaacctgagctcacaggcactgttcagctgctggtcacagtgctggatgtgaatgataatgctcccactttcgaacagtctgaatacgaagtaagaatattcgaaaatgcagacaacggaacaacagttatcagactgaatgcttctgatcgggatgaaggagcgaatggggcaatttcatattcttttaatagccttgttgcagccatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgaactgctcgctgacgcctcacgtccctttcaagctggtgtccaccttcaagaattactactcgttggtgctggacagtgccctggaccgcgagagcgtgtcggcctatgagttggtggtaaccgcgcgggacgggggctcgccttcgctgtgggccaccgccagcttgtctgtggaggtggccgacatgaatgacaatgctccggcgttcgcgcagcccgagtacacagtgttcgtgaaggagaacaacccgccgggctgccacatcttcacggtgtctgcgcgagacgcggacgcgcaggagaacgcgctggtgtcctactcgctggtggagcggcgggtgggcgagcgcgcgttgtcgagctacatttcggtgcacgcggagagcggcaaggtgtacgcgctgcagccgctggaccacgaggagctagagctgctgcagtttcagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctg

SEQ ID NO: 172125 - DNA, 2922 bp, Homo sapiens
  Payload ID: 13821
  Gene Symbol: PCDHA7
  Gene Name: protocadherin alpha 7
  Uniprot ID: Q9UN72
  ENST ID: ENST00000356878
  CDS Start-End: 137-2506
aaagacgctccactctctttcactctttggatgcacaacaatggccacacatcgagattgaaatgaagggataaaaacattcctataaattcgaaggcaagttttgctgactagaaaaacaagccaataatttgaaatggtgtgcccgaatggatacgacccagggggccgacatctactgctgtttattataattctagcagcttgggaggcagggagaggccagctccactactcggtccccgaggaggctaaacatggcaacttcgtgggccgcatcgcgcaggacctggggctggagctggcggagctggtgccgcgcctgttccgggcggtgtgcaaattccgtggggatcttctggaggtaaatctgcagaatggcattttgtttgtgaattctcggatcgaccgcgaggagctgtgcgggcggagcgcggagtgcagcatccacctggaggtgatcgtggaaaggccgctgcaggttttccatgtggacgtggaggtgaaggacattaacgacaaccctccggtgttcccagcgacacaaaggaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacagttcttgtggaagttgtggatgtaaatgacaatgctccacagttgactctcacttccctgtctctccctattccagaggacgcccaaccaggtaccgtcatcacattgattagcgtgtttgaccgagattttggagtcaacggacaggttacctgctccctgacgccccgcgttcccttcaagttggtgtccaccttcaagaattactattcattggtgctggacagcgctctggaccgcgagagtgtgtccgcctatgagctggtggttaccgcgcgggacgggggctcgccttctctgtgggccactgctagcgtgtccgtggaggtggccgacgtgaacgacaacgccccggcgttcgcgcagcccgagtatacggtgttcgtgaaggagaacaacccgccgggctgccacatcttcactgtgtcggcgggggacgcggacgcgcagaagaacgcgctggtgtcctactcgctggtggagctgcgggtgggcgagcgcgcgctgtcgagctacgtgtcagtgcacgcggagagcggcaaggtgtacgcgctgcagccgttggaccacgaggagctggagctgttgcagttccaggtgagcgcgcgcgatgcgggcgtgccgcctctgggcagcaacgtgacgctgcaggtgttcgtgctggacgagaacgacaacgcgccggcactgctggcgcctcgggtgggtggcactggtggcgcagtgagagagcttgtgccgcggtctgtgggcgcgggccatgtggtggcgaaggtacgtgcagttgacgctgactcaggctacaacgcgtggctttcgtatgagttgcaaccggtggcggccggtgcgagcatcccgttccgcgtggggctgtacactggtgagatcagcacgacacgagccctagatgagacggacgcaccgcgccaccgccttctggtgcttgtgaaggaccacggggagccctcgctgacagccacagccaccgtgctggtgtcgctggtggaaagcggccaggcaccaaaggcgtcgtcgcgggcatcgttgggcattgcaggcccagagaccgagctggtggatgtcaacgtgtacctgatcatcgccatctgcgcggtgtccagtctgttggtgcttaccctgctgctgtacacggcgttgcggtgctcagcgccgtcctctgagggcgcatgtagtttggtaaagcccactctggtgtgctccagcgcggtggggagctggtcattctcccagcagaggcggcagagggtgtgctctggggagggcccacccaagacagacctcatggccttcagtcccagccttcctcagggtccatcctctacagacaatgtgagtcataaataatcttgtttccaacaattttaaaacaattagttcaattggtctccttaaattttctttcataatttcttttttagttgatagctttatgtataattattattttttaatgttatgctgtatttgcactaattatttggaagtacgtttaatatacacttttgttttgggatgcgtaatactatagatcaaaatctatggtttatgttggctactctccatttttggaggaggactttgctaactggagcaatggattcacctttcttctatagtgtatttacaaaatcaaatatttacatttccatattttgataatcaatacctataaatgttatagtaaacaaatttaatatatatgttacctaatattttattctatgtattgtcctcattttataaaatatagctgtgtcaaa

SEQ ID NO: 172126 - DNA, 5221 bp, Homo sapiens
  Payload ID: 13821
  Gene Symbol: PCDHA7
  Gene Name: protocadherin alpha 7
  Uniprot ID: Q9UN72
  ENST ID: ENST00000525929
  CDS Start-End: 1-2814
atggtgtgcccgaatggatacgacccagggggccgacatctactgctgtttattataattctagcagcttgggaggcagggagaggccagctccactactcggtccccgaggaggctaaacatggcaacttcgtgggccgcatcgcgcaggacctggggctggagctggcggagctggtgccgcgcctgttccgggcggtgtgcaaattccgtggggatcttctggaggtaaatctgcagaatggcattttgtttgtgaattctcggatcgaccgcgaggagctgtgcgggcggagcgcggagtgcagcatccacctggaggtgatcgtggaaaggccgctgcaggttttccatgtggacgtggaggtgaaggacattaacgacaaccctccggtgttcccagcgacacaaaggaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacagttcttgtggaagttgtggatgtaaatgacaatgctccacagttgactctcacttccctgtctctccctattccagaggacgcccaaccaggtaccgtcatcacattgattagcgtgtttgaccgagattttggagtcaacggacaggttacctgctccctgacgccccgcgttcccttcaagttggtgtccaccttcaagaattactattcattggtgctggacagcgctctggaccgcgagagtgtgtccgcctatgagctggtggttaccgcgcgggacgggggctcgccttctctgtgggccactgctagcgtgtccgtggaggtggccgacgtgaacgacaacgccccggcgttcgcgcagcccgagtatacggtgttcgtgaaggagaacaacccgccgggctgccacatcttcactgtgtcggcgggggacgcggacgcgcagaagaacgcgctggtgtcctactcgctggtggagctgcgggtgggcgagcgcgcgctgtcgagctacgtgtcagtgcacgcggagagcggcaaggtgtacgcgctgcagccgttggaccacgaggagctggagctgttgcagttccaggtgagcgcgcgcgatgcgggcgtgccgcctctgggcagcaacgtgacgctgcaggtgttcgtgctggacgagaacgacaacgcgccggcactgctggcgcctcgggtgggtggcactggtggcgcagtgagagagcttgtgccgcggtctgtgggcgcgggccatgtggtggcgaaggtacgtgcagttgacgctgactcaggctacaacgcgtggctttcgtatgagttgcaaccggtggcggccggtgcgagcatcccgttccgcgtggggctgtacactggtgagatcagcacgacacgagccctagatgagacggacgcaccgcgccaccgccttctggtgcttgtgaaggaccacggggagccctcgctgacagccacagccaccgtgctggtgtcgctggtggaaagcggccaggcaccaaaggcgtcgtcgcgggcatcgttgggcattgcaggcccagagaccgagctggtggatgtcaacgtgtacctgatcatcgccatctgcgcggtgtccagtctgttggtgcttaccctgctgctgtacacggcgttgcggtgctcagcgccgtcctctgagggcgcatgtagtttggtaaagcccactctggtgtgctccagcgcggtggggagctggtcattctcccagcagaggcggcagagggtgtgctctggggagggcccacccaagacagacctcatggccttcagtcccagccttcctcagggtccatcctctacagacaatccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 172127 - DNA, 2616 bp, Homo sapiens
  Payload ID: 13822
  Gene Symbol: PCDHA8
  Gene Name: protocadherin alpha 8
  Uniprot ID: Q9Y5H6
  ENST ID: ENST00000378123
  CDS Start-End: 136-2580
cttttctctgacagcatctgtctctaaaggccgaacaacgggagatgcagcggaattggattaaaagactctgaaagtacagtcgttcatctttatattaagataatattttctgataggaaacgactatttaacatggattatcactggcgaggagagctgggatcctggcgactactactcttgcttctgctcctcgcagcctggaaggtggggagcggccagctccactactccgtccccgaggaggccaaacacggcaccttcgtgggccggatcgcgcaggacctggggctggagctggcggagctggtgccgcgcctgttccgggtggcgtccaaaagacaccgggaccttctggaggtaagtctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgaaggatgttaatgacaacccgccagtgttccgggtaaaagaccaaaagctgtttgtttcagaatccagaatgccagactctcggtttccgctagagggcgcgtccgatgcagatgttggagctaactccgtgttaacctacaggcttagctctcatgattacttcatgctagatgtgaattcaaagaacgatgagaataaactggttgagctcgtattaagaaaatccttggacagagaggacgctcctgcgcaccacttattcctgacagccacagatgggggcaaacctgagctcacaggcactgttcagctgctggtcacagtgctggatgtgaatgataatgctcccactttcgaacagtctgaatacgaagtaagaatattcgaaaacgcagacaacggaacaacagttatcaaactgaatgcttctgatccggatgaaggagccaatggggcaatttcatattcttttaatagccttgttgaaactatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgacctgctccctgatgccccatgtccccttcaagctggtgtccaccttcaagaattactactcgttggtgctggacagcgccctggaccgcgagagagtgtcggcctatgagttggtggtaaccgcgcgggacgggggctcgccttcgctgtgggccaccgccagcttgtctgtggaggtggccgacgtgaacgacaatgctccggcgttcgcgcagcccgagtacacggtgttcgtgaaggagaacaacccgccgggctgccacatcttcacggtgtctgcgcgagacgcggacgcgcaggagaacgcgctggtgtcctactcgcttgtggagcggcgggtgggcgagcgctcgctgtcgagctacatttcggtgcacacggagagcggcaaggtgtacgcgctgcagccgctggaccacgaggagctagagctgctgcagttccaggtgagcgcgcgcgacgcgggcgtgccgcctctgggcagcaacgtgacgctgcaggtgttcgtgctggacgagaatgacaacgcgccggcactgctggagcctcgggtgggtggcactggtggcgcagcgagcaagctggtgccgcggtctgtgggcgcgggccacgtggtagcgaaggtgcgcgcagtggacgccgactcgggctacaacgcgtggctttcgtatgagctgcagccagctgcaagcagccctcgcatcccgttccgcgtggggctgtacacgggcgagatcagcaccactcgtgtcctggacgaagcggactctccgcgccaccgtctgctggtcctggtgaaggatcatggtgaacctgcgctgaccgccacggccacggttctggtgtcgctggtggagagcggccaggctccaaaagcgtcatcgaggcagtcggctggcgttttgggtccggaagcggcgctggtggatgtcaacgtgtacctgatcatcgccatctgcgcggtatccagcctgctggtgctcacgctgctgctgtacactgcgctgcggtgctcagcactgcccactgagggcgggtgccgggcgggcaagcccactctggtgtgctccagtgcggtggggagctggtcatactcgcaacaacagccgcagagggtgtgctctggtgaggggccaccgaagacggacctcatggccttcagcccctgccttcctcctgatctgggatcagttgatgtaggcgaagagcaagatttaaatgttgatcatggcctcaaagtaagtccatttaaatttagaactcataaattctatttgtggaaattgtagttactttaaaagtgtttcagatttagtttttcaccg

SEQ ID NO: 172128 - DNA, 5260 bp, Homo sapiens
  Payload ID: 13822
  Gene Symbol: PCDHA8
  Gene Name: protocadherin alpha 8
  Uniprot ID: Q9Y5H6
  ENST ID: ENST00000531613
  CDS Start-End: 1-2853
atggattatcactggcgaggagagctgggatcctggcgactactactcttgcttctgctcctcgcagcctggaaggtggggagcggccagctccactactccgtccccgaggaggccaaacacggcaccttcgtgggccggatcgcgcaggacctggggctggagctggcggagctggtgccgcgcctgttccgggtggcgtccaaaagacaccgggaccttctggaggtaagtctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgaaggatgttaatgacaacccgccagtgttccgggtaaaagaccaaaagctgtttgtttcagaatccagaatgccagactctcggtttccgctagagggcgcgtccgatgcagatgttggagctaactccgtgttaacctacaggcttagctctcatgattacttcatgctagatgtgaattcaaagaacgatgagaataaactggttgagctcgtattaagaaaatccttggacagagaggacgctcctgcgcaccacttattcctgacagccacagatgggggcaaacctgagctcacaggcactgttcagctgctggtcacagtgctggatgtgaatgataatgctcccactttcgaacagtctgaatacgaagtaagaatattcgaaaacgcagacaacggaacaacagttatcaaactgaatgcttctgatccggatgaaggagccaatggggcaatttcatattcttttaatagccttgttgaaactatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgacctgctccctgatgccccatgtccccttcaagctggtgtccaccttcaagaattactactcgttggtgctggacagcgccctggaccgcgagagagtgtcggcctatgagttggtggtaaccgcgcgggacgggggctcgccttcgctgtgggccaccgccagcttgtctgtggaggtggccgacgtgaacgacaatgctccggcgttcgcgcagcccgagtacacggtgttcgtgaaggagaacaacccgccgggctgccacatcttcacggtgtctgcgcgagacgcggacgcgcaggagaacgcgctggtgtcctactcgcttgtggagcggcgggtgggcgagcgctcgctgtcgagctacatttcggtgcacacggagagcggcaaggtgtacgcgctgcagccgctggaccacgaggagctagagctgctgcagttccaggtgagcgcgcgcgacgcgggcgtgccgcctctgggcagcaacgtgacgctgcaggtgttcgtgctggacgagaatgacaacgcgccggcactgctggagcctcgggtgggtggcactggtggcgcagcgagcaagctggtgccgcggtctgtgggcgcgggccacgtggtagcgaaggtgcgcgcagtggacgccgactcgggctacaacgcgtggctttcgtatgagctgcagccagctgcaagcagccctcgcatcccgttccgcgtggggctgtacacgggcgagatcagcaccactcgtgtcctggacgaagcggactctccgcgccaccgtctgctggtcctggtgaaggatcatggtgaacctgcgctgaccgccacggccacggttctggtgtcgctggtggagagcggccaggctccaaaagcgtcatcgaggcagtcggctggcgttttgggtccggaagcggcgctggtggatgtcaacgtgtacctgatcatcgccatctgcgcggtatccagcctgctggtgctcacgctgctgctgtacactgcgctgcggtgctcagcactgcccactgagggcgggtgccgggcgggcaagcccactctggtgtgctccagtgcggtggggagctggtcatactcgcaacaacagccgcagagggtgtgctctggtgaggggccaccgaagacggacctcatggccttcagcccctgccttcctcctgatctgggatcagttgatgtaggcgaagagcaagatttaaatgttgatcatggcctcaaaccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 172129 - DNA, 6900 bp, Homo sapiens
  Payload ID: 13823
  Gene Symbol: PCDHA9
  Gene Name: protocadherin alpha 9
  Uniprot ID: Q9Y5H5
  ENST ID: ENST00000378122
  CDS Start-End: 725-3253
ctcgcttttcttgcaatattttataccttttcaattcatagaattactcaagaaaactacctcagttggttgctactttttgttgattccttttaccagacatgactaagtttctttttcatcagtagatttctgggctcctatattcactagagattgcaactcctggatttctcttacactagaatcctatttcgagccatatgggagattctgaattccagaacaaaagaattttgtaatttaaaattcgtgattgctcaatggaatcattttaattgttacttcatttctgtcgttatttaaaacttaagtggagagttttctcagggataagaaaaccacaatcaaggtcatacaaaacttttagaggcagtcagtctgctaagaaggctccagcaagagaaacgggatcttctgtttcaacaatcattacttaagaaaaaattaagaaaatgaaataagttttgcagaataactgtgaaatttttattcatgaaatatgtacttacactttgggccacgtgatgtcactctttgccgcgatgttctctctgaatccagacaaatacagcccttttcccatgggaaagaggctcaattctttttcactctctctgtgctgaacgatggcgaacacagcagaatgggactgacgaaatcagatgatttcttctaatttggaggcaattttcactaattagaagaagactgagtatttgaaatgttatactcaagtcgaggagatccagagggtcagcctctactgctctcgcttctgatcctcgcaatgtgggtggtggggagcggccagctccactactccgtcccggaggaagccgaacacggcaccttcgtgggccgcatcgcgcaggacctggggctggagctggcggagctggtgccgcgcctgttccagttggattccaaaggccgcggggaccttctggaggtaaatctgcagaatggcattttgtttgtgaattctcggatcgaccgcgaggagctgtgcgggcggagcgcggagtgcagcatccacctggaggtgatcgtagacaggccgctgcaggttttccatgtggacgtggaggtgaaggacattaacgacaaccctccagtgttcccagcgacacaaaagaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacacttcttgtggaagttgtggatgtaaatgacaatgctccacagttgactatcaaaacgctctcggttcctgtaaaagaggacgcacaactggggacagttattgccctgattagtgtgatcgacctagacgcagatgccaacgggcaggttacctgctccctgacgccccacgtccccttcaagctggtgtccacctacaagaattactactcgttggtgctggacagagctctggaccgcgagagtgtgtccgcctacgagctggtggttaccgcgcgggacgggggctcgccttcactgtgggccacggccagggtgtctgtggaggtggccgacgtgaacgacaacgcaccagcgttcgcgcagtccgagtacacggtgttcgtgaaggagaacaacccgccgggctgccacatcttcacggtgtctgcgcgggacgctgacgcgcaggagaacgccctggtgtcctactcgctggtggagcggcggttgggcgagcgctcgctgtcgagctacgtgtcagtgcacgcggagagcggcaaggtgtacgcgctgcagccgttggaccacgaggagctggagctgctacagttccaggtgagcgcgcgcgacgcgggcgtgccgcctctgggcagcaacgtgacgctgcaggtgttcgtgctggacgagaacgacaatgcgccggcgctgctgacacctcggatgaggggcactgacggcgcagtgagcgagatggtgctgcggtcggtgggcgccggcgtagtggtggggaaggtgcgcgcagtggacgccgactcgggctacaacgcgtggctttcatacgagctgcagccagaaacggccagcgcgagcatcccgttccgcgtggggctgtacacgggcgagatcagcacaacgcgtgccctggacgaaacggacgcaccgcgccagcgcctactggtgctggtgaaagaccacggggagccagcgctgacggccacggccactgtgctggtgtcgctggtggagagcggccaggcgccaaagtcatcgtcgcgggcgtcagtgggtgccacgggccccgaggtgacgctggtggatgtcaacgtgtacctgatcatcgccatctgcgcggtgtctagcctgttggttctcacgctgctgctgtacactgtgctgcggtgctcggcgatgcccaccgagggcgagtgcgcgcctggcaagccgacgctggtgtgttctagcgcggtggggagttggtcgtactcgcagcagaggaggcagagggtgtgctctggcgagggtaagcagaagaccgacctcatggccttcagcccgggcctttctccttgtgctggatctacagagcgaacgggagaaccctctgcttcctcagattcaactgggaaggtgggtttttctagcattttatttatttatataattttttttcttgaaagatattatcgattactcccaggggccgttcaaatagttttattcatttttctagaaatccagcagattttttttctgataaagtaaaccccttaacattggagccgactttgtcttgacttctagtgagaattataaactgtatattaaatagatattttttgggtgctgaatcaattttatttaaatttgtgattaaagtgacattgaatttctgatgctatgctgccataacacttgaaaaccaatttagttgttagtcattcattaaacattaacatcactatcatttatttattgctaaatgatgcatagtattttagtctacttgtattgtttataagaaacccaagcaaaaatatatagcaattgttaccttgttaagtttgtagttctctacatttctctggatggagactgtgaacatctgattgttcagcaaccttcagtatctattattttaataagaaagaaacttcccctaaactttagaaaacagttgctccactttaggaatcaaattatgtcaataaatgttataaacacagccttcatttcaacttatataaaatatgttttaaaatgcctgacaatgtagataattcaagaaatgttgactgaaattttgtctacacttagaacattttttgaaattcagtttacagaaattggagaaaatgctttttaaacaagtgtttcctttcttcaagaagacattctccttttaattgaaattttctccattcagtgataaaatgatcagccatgtgaagattcgaaacttcgagttcttttgaaattcagagtctgtaacttaaaacattacccttatgaatttagatgagaattcacttgttctgtcagtaatccataagacagaaatctgtttttttaaaaatatctttttctcctctcagctcatacataacacaaggcagaaatctggatatgagatttgcctctttaatgtcactacatgttatgtttcctgaattgtagtatgtgactttcaaaatggtggttttccacactctacctttagtgcaagctatttgtttgttttctaatttatagttttaaaaacttcgcttattgagtttttgttatgtggtttatatttttctttctctttcagctattttatttaatattgtgtcagatattttacaaggtatgacctaattaaaaactcagtagagaaagatcagaatggccttgagaatagagccacaaaaataactatgaaaatgccagtaacgtttatttaaaacaaaatattttaatttttaaattttcccttaaaacacacttttggaatatgctacaatattacatgttttttgtctttttatttttctgagacggagtcgttttctgccacccaggctggagtacagtggcatgatcttggctcactgcaacgtctgcctcctgggttcaagcaattctcctgcctcagcctcctgagtagctgggattataggcacatgccaccgcgcccagctaatttttgtatttttagtagagatggggtttcatcatgttggccaggttggtctcgaactcctgaccttgtgatgctcccacctcggcctcccaaagtgctgggattaaagctgtgagccactgtgccaaggcttttttattttttttttttgtcattttctttcaaaacttgagtggtctctgagctcctgtcattaaacctatctatatctgtctatcagcacaactcaccttgaatatagtcttatactttcaagtatctttgtctttgcacgtttttcaagtttcatgtgccatttaaacttggacccaggtatctgattatttgatgtgaatagagggatgctacagatgtcatttgtctcccgccctaagtcctccagtctccttagagctagtacttactaagcatttactatgtcatcaataatcataaaacgtatttttttttttgagtcagagtctcgctctgttgcccaggctggagtgcagtggtgccatcttggctcactccaagctccccctcccgtgttcacgccattctcctgcctcagcctcccgagtagctgggactacaggcgcctgccaccatgcccgcctaatttttttgtatttttagtagagatggggtttcaccgtgttagtcaggatggtctcgatctcctgacctcatgatcctcccgcctcagcctcccaaaatgctgggattacaggcgtgagccaccgcgcctggcctaaaatgtgttctttattattgacggctgtattgatgggattggtaatttagtccttcatattaatctctattctctctcagagtacaagctctcatcatatgcaaattctcagaagggctgtgaacaccttagtaataaatttatcttttgaggtcattagcaaacatgaactcacagggatccagagatggtaaaattcaaaacagcctgtcaagttcaaaacagagaggtgaaagcagaagagacactttcctattttgcctaataggtctccttatatgcatctgtagttaacattcctcaattcaagttagaatcatgaaacaataatgaagctcctcctatgtctcttttcaagttgtaattactatataggaaaaactaagttgtcacccaatatcttagacactttgagagcaaagggggtgctgtaaataagtatacaagatcacagacctaaattgagcctgttccagacaaattggggcctatggtcaacctatccttagacctgctaacgcattagcattagcagcacctaagtcctcattgaatgttctggttcaaggctccacctcagaaattctgaaatgggtagtaagagcaaattttcattttaaagcacacctgagatgattctcatacaaccgaaattttagatccatagccctatttgatacttgacagtgcaagtttctgtaatttaaaaagatgtggtggcctgacacctgcaatcccaacattttgggaggccaaggtgggagggtcccttccttgagcccagcagtttgagaccaatgtagtgagactcatctctgccaaaaaaaaaaaattagccgggcatggtggcacacatctctagtcccaattactcaggaggctgaggcgagagaatcgcttgagcctgggacattgaggctgcagtgaactgtgatggcacaactgcatttcagcccgggtgacagcaagattctgtctcaaaaaaaaaaaaaaaaagagtagtttaactactccctactttttattcaatattggacatctacattgggatatttatgttatcacttggtataaaatgtacattagtagaaattgagtttagtttttattattttgtgcgtggagatgattgatcaatggcaaacttattttacgctccagatagctaaaacaaacgttgatattttgatacataactcattacattttaattcagggtttataaaaaagtaatctctaaaatcagaatttgaatgaattttgatgcaagaggcattccagaggagtagagaagtatagaaacagaatttagtaggacacataaactgatggattaagtgacacccatttctgtcagttttcttattcataaatattgttgctctgtcattcagattttaataaaaaaagtttaaagtaattgacacatttaaaaatattctttagaaaagtcaaaacatcattaaataaaataaattaacccttgcataa

SEQ ID NO: 172130 - DNA, 6293 bp, Homo sapiens
  Payload ID: 13823
  Gene Symbol: PCDHA9
  Gene Name: protocadherin alpha 9
  Uniprot ID: Q9Y5H5
  ENST ID: ENST00000532602
  CDS Start-End: 1034-3886
acttggacgttggaataagatagtaaaactcacaacaaaactttgtagaacttagtcaggaaaagaatctcaagcatagctttaaaaacagaaattgccccgagtactaaggatgagcaataatgaaattaaaacatattgtaataacattacacaaactatattggagactacaaagaagagattattcatagattataaagcttggaaagaatcaaaacaacacatttctggaaacagattgtataaatgctacaaaagagaaaaatatattttctccccacgcaacacaagaccttaaagtcaattctcgcttttcttgcaatattttataccttttcaattcatagaattactcaagaaaactacctcagttggttgctactttttgttgattccttttaccagacatgactaagtttctttttcatcagtagatttctgggctcctatattcactagagattgcaactcctggatttctcttacactagaatcctatttcgagccatatgggagattctgaattccagaacaaaagaattttgtaatttaaaattcgtgattgctcaatggaatcattttaattgttacttcatttctgtcgttatttaaaacttaagtggagagttttctcagggataagaaaaccacaatcaaggtcatacaaaacttttagaggcagtcagtctgctaagaaggctccagcaagagaaacgggatcttctgtttcaacaatcattacttaagaaaaaattaagaaaatgaaataagttttgcagaataactgtgaaatttttattcatgaaatatgtacttacactttgggccacgtgatgtcactctttgccgcgatgttctctctgaatccagacaaatacagcccttttcccatgggaaagaggctcaattctttttcactctctctgtgctgaacgatggcgaacacagcagaatgggactgacgaaatcagatgatttcttctaatttggaggcaattttcactaattagaagaagactgagtatttgaaatgttatactcaagtcgaggagatccagagggtcagcctctactgctctcgcttctgatcctcgcaatgtgggtggtggggagcggccagctccactactccgtcccggaggaagccgaacacggcaccttcgtgggccgcatcgcgcaggacctggggctggagctggcggagctggtgccgcgcctgttccagttggattccaaaggccgcggggaccttctggaggtaaatctgcagaatggcattttgtttgtgaattctcggatcgaccgcgaggagctgtgcgggcggagcgcggagtgcagcatccacctggaggtgatcgtagacaggccgctgcaggttttccatgtggacgtggaggtgaaggacattaacgacaaccctccagtgttcccagcgacacaaaagaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacacttcttgtggaagttgtggatgtaaatgacaatgctccacagttgactatcaaaacgctctcggttcctgtaaaagaggacgcacaactggggacagttattgccctgattagtgtgatcgacctagacgcagatgccaacgggcaggttacctgctccctgacgccccacgtccccttcaagctggtgtccacctacaagaattactactcgttggtgctggacagagctctggaccgcgagagtgtgtccgcctacgagctggtggttaccgcgcgggacgggggctcgccttcactgtgggccacggccagggtgtctgtggaggtggccgacgtgaacgacaacgcaccagcgttcgcgcagtccgagtacacggtgttcgtgaaggagaacaacccgccgggctgccacatcttcacggtgtctgcgcgggacgctgacgcgcaggagaacgccctggtgtcctactcgctggtggagcggcggttgggcgagcgctcgctgtcgagctacgtgtcagtgcacgcggagagcggcaaggtgtacgcgctgcagccgttggaccacgaggagctggagctgctacagttccaggtgagcgcgcgcgacgcgggcgtgccgcctctgggcagcaacgtgacgctgcaggtgttcgtgctggacgagaacgacaatgcgccggcgctgctgacacctcggatgaggggcactgacggcgcagtgagcgagatggtgctgcggtcggtgggcgccggcgtagtggtggggaaggtgcgcgcagtggacgccgactcgggctacaacgcgtggctttcatacgagctgcagccagaaacggccagcgcgagcatcccgttccgcgtggggctgtacacgggcgagatcagcacaacgcgtgccctggacgaaacggacgcaccgcgccagcgcctactggtgctggtgaaagaccacggggagccagcgctgacggccacggccactgtgctggtgtcgctggtggagagcggccaggcgccaaagtcatcgtcgcgggcgtcagtgggtgccacgggccccgaggtgacgctggtggatgtcaacgtgtacctgatcatcgccatctgcgcggtgtctagcctgttggttctcacgctgctgctgtacactgtgctgcggtgctcggcgatgcccaccgagggcgagtgcgcgcctggcaagccgacgctggtgtgttctagcgcggtggggagttggtcgtactcgcagcagaggaggcagagggtgtgctctggcgagggtaagcagaagaccgacctcatggccttcagcccgggcctttctccttgtgctggatctacagagcgaacgggagaaccctctgcttcctcagattcaactgggaagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 172131 - DNA, 5299 bp, Homo sapiens
  Payload ID: 13824
  Gene Symbol: PCDHAC1
  Gene Name: protocadherin alpha subfamily C, 1
  Uniprot ID: Q9H158
  ENST ID: ENST00000253807
  CDS Start-End: 1-2892
atggtgggctgtggggtggcagttttatgtttgtgggtttcctgcggcgctgcagcgggacagctcgagtactcagtgccggaggagacggagcggggcgtagccgtaggcaatctctccgcggacttgaggctgccagcggccgctatgtcctcgcggaactttcgcttcctttccagccaccgcgagctctacttcggggtggatctacccagcggcaatttggtggtcagagagccggcggaccgcgaacagctgtgcagggccaaagctgcctgcgtcttgacctacgacctggtgctcgaggacccgctggagctgcacaagattcggattcacgtcctggacaccaatgacaactcacctctctttcctgccggcgacgtgcagctgcacatccccgagttcctgacgcccggagcccgctttactctcccgaatgcccaagatgacgacgagggaagcaatgggatactaagctacagcctaagccccagtcagcactttcgcctggacatgggatcgcgggttgacggcagcgaatacccggagttggtgttggagaaagcactggatcgcgaacagcgcgccacccacctgctggtgcttacagctcgggacggcgggctacctgcccgctcaggagacgcacaagtcaccatcattgtggtggacacaaatgacaacgcgcctgtatttgagcgctccgtataccgcaccaaggttccagagactgcacccaatgggactgtgttattccgagttcaagccttggatccagatgaagggtccaatggggaagtccagtactccctaagcaacagcacgcaagcagagctgcgacaccgctttcacgtgcaccctaaaagtggggaggtgcaagtagctgcttcactaggtccgcctgaaacgctcttggaggcatacattgaggcgagggacgaaggtgtctttggtttagctagcaccgctaaactgctggtggaggtgactgacgtgaacgatcatgcccccgaactggacttcctgactctttcgaacccagtacctgaggacgctgcccctggcacagtgattgctctctttagtgtaaaggatgaagacctcgattctaatggtagggtcatttgtggcatgtctagtgcaggcccttttcagctgacggcttcctttgacaactactacagcctgctgattgatgggcccctggaccgggagcagatcagtgaataccaagtcctgatcacggcctcagatagtggctcacccccacttagcacccgaaggacaatcactgtgtcagttgctgatgtgaatgacaatacaccaaactttcctcaaccccagcaggaacttttcgttgctgaaaacaatggccctggggcctctctaggccgagtgtttgcccaggaccccgacctggggaagaatggccttgtctcttatgagctgttggatgttatctctgaagggccatcagcctctagcttgctggcagtggaatcatccagtggggccatcactgccaaaacttcctttgactttgagcagctcagggggtttcatttccaagtagaaggccgggatggtggcattcctcccagaagtgcaacagtgactataaacttgtttgtggtagataggaatgacaattatccggttatcttgtttcccttgcccagaaatggttctgtcccagtggaaattgtgccccgctctgccaggactggacacttggtcacaaaagtggtagcagaggatgctgacagtggttctaatgcctggctttcctaccacatctcccgggcgtctgactctagtctctttagaatttcagccaatataggtgagctccgtactgctcgcttagttcttcccactgatgcagttaagcagagggtggtggtagtggttcgggaccatggagacccaccactttcctcctctgtcactctgggtgtgctgttgagcaactctgtccctcagttacttccagactttgaagatgtctgggaaccaggagggcagctttctgcccagaacttgtatttagtaattgccttggcttgtatttcctttttatttctggggtgcttacttttcttcgtgtgtaccaagttgcaccagagcccaggctgttgcgctcagagctgctgtcgctctacagaggatctgaggtatggaagtaagatggtttcaaatccttgcatgacatcagccaccatagatgtcactacagttgagagactttctcagacttatctctatcgggcctctctgggacttggttctgataataacagtttgctgttgcgtggggagtacaatgctgccgacctgcgaaatcttgccactggggtaggactgaatttgccaatatcctgtattcagattcggaataggaaaggggatcacgctaatgtcaatgccatgccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 172132 - DNA, 4077 bp, Homo sapiens
  Payload ID: 13824
  Gene Symbol: PCDHAC1
  Gene Name: protocadherin alpha subfamily C, 1
  Uniprot ID: Q9H158
  ENST ID: ENST00000409700
  CDS Start-End: 525-2981
aagagcccagctgggctcagccacagttatcagcaatctgcgggcagaggatgtggaggttaagatctgggcagcctcagggcgttgtcctagaaaacaccgtttaaggagagaagtgttagtgtctcggggcgtctcccaggctccgccctgcgcccgcagccagcgtggtggtcgagaccccagcccgctgctactggagacagcacctctcgcgcccgggcgggcggcctcgtctctgcacccctaggcggcgctgcgctcctcaacacccggccggctccgctttcccagacggctgcccagcctccagcctagcaagcccggctcccagctggccagccccggcaatgccggcgttcgggaggcgcaacgtcggcggtcgctgagtatccagcccgcagcagtgacggccggcaggagcgtgctcttccccgcggctcgtgctctccaggagtccggagcatggtcctgggtcaccgttggtgtagcgtgttggtggaacgtggacgcctagagggaggatggtgggctgtggggtggcagttttatgtttgtgggtttcctgcggcgctgcagcgggacagctcgagtactcagtgccggaggagacggagcggggcgtagccgtaggcaatctctccgcggacttgaggctgccagcggccgctatgtcctcgcggaactttcgcttcctttccagccaccgcgagctctacttcggggtggatctacccagcggcaatttggtggtcagagagccggcggaccgcgaacagctgtgcagggccaaagctgcctgcgtcttgacctacgacctggtgctcgaggacccgctggagctgcacaagattcggattcacgtcctggacaccaatgacaactcacctctctttcctgccggcgacgtgcagctgcacatccccgagttcctgacgcccggagcccgctttactctcccgaatgcccaagatgacgacgagggaagcaatgggatactaagctacagcctaagccccagtcagcactttcgcctggacatgggatcgcgggttgacggcagcgaatacccggagttggtgttggagaaagcactggatcgcgaacagcgcgccacccacctgctggtgcttacagctcgggacggcgggctacctgcccgctcaggagacgcacaagtcaccatcattgtggtggacacaaatgacaacgcgcctgtatttgagcgctccgtataccgcaccaaggttccagagactgcacccaatgggactgtgttattccgagttcaagccttggatccagatgaagggtccaatggggaagtccagtactccctaagcaacagcacgcaagcagagctgcgacaccgctttcacgtgcaccctaaaagtggggaggtgcaagtagctgcttcactaggtccgcctgaaacgctcttggaggcatacattgaggcgagggacgaaggtgtctttggtttagctagcaccgctaaactgctggtggaggtgactgacgtgaacgatcatgcccccgaactggacttcctgactctttcgaacccagtacctgaggacgctgcccctggcacagtgattgctctctttagtgtaaaggatgaagacctcgattctaatggtagggtcatttgtggcatgtctagtgcaggcccttttcagctgacggcttcctttgacaactactacagcctgctgattgatgggcccctggaccgggagcagatcagtgaataccaagtcctgatcacggcctcagatagtggctcacccccacttagcacccgaaggacaatcactgtgtcagttgctgatgtgaatgacaatacaccaaactttcctcaaccccagcaggaacttttcgttgctgaaaacaatggccctggggcctctctaggccgagtgtttgcccaggaccccgacctggggaagaatggccttgtctcttatgagctgttggatgttatctctgaagggccatcagcctctagcttgctggcagtggaatcatccagtggggccatcactgccaaaacttcctttgactttgagcagctcagggggtttcatttccaagtagaaggccgggatggtggcattcctcccagaagtgcaacagtgactataaacttgtttgtggtagataggaatgacaattatccggttatcttgtttcccttgcccagaaatggttctgtcccagtggaaattgtgccccgctctgccaggactggacacttggtcacaaaagtggtagcagaggatgctgacagtggttctaatgcctggctttcctaccacatctcccgggcgtctgactctagtctctttagaatttcagccaatataggtgagctccgtactgctcgcttagttcttcccactgatgcagttaagcagagggtggtggtagtggttcgggaccatggagacccaccactttcctcctctgtcactctgggtgtgctgttgagcaactctgtccctcagttacttccagactttgaagatgtctgggaaccaggagggcagctttctgcccagaacttgtatttagtaattgccttggcttgtatttcctttttatttctggggtgcttacttttcttcgtgtgtaccaagttgcaccagagcccaggctgttgcgctcagagctgctgtcgctctacagaggatctgaggtatggaagtaagatggtttcaaatccttgcatgacatcagccaccatagatgtcactacagttgagagactttctcagacttatctctatcgggcctctctgggacttggttctgataataacagtttgctgttgcgtggggagtacaatgctgccgacctgcgaaatcttgccactggggtaggactgaatttgccaatatcctgtattcagattcggaataggaaaggggatcacgctaatgtcaatgccatggtaagcaaattttatggaatttgattcctttggcccggagatggctgctagctgtgttttgaaatatttcttagacaagcctttcacaacatttcatcaattgaactaaacactccttcttagcacttcctgtgccaagaaatctggaagtatagaagtattagaagattgccctaggcctcaagggacttatagtttatttttgagaaacaagggcaaaaattaaaacctatttaagaacaataaaagtaatatgacataaaggtctaaaattaaaaataaaataccaaaatattttataagcaacagatgtgtaaggcactctaatatttaaagtgaagaatgaaaaatatgtaagagtctgctttatatgaatataatatggaaggtgaaacatttacttaaactattgcaatgcattattaaaagatgacgataaccacaaaagatgtaaaaataaattacaatgggggttaaaagaagggagaaagggaacataagagaacatttgagtgaggaggaaggagtcagagaaggctttgtgatagagatcacagatttagttggatctttaatacgatataccatttaataaaaaacagtgtattctctagcctatacttttaatgaataccattttggtgaaggtgtcttctttgggaatgacaccctaaaacatagctgatagctccatagcagtgttttgtaactgctttggagtttttgcttacacaaaaactgtaagcctctctcataacatctatttatactgataggagatcatattgttggatataggacttgacaaccttttgttttgtgtttctattgataatattttacaaagaggaaagatgagtaatttttatgtcagaaatatttatgtgttcaaaggtgcacttaccatccaaagtccattcaacttggatttaatttcttttattttaggggacaaatacacttaacaaataagtaaatatcatatttgagagtaatgtatctaatgaaagttaagtgattcaaatatttcaatttatctgttagtggcccttggcatttcaaaacttcttttttttttttgagacaggggtctcactatgttgcccaggctggtctcaaa

SEQ ID NO: 172133 - DNA, 5963 bp, Homo sapiens
  Payload ID: 13825
  Gene Symbol: PCDHAC2
  Gene Name: protocadherin alpha subfamily C, 2
  Uniprot ID: Q9Y5I4
  ENST ID: ENST00000289269
  CDS Start-End: 533-3556
gttaagcaggggagagacggtggagactggatgaactggacagtgggggtagggagaaagggagtggccgtgttcctgcggtccgctgggatccggcaggtccagggtgaaggagatggggctggagaggctgagcagtccgggttcgctgtccgccacttcggcgcggaatcagagcaggacttgctgagccctcctaccgctccctttccccctccccctctgtcttcccttctgtttccttttccctccccctggagctgtagcggcagcagcagcaggaagccgagccgggttgagcgactcggaggcgagcggaggagctggaatatggggagtcagcgaggacggtggggccaggagcccttgggagggcctacggagggagcggccccaggcgctttctagagcgtgagcggtgggggagcaggcgcagggtggcacgagcggaggcggggcccgggcgtggggcacggctggggaagctgccgcctccggccctgcccggctgcctccgccgcggccagtggctatggagcaggcgggcaccagacctgcggcgacagagcatccacggctccggcggcccatgccctggctgctgctactgcctctcctgctgctgttgctgctgctgctacctggccctgcggcctcccagctgcgatactctgtgccagaggagcaggcacccggcgcgctcgtgggcaacgtggctcgcgcgctggggcttgagctgcggcgcttggggccgggttgcttgcgcatcaaccatctgggtgcgcccagtccgcgctacctggagctggacctgacgagtggagcgctcttcgtcaacgagcgcattgatcgggaggcgctgtgtgagcagcggcctcgctgcctgctcagcttggaagtgctggcgcacaaccccgtggcggtgagcgccgttgaggtggaaatattggacatcaacgacaactcaccgcgtttcccgcggcccaactaccagcttcaggtaagcgaatcggtggcgcctggagcgcgctttcacatagagagtgcgcaggaccccgacgtgggcgccaactcagtacagacctacgagctcagccccagcgagcacttcgagctggaccttaagcccctgcaggagaacagtaaagtgcttgagctggtgctgcgtaagggcctagaccgggagcaggcagccttgcaccacctggttctcacagccgtggatgggggcatcccagcccgctcgggtacggcacagatctctgtgcgtgtcctggacactaacgacaactctcctgcctttgaccagtccacttatcgcgtccagctacgggaggactcacccccaggcacattggtggtgaagctgaatgcctcagacccggatgagggctccaatggtgagctcaggtactccttgagcagctacacgtcggaccgggagaggcagctcttcagcatagatgccagtaccggggaagtgcgagtaattggggggctggattatgaggaagcctcctcctaccagatctatgtgcaggcgactgaccggggtccagtgcccatggcaggtcactgcaaggtgctggtggacatcgtggacgtgaatgacaatgccccagaggtggtgctcacggacctgtatagcccagtgcctgagaatgctacacccaacaccattgtggccgttctcagtgtcaatgaccaagactcaggccccaaccggaaagtgagcctgggtctggaggccacactgcctttccgactgaatggctttggaaactcctatacactggtggtgagcggcccactggaccgagagcgggtggctgtctacaacatcacggtgacagccacagatgggggaataccgcagctcacatccctgcgtacactgaaggttgagatctctgacatcaatgacaatccaccaagcttcctggaggactcctattccatctacatacaggagaacaatttgccaggtgtgttgctctgtactgtgcaagccacagacccagatgaaaaggagaatgcagaggtgacctactcccttctggagagggagattcaagggctgccagtcacctcctatgtctccattaacagtgccagtggcagcctttatgctgtcaactcctttgactatgagaagtttcgggagttctttgtgactgtggaggctcaggacaaggggagcccaccactgagcagcactgtgactgccaacgtatatgtggtggacatgaatgaccatgcccctcacattctgtaccctacctcaaccaactcgtcagcagccttcgagatggtgcctcgaactgcccctgctggctacctggtcaccaaagtcatagctatggactcagactctgggcaaaatgcttggcttttttaccatctagcccagacttctgacctggacctctttaaggtagagctgcacacaggagaaattaggactaccaggaagatgggagatgagagtggtagcactttcaacctgaccgtggtggtccgagataatggagagccatcactatcagcctctgtggccattacagtagctgtggtggatagggtttccaaaatcctccctgacactcagaggcatgttaagagccctcggacatactctgaaattaccctttatctaataatagcattaagcacagtgtcttttatatttcttttgacaatcatcattttgagcatcatcaagtgctaccgctacactgcgtatggcactgcatgctgtggaggcttctgtggagtaagggaaaggtcccctgcagaactgtacaaacaagccaacaacaatattgatgccaggataccgcatggcctcaaagtgcagcctcacttcattgaagttcgagggaatggctccctcaccaagacctactgctacaaggcctgtctgacagcaggctcagggagtgacactttcatgttttacaatacaggggcccagacaggaccagggccttcgggagcccaagcagcagtgactgacagcaggaatctcacaggccaaagtggtcagaatgctgggaacctgattattctcaaaaatgaggctgtttctcaaaatgagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 172134 - DNA, 3011 bp, Homo sapiens
  Payload ID: 13825
  Gene Symbol: PCDHAC2
  Gene Name: protocadherin alpha subfamily C, 2
  Uniprot ID: Q9Y5I4
  ENST ID: ENST00000615316
  CDS Start-End: 298-2952
tgtttccttttccctccccctggagctgtagcggcagcagcagcaggaagccgagccgggttgagcgactcggaggcgagcggaggagctggaatatggggagtcagcgaggacggtggggccaggagcccttgggagggcctacggagggagcggccccaggcgctttctagagcgtgagcggtgggggagcaggcgcagggtggcacgagcggaggcggggcccgggcgtggggcacggctggggaagctgccgcctccggccctgcccggctgcctccgccgcggccagtggctatggagcaggcgggcaccagacctgcggcgacagagcatccacggctccggcggcccatgccctggctgctgctactgcctctcctgctgctgttgctgctgctgctacctggccctgcggcctcccagctgcgatactctgtgccagaggagcaggcacccggcgcgctcgtgggcaacgtggctcgcgcgctggggcttgagctgcggcgcttggggccgggttgcttgcgcatcaaccatctgggtgcgcccagtccgcgctacctggagctggacctgacgagtggagcgctcttcgtcaacgagcgcattgatcgggaggcgctgtgtgagcagcggcctcgctgcctgctcagcttggaagtgctggcgcacaaccccgtggcggtgagcgccgttgaggtggaaatattggacatcaacgacaactcaccgcgtttcccgcggcccaactaccagcttcaggtaagcgaatcggtggcgcctggagcgcgctttcacatagagagtgcgcaggaccccgacgtgggcgccaactcagtacagacctacgagctcagccccagcgagcacttcgagctggaccttaagcccctgcaggagaacagtaaagtgcttgagctggtgctgcgtaagggcctagaccgggagcaggcagccttgcaccacctggttctcacagccgtggatgggggcatcccagcccgctcgggtacggcacagatctctgtgcgtgtcctggacactaacgacaactctcctgcctttgaccagtccacttatcgcgtccagctacgggaggactcacccccaggcacattggtggtgaagctgaatgcctcagacccggatgagggctccaatggtgagctcaggtactccttgagcagctacacgtcggaccgggagaggcagctcttcagcatagatgccagtaccggggaagtgcgagtaattggggggctggattatgaggaagcctcctcctaccagatctatgtgcaggcgactgaccggggtccagtgcccatggcaggtcactgcaaggtgctggtggacatcgtggacgtgaatgacaatgccccagaggtggtgctcacggacctgtatagcccagtgcctgagaatgctacacccaacaccattgtggccgttctcagtgtcaatgaccaagactcaggccccaaccggaaagtgagcctgggtctggaggccacactgcctttccgactgaatggctttggaaactcctatacactggtggtgagcggcccactggaccgagagcgggtggctgtctacaacatcacggtgacagccacagatgggggaataccgcagctcacatccctgcgtacactgaaggttgagatctctgacatcaatgacaatccaccaagcttcctggaggactcctattccatctacatacaggagaacaatttgccaggtgtgttgctctgtactgtgcaagccacagacccagatgaaaaggagaatgcagaggtgacctactcccttctggagagggagattcaagggctgccagtcacctcctatgtctccattaacagtgccagtggcagcctttatgctgtcaactcctttgactatgagaagtttcgggagttctttgtgactgtggaggctcaggacaaggggagcccaccactgagcagcactgtgactgccaacgtatatgtggtggacatgaatgaccatgcccctcacattctgtaccctacctcaaccaactcgtcagcagccttcgagatggtgcctcgaactgcccctgctggctacctggtcaccaaagtcatagctatggactcagactctgggcaaaatgcttggcttttttaccatctagcccagacttctgacctggacctctttaaggtagagctgcacacaggagaaattaggactaccaggaagatgggagatgagagtggtagcactttcaacctgaccgtggtggtccgagataatggagagccatcactatcagcctctgtggccattacagtagctgtggtggatagggtttccaaaatcctccctgacactcagaggcatgttaagagccctcggacatactctgaaattaccctttatctaataatagcattaagcacagtgtcttttatatttcttttgacaatcatcattttgagcatcatcaagtgctaccgctacactgcgtatggcactgcatgctgtggaggcttctgtggagtaagggaaaggtcccctgcagaactgtacaaacaagccaacaacaatattgatgccaggataccgcatggcctcaaagtgcagcctcacttcattgaagttcgagggaatggctccctcaccaagacctactgctacaaggcctgtctgacagcaggctcagggagtgacactttcatgttttacaatacaggggcccagacaggaccagggccttcgggagcccaagcagcagtgactgacagcaggaatctcacaggccaaagtggtcagaatgctgggaacctgattattctcaaaaatgaggctgtttctcaaaatgaggtgagacagtggtcagggggtcttctacaaactcatgcatttgttacacatcccccaatatcctgtgatttggctttattgagtcattaacagtgacaagagttatctggtaaactgagtatatatagtatccacaatttgatcataat

SEQ ID NO: 172135 - DNA, 8210 bp, Homo sapiens
  Payload ID: 13826
  Gene Symbol: PCDHB1
  Gene Name: protocadherin beta 1
  Uniprot ID: Q9Y5F3
  ENST ID: ENST00000306549
  CDS Start-End: 337-2793
tctcattggcttctcaattcccaaggactttttttcctgaaagggaattaacaggtgagtctgttgttgctttggcaacaaactttcaacctctacctaactctccggaatgagaacatatctattaatacattcgctagactggggagttgagtcgctcaatgcaaattttctttcaagtgcaaaacagcttaatgggctcggctagcctttggtggtgctgcagttagaggctagtgaagcggagagcagctgttgcagtaacctgttgcagaaaagtgaaagtatatccgcaacagttggctctgattgcagagagcgcgcttgtgagaactgatggcgggtacgcgcagaaaatctttgcaaaacaggcaagtgggatctcttctcatttttctgtgcatatctgtgggggatgcgacaactatccgctattcagtggcagaggaaatggagagcggctcgtttgtggccaacgtagctaaggacctaggactggaggtagggaagctggctgcgcgcggggcgcggctggtttccgagggcaacaaaatgcatttccggctccaccgcaagacgggagatttgtttgtgaaggagaaactggatcgggagtcactttgtggcaaagccgacccttgtgttctgcactttgaagtagtcctggtggagccgctgcagtccttccgggccgaggtcagggtatttgatatcaatgacaatgccccagttttcctaaacaaggagccgcttttaaagattccggagagcacccctttgggttcacgttttcctctgcagagcgcccaggatctggacgtgggccttaacggtctccagaactacaccctgagtgccaatgggtatttccacctgcacacccgcttctgcagccacgggcctaaatatgctgagctggtgctgaacaaacccctggaccgagaggagcagcctgaagtcaacttgacaattacggcggtggacggcgggtccccgcctaagtctggcacagctcacatccacgtggtggttctggatgtcaacgaccacgtgccccagttctcgcgactggtgtacagagcccaggtatcagagaacagccccaatggctctttggtggccacggtgactgccgtggacctagacgagggcaccaacaaagcgataacttactctttagctcaaaacccagaagcaattctcaagacgtttcagattgaccctcaaaatggagaagttcgactaagaggacccctcgattttgaagccattgaaacatacgacattgacattcaagctacagatggtggaggcctctctgcccacagcaaagtcctggtagaagtggtggatgtgaatgacaatcctcccgaagtgatggtctcctctgtgtccagcccactccctgaagactcaccaccacagacagtagtagcccttttcactatcagagaccgggacattcgagtgggaggaaaagtcacctgcttcctcagagaagaccttccctttgtaatcaaacctacatttgggaattcttactcactggtcactgacagaagcttggatcgggaggaggtctcaggctataatatcaccattgttgccatggatactggaccacctagcttgtctgccgagactatgatagaggtgctaatatccgacgttaatgacaatcctccaatatttcgggaagattcctatatcttgactgttcgagaaaacaacagtcctgcggtttttattggcaaagtccatgctgaggatcttgatttgggtgagaatgcccaaataacatattctctgttgcctccaaaaaacggagatctttcagtctttgcttacatatccataaattcaggcaatgggaagctctacgcgctgagaaccatggattatgaggccattcaagattttcaatttgtggtaaaggcaactgatgggggcttcctgtcactgagtagccaagttactgtcagagtggttgtcctagatgacaatgacaatcgtccaatgatcttatacccactgcagaacggcaccttgccctgcaatgacctggtgcccaggtctgcagaggcaggctacctagtgaccaaagtggtggctgtggatggtgactcaggtcagaattcttggctttcatatcatctacttaaggccactgaccttgggttattttctgttcaaagacaaaatggagaaatccatacattaaggcagatatctgagagagaccccatgatgcagaaattgatcattcttgttcaggatcacggccaaccagctctttccactactgtctcactcaacatcctgctggtagatggcttttcagagccctacctgcagttccaggatccaaccaagcattctagaaaggtaaatccatccactaaatatttggtcatttctctggtcatcctttcctttctctttctcctctctgtcatagtgatcttcattatacatgtctaccaaaagattaaatatagagaaaagttcacaattcaagagcatttctatgatgactgtaatttctctaacaacctggtacaaggacaaggcaatggatccttatctcggccttgtccatatgaaatgtgttcagccactggcactggtaatagtgagtttcgctttcttaagcgttttatgcccaacttccctttccctcatgccactggggagataaaaatggaggctggctccagtttgcccccaaattctgataggaataagtctcagagattagagggccatgaccaggtatctgatgactatatgtagctcctatttacaggctcagtgagagaagagaagcaaaattttatacttggtatgcaaagatgttacatcctcattaaaacaaaaactggtagtagattgcagctttagtaaagataagagtacttagtttggtgaaaatgggaaacctagagtgaggctaggcttactcaatacaaagcagttatcctgatccccagatcatatatctataaccctttctccagttggaattctgtttaaagaaatgtcaccctctataaatgcatatgtggtaggaacttctgcttttccatctctgtgctagcaagtaatgaataagccattattcacattttccttagaagttcattggtcctggcccaggaaatacttagttccatagagagatccttttatttgcctctaaattattttccagtagaaagttatgcatgcatagggaagagaactaccttccctttttgatatattgggaagtgattaggtttgacaagcagagatatagtttattattcaggaatctctaaattcttgtccctgatgagtgattatctttgatcaataccttgcctgcaatcattcataatcataatcatggaaatgcctggtaaatggtgatcttcacaaataatcatggtgggaggaagggtggagaaagaaaaggatttcacttatttgcaaatgtgaataagggcagacataaggataaagagattcagtttaggaatgttctccaaaattaaattagatgtagttgttttttttttttttttttttttttttgagacggagtttttctcttgttgcccagactggagtgcaatggcacgatctcggctcactgcaacctctgcctcctgggttcaagcgattctcctgcctcagcctcctgagtagctaggattacaggcatgcgccaccatgcccagctaattttttggtatttttagtagagacggggtttcaccatgttggccaggctggtcatgaacttctgacctcaggtgatccaccagcctcggaaacccaaagcactgggattacaggcataagccaccacgcccagccagatttgatttcttgattgtttggagccataggcaagtctcaaatctccctcttttatatccagatgtctatccttgcagtcccagagaaaatctatttgaaaaaacggaaatggagggtgggtgaggaaaaaaataaagtatgacggctgggcaccgtggctcatggctgtaatctcagcactctgggagacggagggaggcagatcacctgaggtcaggagttcgagatcaccctggctaacatggcaaaaccctatctctactaaaaatacaaaaattagtcagtcgtggtggcacgcacctgtaatcccaggtactcaagaggctgaggctggagaatcgcttgaacctgggaggtggaggttgcagtgagctgagattgtgccactgcactccagcctgggcaacagagtgagacgctgtctcaaaaacataaaaataaatacataaatacataaatacataaggcctgctgtagttaataagtgttacagaacactctaaactattttgtgccattaagtgtacacaacatttattgtaaaccattttgtagtttgtagagcaaatataaaataaaaagacattaaaattaaaaagttcattaatactaattaagtggcattaaggaaagacacattttcaggtagtactagatttgattgtaagccattttcctctctgagtattctgaagttaacacatgcaaactgagaaaaagtggcatttttagtaaatcattcataaaatgaaatggagtggggagacaacttaagcttctctttgatcaccactgtttgatttcataagctattctgagccctctcattctaaaataagccaatgttaaaacattaacatatttcagggattctcccaacactgctaactgtgccttgaaagtcaaaagtttgctttagagaagggcatggtggctcatacctgtagtcccagctactcaggagtctgaaggaggaggattgctcaagcccaggagttcaggggtgcagtaagctatgattgcacttctgcactccagcctgggcaaaagagtgaaacctcatctcaaaaaaaaaaaaagtgtgctttaatgaggctttaattatattccttattttataaaaatgtgtgtaaattcagactcactagaatacatcctcttggtattttaagggtagagcattatcttttaaaatacttcttaaatataccaaatcatgtttattgatacaaacttcattcttggacttaatgactgatacctaatggcaccacctggctgtttacctgttggccaggaatacactaaaatttagtgctgttattttttagatgttagagatgcttagggcagaactggtgtaacctatggctgccttcaatgttaaaatgttaaagaacagatgaagcaaatgcactatatcaatgaattgcttttatttttaatattaaatattttacatacattgagttatgattccgatttagagtaaaggttttcttgcacaaaacatagaataagtgttccagtgtatttgtgttccaattggtgaaggcatgctgaaatttctatttcctttaaatgaaaaaggagatagaatttttatttatttatttattttttggagacaaagtcttgctctgtcacccaggctggagtacagtggcatgatctcggctcactgcaaactccgtctcctgggttcaagtgatcttcctgcctcagcctcctgagtagctgggactacaggtatacattaccacgcccagctaaattttgtgtttttagtagagacggggcttcgccatgttggcatttcgctatgttggccaggctggtctcgagctcctgatctcaggtgatccacccgccttggcctcccaaagtgctaggattacagcaccatgcccagcctagaattaatttttatgggtaagcaataattagttaataaaacatgcttaagtaaaagctactgtattaactgtgtttcattacacttaatgatgtgaacataatcaatggaaactggcttaatgtcaaggataggaaaagaaaatggtgtagattcatgattttaagactttgatattcaaatagcagtgaaattcatgaatacatatatacacacatacacaatggacagaagatgtagatttgtcaactttttattttttcacattaaatgagataaaatctaccacttcacgccaccattattccataaacgaaatggcattttaatataaaaatggttaagataggctgggcatggtggctcacacctgtaataccagtactttgggaggctgaggcagatggatcacaaggtcaagagatggagaccatcctggccaacatggtgaaaccatgtctctattaaaaatacaaaaattagctgggtgtggtggtatgtgcctgtagtcccagctacttgggaggctgaggcaggagaattgcttgcacccaggaggtggaggttgcagtgagctgagatcatgccactgcactccagcctggcgacaaagcaagactctgtctcaaaaaaaaaaaaaaaaaagaaaaaaagaaaaaagaaaaaaaaaggtaagataacaatctcataaaagaaaccatcctttaaatttaaaaaatgtatcgatttaataaaaaattattttgccaccatttttcttatttttgccttaggtgaaaattttgtcactctaattttattcagacttcaagttcccaagaaaattccaatcctacctgataacttaaaataagaatatatcaattcactgaatgtgaagtaggccacttgtttttggagagaactctgtacaccagctgagattaagtccaggtctctatcagcaaattaagacaaagaatggaaataattagggcaattactctctccaaagtgtcaagtgatattataactatttctatgtattcaaagctataacctaagaaccttgaaaagtgtcttgtacaaaaaggctttttattaggaaataattctagactcataaaattgcaaaaatactatagatagttcctgtatatccttcacctaacttcccggaatgctaacatcttatataaccatagtagttatcaaaattaagaaattaaccttggtataattctatgaagtaaactacagatcttattcaaatttaacagttttcccccaatgtcctttttctattcaaggatccaatccaggatcctgcaaagcatttgttatggctccttagtctctaccacctgtgacagttccttactcttaccttgtctatcatgacttgagatttttgaagagtactagccagttatttgtagaatgcccctcagtttgggattctttgttttctcattattaaactgaggtaatgcattattgggaaaaatactgcagaaatgatattgtatccttttcagtgcatcacgtcagcaggtatgtgatgccaatgtcacactactggtgatattaatcttttttcttttattgtggtaaagaacttataaaatgtaccatgttagccatttttaagtatgttagccatttttaagtaatgttaaggtgatgttaattttgatcgcttggttaacataatgtctgccacgtttctctactataaagttacttttttctctttgtaattaataaacacttgggggatatgctttgaaactatgcaaatatgatgtttctgcttaaaccaattttagtatccattgctagatatttcctgtggcaattaatattgtggcattctaatggtgattttctatttctctatttccttttacattaattaaaattcttctggaaggaaaacttgttactttcccccccacttatttagttagttatttctttacataaggatacctggatatctcctctattatttgggttacaaactaatcctatcatttactttgttgttcagcaaactcttttatctgagatgaagagcagatttttaagactggaattatccatatagaatacatttttatcaaaattagtatttctttgtaactctacatgttagattattttaaacaatcataaagtaaccccattaaggttcatgcataaagttttaactttaaatgaaaattatactaacataattttaaattagtcatacattttaaaatagatataaactgaaaattttaaaatttgttgtgcagacatgtttatatagtttaagctatatatacctgagatactatttaaaaatagacttatatgctgaaattagacttacagatatacaaaaaatggaattggtctgtctgatattatgtaattctcctaaaaataaagaatttctttatca

SEQ ID NO: 172136 - DNA, 3290 bp, Homo sapiens
  Payload ID: 13827
  Gene Symbol: PCDHB10
  Gene Name: protocadherin beta 10
  Uniprot ID: Q9UN67
  ENST ID: ENST00000239446
  CDS Start-End: 201-2603
ggatgctatgcaagtcactaataaaggaagacacggacagatgaacttaaaagagaagctttagctgccaaagattgggaaagggaaaggacaaaaaagacccctgggctacacggcgtaggtgcagggtttcctactgctgttcttttatgctgggagctgtggctgtaaccaactaggaaataacgtatgcagcagctatggctgtcagagagttgtgcttcccaagacaaaggcaagtcctgtttctttttcttttttggggagtgtccttggcaggttctgggtttggacgttattcggtgactgaggaaacagagaaaggatcctttgtggtcaatctggcaaaggatctgggactagcagagggggagctggctgcaaggggaaccagggtggtttccgatgataacaaacaatacctgctcctggattcacataccgggaatttgctcacaaatgagaaactggaccgagagaagctgtgtggccctaaagagccctgtatgctgtatttccaaattttaatggatgatccctttcagatttaccgggctgagctgagagtcagggatataaatgatcacgcgccagtatttcaggacaaagaaacagtcttaaaaatatcagaaaatacagctgaagggacagcatttagactagaaagagcacaggatccagatggaggacttaacggtatccaaaactacacgatcagccccaactcttttttccatattaacattagtggcggtgatgaaggcatgatatatccagagctagtgttggacaaagcactggatcgggaggagcagggagagctcagcttaaccctcacagcgctggatggtgggtctccatccaggtctgggacctctactgtacgcatcgttgtcttggacgtcaatgacaatgccccacagtttgcccaggctctgtatgagacccaggctccagaaaacagccccattgggttccttattgttaaggtatgggcagaagatgtagactctggagtcaacgcggaagtatcctattcattttttgatgcctcagaaaatattcgaacaacctttcaaatcaatcctttttctggggaaatctttctcagagaattgcttgattatgagttagtaaattcttacaaaataaatatacaggcaatggacggtggaggcctttctgcaagatgtagggttttagtggaagtattggacaccaatgacaatccccctgaactgatcgtatcatcattttccaactctgttgctgagaattctcctgagacgccgctggctgtttttaagattaatgacagagactctggagaaaatggaaagatggtttgctacattcaagagaatctgccattcctactaaaaccttctgtggagaatttttacatcctaattacagaaggcgcgctggacagagagatcagagccgagtacaacatcactatcaccgtcactgacttggggacacccaggctgaaaaccgagcacaacataacggtcctggtctccgacgtcaatgacaacgcccccgccttcacccaaacctcctacaccctgttcgtccgcgagaacaacagccccgccctgcacatcggcagcgtcagcgccacagacagagactcgggcaccaacgcccaggtcacctactcgctgctgccgccccaagacccgcacctgcccctcgcctccctggtctccatcaacgcggacaacggccacctgttcgccctcaggtcgctggactacgaggccctgcaggctttcgagttccgcgtgggcgccacagaccgcggctcccccgcgctgagcagagaggcgctggtgcgcgtgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggtgtgtgggcgcacaatggggaggtgcgcaccgccaggctgctgagcgagcgcgacgcagccaagcacaggctcgtggtgcttgtcaaggacaatggcgagcctcctcgctcggccaccgccacgctgcacttgctcctggtggacggcttctcccagccctacctgcctctcccggaggcggccccggcccaggcccaggccgaggccgacttgctcaccgtctacctggtggtggcgttggcctcggtgtcttcgctcttcctcctctcggtgctcctgttcgtggcggtgcggctgtgcaggaggagcagggcggcctcggtgggtcgctgctcggtgcccgagggtccttttccagggcatctggtggacgtgaggggcgctgagaccctgtcccagagctaccagtatgaggtgtgtctgacgggaggccccgggaccagtgagttcaagttcttgaaaccagttatttcggatattcaggcacagggccctgggaggaagggtgaagaaaattccaccttccgaaatagctttggatttaatattcagtaaagtctgtttttagtttcatatacttttggtgtgttacatagccatgtttctattagtttacttttaaatctcaaatttaagttattatgcaacttcaagcattattttcaagtagtatacccctgtggttttacaatgtttcatcatttttttgcattaataacaactgggtttaatttaatgagtatttttttctaaatgatagtgttaaggttttaattctttccaactgcccaaggaattaattactattatatctcattacagaaatctgaggttttgattcatttcagagcttgcatctcatgattctaatcacttctgtctatagtgtacttgctctatttaagaaggcatatctacatttccaaactcattctaacattctatatattcgtgtttgaaaaccatgtcatttatttctacatcatgtatttaaaaagaaatatttctctactactatgctcatgacaaaatgaaacaaagcatattgtgagcaatactgaacatcaataatacccttagtttatatacttattattttatctttaagcatgctacttttacttggccaatattttcttatgttaacttttgctgatgtataaaacagactatgccttataattgaaataaaattataatctgcctgaaaatgaataaaaataaaacattttgaaatgtgtg

SEQ ID NO: 172137 - DNA, 2397 bp, Homo sapiens
  Payload ID: 13827
  Gene Symbol: PCDHB10
  Gene Name: protocadherin beta 10
  ENST ID: ENST00000515856
  CDS Start-End: 1-2397
atggagattggatggatgcacaatcggagacaaaggcaagtccttgttttctttgttttgctgagcttgtctggggcgggcgccgagttggggtcctattccgtagtggaagaaacggagagaggctcttttgtggcaaatctaggaaaagacctggggttggggttgacagagatgtccacccgcaaggccaggatcatttcccaggggaacaaacagcatttgcagctcaaggctcaaactggggatttgctcataaatgagaagctagatcgagaggagctatgcggtcccactgagccttgcatactacatttccaagtgttaatggaaaaccctttagaaatatttcaggctgaactgagggtgatagatataaatgaccattctcccatgttcactgaaaaggaaatgattctaaaaattccagagaacagtcctcttggctccctgttcttactagaaagagcacaggatccagatggaggacttaacggtatccaaaactacacgatcagccccaactcttttttccatattaacattagtggcggtgatgaaggcatgatatatccagagctagtgttggacaaagcactggatcgggaggagcagggagagctcagcttaaccctcacagcgctggatggtgggtctccatccaggtctgggacctctactgtacgcatcgttgtcttggacgtcaatgacaatgccccacagtttgcccaggctctgtatgagacccaggctccagaaaacagccccattgggttccttattgttaaggtatgggcagaagatgtagactctggagtcaacgcggaagtatcctattcattttttgatgcctcagaaaatattcgaacaacctttcaaatcaatcctttttctggggaaatctttctcagagaattgcttgattatgagttagtaaattcttacaaaataaatatacaggcaatggacggtggaggcctttctgcaagatgtagggttttagtggaagtattggacaccaatgacaatccccctgaactgatcgtatcatcattttccaactctgttgctgagaattctcctgagacgccgctggctgtttttaagattaatgacagagactctggagaaaatggaaagatggtttgctacattcaagagaatctgccattcctactaaaaccttctgtggagaatttttacatcctaattacagaaggcgcgctggacagagagatcagagccgagtacaacatcactatcaccgtcactgacttggggacacccaggctgaaaaccgagcacaacataacggtcctggtctccgacgtcaatgacaacgcccccgccttcacccaaacctcctacaccctgttcgtccgcgagaacaacagccccgccctgcacatcggcagcgtcagcgccacagacagagactcgggcaccaacgcccaggtcacctactcgctgctgccgccccaagacccgcacctgcccctcgcctccctggtctccatcaacgcggacaacggccacctgttcgccctcaggtcgctggactacgaggccctgcaggctttcgagttccgcgtgggcgccacagaccgcggctcccccgcgctgagcagagaggcgctggtgcgcgtgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggtgtgtgggcgcacaatggggaggtgcgcaccgccaggctgctgagcgagcgcgacgcagccaagcacaggctcgtggtgcttgtcaaggacaatggcgagcctcctcgctcggccaccgccacgctgcacttgctcctggtggacggcttctcccagccctacctgcctctcccggaggcggccccggcccaggcccaggccgaggccgacttgctcaccgtctacctggtggtggcgttggcctcggtgtcttcgctcttcctcctctcggtgctcctgttcgtggcggtgcggctgtgcaggaggagcagggcggcctcggtgggtcgctgctcggtgcccgagggtccttttccagggcatctggtggacgtgaggggcgctgagaccctgtcccagagctaccagtatgaggtgtgtctgacgggaggccccgggaccagtgagttcaagttcttgaaaccagttatttcggatattcaggcacagggccctgggaggaagggtgaagaaaattccaccttccgaaatagctttggatttaatatt

SEQ ID NO: 172138 - DNA, 4198 bp, Homo sapiens
  Payload ID: 13828
  Gene Symbol: PCDHB11
  Gene Name: protocadherin beta 11
  Uniprot ID: Q9Y5F2
  ENST ID: ENST00000354757
  CDS Start-End: 194-2587
gatggcgttgtgaacactgatatccagtgcacacagagaatcagaagacagaaacaacaagccttcaagagggtgacctggaaaccattcaacagggttaaaatccttagaccacagaggatttggtggacaagtcagagacgcgttccgcagagctgaagcctttcttcaagaagcctacaagaaaggaactatggagaaccaagggacacgcactcagcagataaggcaagtcctgcttctctttgttttgctcggaatgtctcaggcgggctctgaaacctggagcttttctgtggcagaagaaatgcagagcgggagttttgtaggcaatctggcaaaggacctggggctgaaggtgagagaactgtcctcacggggggctcgggtggtctctaatgataagaaacagcgtttgcagctggacataaacactggggatttgctcttaagtgaaacactagacagggaggagctctgcggttccatcgagccttgcgtgctacatttgcaggtgttaatgcaaaaccccacgcagtttttacaaattgagcttcaggtcagggatataaatgatcactctcccatcttctcggaaaaacaaatgctcctagaaatcccagagaacagtcccgttggtgctgtgttcttactagaaagtgcgaaggatttagatgtaggaatcaatgctgtaaaaagctacacaataagccccaactctcattttcacattaaaatgagagtcattccagacaataggaaataccccgagttagttctggacaaggcgctggattatgaagagctcccggagctcagtttcatcctctctgctctggatggtgggtcccctcccaggtctggaactgccttggtcagggtggtggttgtggacattaatgacaactcccctgaatttgagcaggctttttatgaggtgaagattcgggagaatagcatccttggctcgctgattttgattgtctcagcttgggatttagactctggaacaaatggtgaaatatgctataccttttcccatgcctcagaagatattcgcaagacatttgaaattaatcaaaagtctggagaaattactttaagagcacctctggattttgaaacgattgagtcatactcaataatcattcaagccacagatgggggaggactttttggaaaatctacagtcataattcacgtgatagatgtaaatgacaatgctcctgaaatcactgtgtcatcaattaccagtccaatcccagaaaatacgccagagaccgtggttatggtttttagtatccaagatatagactctggggacaacggaagaattgtttgttccattccggaagacctcccattcgtgctaaaatcttcagttgagaattactacacgttggaaacagagagaccactggacagagagagcacagccgagtacaatatcaccatcaccgtcaccgacttggggatacccaggctgaaaaccgagcacaacacaactgtgttggtctctgacgtcaatgacaacgcccccaccttcacccaaacctcctacaccctgttcgtccgcgagaacaacagccccgccctgcacatcggcagtgtcagcgctacagacagagactcaggcaccaacgcccaggtcaactactcgctactcccgccccaggacctgcacctgcccctcgcctccctggtctccatcaacacagacaacggccacctgttcgccctcaggtcgctggactacgaggccctgcaggctttcgacttccgcgtgggcgccacagaccgcggctccccggctttgagcagcgaggcgctggtgcgcgtgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctattcggcgtgtgggcgcacaatggcgaggtgcgcaccgccaggctgctgagcgagcgcgacgcggccaagcacaggctggtggtgctggtcaaggacaatggcgagcctccgcgctcggccaccgccacgctgcaagtgctcctggtggacggcttctcccagccctacctgccgctccctgaggcggcaccggcccaggcccaggccgactcgctcaccgtctacttggtggtggcgttggcctcggtgtcttcgctcttcctcttctcggtgctcctgttcgtggcggtgcggctgtgcaggaggagcagggcggcctcggtgggaagctgctcggtgcctaagggcccctttccagggcatctggtggacgtgagcggcaccgggaccctttcccagagctaccagtacgaggtgtgtctgacgggaggttccgagacaaatgaattcaagttcctaaaaccggttatccctaatatccaggcaaaaggtcttgggaagaatagtgaagaaaactccacctttcgaaatagctttggatttaatttttagtaagaatgctatttacatttgcatgtacttttttagttttatgtaaccatatcaatattatttagtcttaaactagttacgttattatgcaatacgactaattgtatttttaattttttcttttctcccccaattttttttttttttttgagaccgagtctcattctgtcgccctggctggagtgcaatggtgtgatctcagctcactgcaccctccgcctctcgggttcaagcaattctcctgcatcagcctcccgagtagctggcattacaggcgcccaccaccacgctcggctaaattttttttttttttatctttagtagagacggggtttcaccacgttggccgggcaggttttaaactcttgacctcatgttccacccgccacggcctcccaaagtgctgtgattaccggtgtgagccactgcgcccggccttttttttttcttttcttttcttttttttgatacagagtcttagtcacccagactagaggtcagtggcaggatctcagctcactgcaacctctgcctcctgggctcaagagaccagcccacctccgcctccaagtagctgggactacaggcgtgcgccaccatgcccggctacttcttgtattttttgtagagacggatcgtcaccatatttcttaggctggcctttaacttctgagctcaagagatgcactcccctcagcctcccaaagtgctgggattacaggcggccaggcctattttcaattttcaagtattgcatatcattgtgaataacattgtaaatcctttttatattaagtaacaggtagttaatccatttctaatgaataattttaaggttttaatcctttccaagtgtacaataatttactgattattatttcttattctagaaaactgactttgatttttctcttaggttgttttgttttgttttgttttttgagacgatgtttcactcttgtcgcccaggctggtgtgcaatggcgtgatctcggctcactgcagtctctgcctcccgggttctcctgcctcagcctcccgagtagctgggattacaggtgcaccaccacacccagctaattttgcatttttagtagagacggggtttcaccatgttggtcaggctggtctctaactcttgatatcagtgatccgcccgcctcagcctcccaaaaagctgggattacaggcgtgagccaccgtgcccaggctcccctagtatttttcactgtctgcatcctatgatcctaaccacctgtgtattgtagtttcttcatgggagaagtcatatctgcccttccaaccttattctaacattctatttattcatttaaaaagccacatcatctagttctaaatcacagcatttaaagagaaacatttcattattaatgtgctcatggtaaattaaatattattttgtgatcaatattatacttcaatactaactttgtgcttgtattattttcttaaatatactacacttacttggctaatatttttaatgcttttgtgtgtgtatatatatatatagagagagagagagatcatggcttataatccaaacaaaatgtaataaactgcatgaaaataaataggaatattaaaaca

SEQ ID NO: 172139 - DNA, 1973 bp, Homo sapiens
  Payload ID: 13828
  Gene Symbol: PCDHB11
  Gene Name: protocadherin beta 11
  Uniprot ID: Q9Y5F2
  ENST ID: ENST00000624887
  CDS Start-End: 564-1862
gcacacagagaatcagaagacagaaacaacaagccttcaagagggtgacctggaaaccattcaacagggttaaaatccttagaccacagaggatttggtggacaagtcagagacgcgttccgcagagctgaagcctttcttcaagaagcctacaagaaaggaactatggagaaccaagggacacgcactcagcagataaggctttttatgaggtgaagattcgggagaatagcatccttggctcgctgattttgattgtctcagcttgggatttagactctggaacaaatggtgaaatatgctataccttttcccatgcctcagaagatattcgcaagacatttgaaattaatcaaaagtctggagaaattactttaagagcacctctggattttgaaacgattgagtcatactcaataatcattcaagccacagatgggggaggactttttggaaaatctacagtcataattcacgtgatagatgtaaatgacaatgctcctgaaatcactgtgtcatcaattaccagtccaatcccagaaaatacgccagagaccgtggttatggtttttagtatccaagatatagactctggggacaacggaagaattgtttgttccattccggaagacctcccattcgtgctaaaatcttcagttgagaattactacacgttggaaacagagagaccactggacagagagagcacagccgagtacaatatcaccatcaccgtcaccgacttggggatacccaggctgaaaaccgagcacaacacaactgtgttggtctctgacgtcaatgacaacgcccccaccttcacccaaacctcctacaccctgttcgtccgcgagaacaacagccccgccctgcacatcggcagtgtcagcgctacagacagagactcaggcaccaacgcccaggtcaactactcgctactcccgccccaggacctgcacctgcccctcgcctccctggtctccatcaacacagacaacggccacctgttcgccctcaggtcgctggactacgaggccctgcaggctttcgacttccgcgtgggcgccacagaccgcggctccccggctttgagcagcgaggcgctggtgcgcgtgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctattcggcgtgtgggcgcacaatggcgaggtgcgcaccgccaggctgctgagcgagcgcgacgcggccaagcacaggctggtggtgctggtcaaggacaatggcgagcctccgcgctcggccaccgccacgctgcaagtgctcctggtggacggcttctcccagccctacctgccgctccctgaggcggcaccggcccaggcccaggccgactcgctcaccgtctacttggtggtggcgttggcctcggtgtcttcgctcttcctcttctcggtgctcctgttcgtggcggtgcggctgtgcaggaggagcagggcggcctcggtgggaagctgctcggtgcctaagggcccctttccagggcatctggtggacgtgagcggcaccgggaccctttcccagagctaccagtacgaggtgtgtctgacgggaggttccgagacaaatgaattcaagttcctaaaaccggttatccctaatatccaggcaaaaggtcttgggaagaatagtgaagaaaactccacctttcgaaatagctttggatttaatttttagtaagaatgctatttacatttgcatgtacttttttagttttatgtaaccatatcaatattatttagtcttaaactagttacgttattatgcaatacgactaattgtattttt

SEQ ID NO: 172140 - DNA, 3853 bp, Homo sapiens
  Payload ID: 13829
  Gene Symbol: PCDHB12
  Gene Name: protocadherin beta 12
  Uniprot ID: Q9Y5F1
  ENST ID: ENST00000239450
  CDS Start-End: 190-2577
agtacacgcggagaactgggaagacagaaagaacaatcctttaagggagaacctagaagccattcaacaaggttaaaatcttcaggcttccgaggatttggtagacagatcagaggcacgtttcccacaactgcgaagaggcgctgaggcaattctgcaagaagattttggggttttggaaaagaagctatggaaaacggaggggcaggcactctgcagataaggcaagtcctgcttttctttgttttgctgggaatgtctcaggcgggctctgaaactgggaactttttggtgatggaggaattgcagagcgggagctttgtaggaaatttggcaaagaccctgggactcgaggtgagtgagctgtcttcgcggggggctcgggtggtttctaatgataacaaagagtgtttgcagctggacacaaacactggggatttgctcctgagagaaatgctagacagggaggagctctgtggctccaatgagccttgtgtgctgtatttccaagtgttaatgaaaaaccccacgcagtttttacaaattgagctccaggtcagggatataaatgatcactctcccgtcttcttggaaaaagaaatgctcttagaaatcccagagaacagtcctgttggtgctgtgttcttgcttgaaagtgcaaaggatttagatgtaggaatcaatgctgtaaaaagctacacaataaatccgaactctcatttccacgttaaaataagagtcaatccagacaataggaaataccctgagttagttctggacaaggcgctggattatgaagagcgcccggagctcagtttcatcctcactgctctggatggcgggtcccctcccaggtctggaactgccttggtcagggtggtggttgtagatattaatgacaactcccctgagtttgagcaggctttttatgaggtgaagattctggagaatagcatccttggctccctggttgtgaccgtctcagcctgggatttagactctggaacaaacagtgaactatcctataccttttcccatgcctcagaagatattcgcaagacatttgaaattaatcaaaagtctggtgacattactttaacagcacctttggattttgaagcaattgagtcatactcaataatcattcaagccacagatgggggaggactttttggaaaatctacagtcagaattcaggtgatggatgtaaacgacaacgctcctgaaatcactgtgtcatcaattaccagtccaatcccagaaaacactccagagactgtggttatggttttcaggatacgagacagagactctggggacaacggaaagatggtttgttctatcccggaggacatcccattcgtgctaaaatcttcggtaaataattactacactttggaaacagagagaccgctggacagagagagcagagccgagtacaacatcaccatcaccgtcaccgacttggggacccccaggctaaaaaccgagcacaacataaccgtgctggtctccgacgtcaatgacaacgcccccgccttcacccaaacttcctacgccctgttcgtccgcgagaacaacagccccgccctgcacatcggcagcatcagcgccacagacagagactcgggcaccaacgcccaggtcaactactcgctgctgccgtcccaggacccgcacctgcccctcgcctccctggtctccatcaacgcggacaacggccacctgtttgccctcaggtcgctggactacgaggccctgcaggggttccagttccgcgtgggcgccacagaccacggctccccggctttgagcagcgaggcgctggtgcgcgtgctggtgctggacgccaacgacaactcgcccttcgtgctgtacccgctgcagaacggctccgcgccctgcaccgagctggtgccctgggcggccgagccgggctacctggtgaccaaggtggtggcggtggacggtgactcgggccagaacgcctggctgtcgtaccagctgctcaaggccacggagcccgggctattcggcgtgtgggcgcacaatggcgaggtgcgcaccgccaggctgctgagcgagcgcgacgcggccaagcacaggctggtggtgctggtcaaggacaatggcgagcctccgcgctcggccaccgccacgctgcacgtgctcctggtggacggcttctcccagccctacctgcctctcccggaggcggccccggcccaggcccaggccgactcgctcactgtctacctggtggtggcgttggcctcagtgtcgtcgctcttcctcttctcggtgctcctgttcgtggcggtgcggctgtgcaggaggagcagggcggccccggtcggtcgctgctcggtgcctgagggcccctttccaggacatctggtggacgtgagtggcaccgggaccctgtcccagagctaccactatgaggtgtgtgtgactggaggctccaggtcaaataagttcaaatttctgaaaccaattatccccaacttcctaccccagagcacaggtagtgaagtcgaagaaaatcccccatttcagaataatttgggtttctgataaagaatgaaaaataaaacctgtgtttatgaatacatttataattaggaacttatcgtgaggtgcctgtaaagtagtatttttgatcacttcaaatacatactcttcaagtcaagaaataaatttctttacatagaaaaggatacagatttagtaccaagaacacttcacaaagcaggaaatgtgcatgtgtaatggtttatgtcaaacaattatgcttaatataaagtctattaagtggtaagtcttgtttgagatattttaaattgctttccattgttttcaatatttactgtgacttttgttttctgagttgattagaatgctgttcgagtatacctaccctagtttcagaagcatagattgtagtgtacctttttaaactttatttttttaaaaaaagttgttttatgaatcatacactattttcacacttttaatctcagaagaaacatatgtgacatggtattttagtaatgaccaaatagacggtcttagagattcagtaagttcactaaggtccactaactaataagtgacaaaactgagcatccatcctagatctgcctgactctaagtcagtgactttgctcccattccatactgtttttgtcattggatatcacctggcaagtttctgcctaactaaagagaagaaaagtttttatcgtattcatactactgttcaatctttatttagaaataaactttatctatgatttcattttcttataaaccagtaatcttgcttttctgggtaaattttcagctattattactaatgctctgatctgcccaaatcttaagtaaaaaacaaaattgaaagagcaacctatgccttctcattgtctcctgaacatataactatcatttcacagaaaagattaatggtcctgattaggaatagtacataattttgatggcattattagttaattattttctttacattgtagtatatttccagagtcacccatgcttacatttgtaatatattttcctgatttgagagtttgtttttagcagtttttcttacctatactgcactgctgaatcaggaaaatttaagaaaaagaatagatttaaatgtgtaatatcaaagagaaatatagatgatcattaaatttttagaaattttggggagttaaggagaagcattgtttgttaaaaatatataaccgattcttatatttaaaataggtaatttttgcatagttgtgttctaaatatattataaactagtgccagtaactctaataaagctagtattactgca

SEQ ID NO: 172141 - DNA, 1963 bp, Homo sapiens
  Payload ID: 13829
  Gene Symbol: PCDHB12
  Gene Name: protocadherin beta 12
  Uniprot ID: Q9Y5F1
  ENST ID: ENST00000624949
  CDS Start-End: 345-1721
gatgttgtagaccctgttatccagtacacgcggagaactgggaagacagaaagaacaatcctttaagggagaacctagaagccattcaacaaggttaaaatcttcaggcttccgaggatttggtagacagatcagaggcacgtttcccacaactgcgaagaggcgctgaggcaattctgcaagaagattttggggttttggaaaagaagctatggaaaacggaggggcaggcactctgcagataagcacctttggattttgaagcaattgagtcatactcaataatcattcaagccacagatgggggaggactttttggaaaatctacagtcagaattcaggtgatggatgtaaacgacaacgctcctgaaatcactgtgtcatcaattaccagtccaatcccagaaaacactccagagactgtggttatggttttcaggatacgagacagagactctggggacaacggaaagatggtttgttctatcccggaggacatcccattcgtgctaaaatcttcggtaaataattactacactttggaaacagagagaccgctggacagagagagcagagccgagtacaacatcaccatcaccgtcaccgacttggggacccccaggctaaaaaccgagcacaacataaccgtgctggtctccgacgtcaatgacaacgcccccgccttcacccaaacttcctacgccctgttcgtccgcgagaacaacagccccgccctgcacatcggcagcatcagcgccacagacagagactcgggcaccaacgcccaggtcaactactcgctgctgccgtcccaggacccgcacctgcccctcgcctccctggtctccatcaacgcggacaacggccacctgtttgccctcaggtcgctggactacgaggccctgcaggggttccagttccgcgtgggcgccacagaccacggctccccggctttgagcagcgaggcgctggtgcgcgtgctggtgctggacgccaacgacaactcgcccttcgtgctgtacccgctgcagaacggctccgcgccctgcaccgagctggtgccctgggcggccgagccgggctacctggtgaccaaggtggtggcggtggacggtgactcgggccagaacgcctggctgtcgtaccagctgctcaaggccacggagcccgggctattcggcgtgtgggcgcacaatggcgaggtgcgcaccgccaggctgctgagcgagcgcgacgcggccaagcacaggctggtggtgctggtcaaggacaatggcgagcctccgcgctcggccaccgccacgctgcacgtgctcctggtggacggcttctcccagccctacctgcctctcccggaggcggccccggcccaggcccaggccgactcgctcactgtctacctggtggtggcgttggcctcagtgtcgtcgctcttcctcttctcggtgctcctgttcgtggcggtgcggctgtgcaggaggagcagggcggccccggtcggtcgctgctcggtgcctgagggcccctttccaggacatctggtggacgtgagtggcaccgggaccctgtcccagagctaccactatgaggtgtgtgtgactggaggctccaggtcaaataagttcaaatttctgaaaccaattatccccaacttcctaccccagagcacaggtagtgaagtcgaagaaaatcccccatttcagaataatttgggtttctgataaagaatgaaaaataaaacctgtgtttatgaatacatttataattaggaacttatcgtgaggtgcctgtaaagtagtatttttgatcacttcaaatacatactcttcaagtcaagaaataaatttctttacatagaaaaggatacagatttagtaccaagaacacttcacaaagcaggaaatgtgcatgtgtaatggtttatgtcaaacaattatgcttaatataaagtctattaagtggt

SEQ ID NO: 172142 - DNA, 2093 bp, Homo sapiens
  Payload ID: 13829
  Gene Symbol: PCDHB12
  Gene Name: protocadherin beta 12
  ENST ID: ENST00000622978
  CDS Start-End: 190-393
agtacacgcggagaactgggaagacagaaagaacaatcctttaagggagaacctagaagccattcaacaaggttaaaatcttcaggcttccgaggatttggtagacagatcagaggcacgtttcccacaactgcgaagaggcgctgaggcaattctgcaagaagattttggggttttggaaaagaagctatggaaaacggaggggcaggcactctgcagataaggcaagtcctgcttttctttgttttgctgggaatgtctcaggcgggctctgaaactgggaactttttggtgatggaggaattgcagagcgggagctttgtaggaaatttggcaaagaccctgggactcgagcacctttggattttgaagcaattgagtcatactcaataatcattcaagccacagatgggggaggactttttggaaaatctacagtcagaattcaggtgatggatgtaaacgacaacgctcctgaaatcactgtgtcatcaattaccagtccaatcccagaaaacactccagagactgtggttatggttttcaggatacgagacagagactctggggacaacggaaagatggtttgttctatcccggaggacatcccattcgtgctaaaatcttcggtaaataattactacactttggaaacagagagaccgctggacagagagagcagagccgagtacaacatcaccatcaccgtcaccgacttggggacccccaggctaaaaaccgagcacaacataaccgtgctggtctccgacgtcaatgacaacgcccccgccttcacccaaacttcctacgccctgttcgtccgcgagaacaacagccccgccctgcacatcggcagcatcagcgccacagacagagactcgggcaccaacgcccaggtcaactactcgctgctgccgtcccaggacccgcacctgcccctcgcctccctggtctccatcaacgcggacaacggccacctgtttgccctcaggtcgctggactacgaggccctgcaggggttccagttccgcgtgggcgccacagaccacggctccccggctttgagcagcgaggcgctggtgcgcgtgctggtgctggacgccaacgacaactcgcccttcgtgctgtacccgctgcagaacggctccgcgccctgcaccgagctggtgccctgggcggccgagccgggctacctggtgaccaaggtggtggcggtggacggtgactcgggccagaacgcctggctgtcgtaccagctgctcaaggccacggagcccgggctattcggcgtgtgggcgcacaatggcgaggtgcgcaccgccaggctgctgagcgagcgcgacgcggccaagcacaggctggtggtgctggtcaaggacaatggcgagcctccgcgctcggccaccgccacgctgcacgtgctcctggtggacggcttctcccagccctacctgcctctcccggaggcggccccggcccaggcccaggccgactcgctcactgtctacctggtggtggcgttggcctcagtgtcgtcgctcttcctcttctcggtgctcctgttcgtggcggtgcggctgtgcaggaggagcagggcggccccggtcggtcgctgctcggtgcctgagggcccctttccaggacatctggtggacgtgagtggcaccgggaccctgtcccagagctaccactatgaggtgtgtgtgactggaggctccaggtcaaataagttcaaatttctgaaaccaattatccccaacttcctaccccagagcacaggtagtgaagtcgaagaaaatcccccatttcagaataatttgggtttctgataaagaatgaaaaataaaacctgtgtttatgaatacatttataattaggaacttatcgtgaggtgcctgtaaagtagtatttttgatcacttcaaatacatactcttcaagtcaagaaataaatttctttacatagaaaaggatacagatttagtaccaagaacacttcacaaagcaggaaatgtgcatgtgtaatggtttatgtcaaacaattatgcttaatataaagtctattaagtggtaagtcttgtttgagatatttta

SEQ ID NO: 172143 - DNA, 5061 bp, Homo sapiens
  Payload ID: 13830
  Gene Symbol: PCDHB13
  Gene Name: protocadherin beta 13
  Uniprot ID: Q9Y5F0
  ENST ID: ENST00000341948
  CDS Start-End: 206-2602
gcagctccattaaccggcaaaaagcagcagaacctggaagtccacggggagcttggatgccaaagggaggacggctgggtcctctggagaggactactcactggcatatttctgaggtatctgtagaataaccacagcctcagatactggggactttacagtcccacagaaccgtcctcccaggaagctgaatccagcaagaacaatggaggccagcgggaagctcatttgcagacaaaggcaagtccttttttcctttctccttttgggcttatctctggcgggcgcggcggaacctagaagctattctgtggtggaggaaactgagggcagctcctttgtcaccaatttagcaaaggacctgggtctggagcagagggaattctccaggcggggggttagggttgtttccagagggaacaaactacatttgcagctcaatcaggagaccgcggatttgttgctaaatgagaaattggaccgtgaggatctgtgcggtcacacagagccctgtgtgctacgtttccaagtgttgctagagagtcccttcgagttttttcaagctgagctgcaagtaatagacataaacgaccactctccagtatttctggacaaacaaatgttggtgaaagtatcagagagcagtcctcctgggactacgtttcctctgaagaatgccgaagacttagatgtaggccaaaacaatattgagaactatataatcagccccaactcctattttcgggtcctcacccgcaaacgcagtgatggcaggaaatacccagagctggtgctggacaaagcgctggaccgagaggaagaagctgagctcaggttaacactcacagcactggatggtggctctccgcccagatctggcactgctcaggtctacatcgaagtcctggatgtcaacgataatgcccctgaatttgagcagcctttctatagagtgcagatctctgaggacagtccggtaggcttcctggttgtgaaggtctctgccacggatgtagacacaggagtcaacggagagatttcctattcacttttccaagcttcagaagagattggcaaaacctttaagatcaatcccttgacaggagaaattgaactaaaaaaacaactcgatttcgaaaaacttcagtcctatgaagtcaatattgaggcaagagatgctggaaccttttctggaaaatgcaccgttctgattcaagtgatagatgtgaacgaccatgccccagaagttaccatgtctgcatttaccagcccaatacctgagaacgcgcctgaaactgtggttgcacttttcagtgtttcagatcttgattcaggagaaaatgggaaaattagttgctccattcaggaggatctacccttcctcctgaaatccgcggaaaacttttacaccctactaacggagagaccactagacagagaaagcagagcggaatacaacatcactatcactgtcactgacttggggacccctatgctgataacacagctcaatatgaccgtgctgatcgccgatgtcaatgacaacgctcccgccttcacccaaacctcctacaccctgttcgtccgcgagaacaacagccccgccctgcacatccgcagcgtcagcgctacagacagagactcaggcaccaacgcccaggtcacctactcgctgctgccgccccaggacccgcacctgcccctcacatccctggtctccatcaacgcggacaacggccacctgttcgccctcaggtctctggactacgaggccctgcaggggttccagttccgcgtgggcgcttcagaccacggctccccggcgctgagcagcgaggcgctggtgcgcgtggtggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagctcggtctgttcggcgtgtgggcgcacaatggcgaggtgcgcaccgccaggctgctgagcgagcgcgacgcggccaagcacaggctggtggtgctggtcaaggacaatggcgagcctccgcgctcggccaccgccacgctgcacgtgctcctggtggacggcttctcccagccctacctgcctctcccggaggcggccccgacccaggcccaggccgacttgctcaccgtctacctggtggtggcgttggcctcggtgtcttcgctcttcctcttttcggtgctcctgttcgtggcggtgcggctgtgtaggaggagcagggcggcctcggtgggtcgctgcttggtgcccgagggcccccttccagggcatcttgtggacatgagcggcaccaggaccctatcccagagctaccagtatgaggtgtgtctggcaggaggctcagggaccaatgagttcaagttcctgaagccgattatccccaacttccctccccagtgccctgggaaagaaatacaaggaaattctaccttccccaataactttgggttcaatattcagtgaccatagttgacttttacattccataggtattttattttgtggcatttccatgccaatgtttatttcccccaatttgtgtgtatgtaatattgtacggatttactcttgatttttctcatgttctttctccctttgttttaaagtgaacatttacctttattcctggttcttaaaaggtgacaattcattctttaacccagatggtcttaatttgtaattaatttgcctccctaaagagcaataccaaatcacatttttttcatgcccctatctttagctgaacttcacccactattatgcttatggtaaaattaaatagagcaatttggaagtgattccaattttccagcatttcttcatttgattctctttttttagtcttaaaataatgactcctattcagacatatcatttttcttttttgtaaatccagtgcgtttttagttaacctttaaatatgctttttgctttcaaaaataaaccagaaaacctatatcctatgatacaactctaagtgttatcacttgattcgaaagggtcagaagaccagttttttagtatcctttcctcattcatcctggagaggattgtgcaggcacattaatattgtgaccaatcacagaatctgggaatatgaagctataattttttaattaatgtcacaaagctctagtgcaatctagttgaatgcagatgcctgtgcccaaataataattcatatagcataaattggagttgtgtgttaatgtgtaaaaatttttgcctgtactatcatataatttaatgtatatacaccagaaactatttttcaaactttttttactgcaaccaatagttaagattatattttacatattttgaaacacacaagcttaatagaaataaatgcttgtgaacaatgcttagtctttttatgacataatttgaaattacctatatatttcattctattcaattttcaaatgtggtcatgatccactaaatttatttcatggtatactagtgggtagtaacccaaagtttgaaaaccacttttctcagacatataaaagcataccagatgttgaacattgatagtatcaaaagatagtcccttagggttctaattttaaaaaaattttcaaagcattgtaggggagtagctttgtctcatgttaaatcactcttacctttaaggatctgacacactatgtaagaaaaagacttcaaggttggaggaggagattttccatgacttttatcaaagtctacagtctatgttgtgggagaaaaatgtagaataacaaaatgagtaaaagtatagaggcaaaacaagcatgtgtatgagagagagagagaaagcatggaaaagaggaaattcatggggatgagcaaaatgactacttccagtgccacagactagactcagttgcttctcttatgttattttttgagacaaggtcctgttctgtcacccaggctggagtgcagtggtgtgatctccactcactgtgatctccactcactgcaacctccacctcctgggctcaagtgatcctcccacctcagcctccctagtacccaggactacaggcccaggccaccacacccactaatttttgcatatttagtagagacgaggtttcatcatattgcccagactggtctcgaattcctgagctcaagcagtctgcctgcctcagcctcccaaagtgctatgattacaggtatgagcacctggcctcaactacttcttgaagatattttaaaactttatcttaacattgtagagggactgggtattagtcagttgataatgccaagaagtgcaatctcttttaatagcatatctaagacaacctaatgtttatacttctgactcagatttcactactggttctgttgagctttgtcaactgagtaattattcttttcttttttctttctttgtttatgttttagagacagggtcttagtcacctaggctggagtgcagtggtgcaatcatagctcactgaagccttgacctcctgggctcaagcaatcctcctgacgcagcatcccaagtagccgggaccacaggcacatgccaccccccacagctatttttgtttgtttgtttgttttttgttttgttttgtttttgaggcagagtctcactctgtcacccaggctggagtgcagtggcgcgatctcggctcactgcaagctccgcctcctgggttcccgccattctcctgcctcagtctcccgagtagcacccccagctattttaaaaaaaatttttgtagagatgggttctcatcatgtcgcccaggctgttgaacttctggcctccaaaggtgggagttattctagcagcttccctgtgatcttctcatatctactggtggagtgggaaagagtagttcaaacaactcagacagaaaatctcgctggtgcaacagtggagagaagggccaagtacttgtcctgttact

SEQ ID NO: 172144 - DNA, 4828 bp, Homo sapiens
  Payload ID: 13831
  Gene Symbol: PCDHB14
  Gene Name: protocadherin beta 14
  Uniprot ID: Q9Y5E9
  ENST ID: ENST00000239449
  CDS Start-End: 575-2971
cagatcctttagtgccgagcattcaaaacagtgataatgcagtgtatggacttttctggattcaaattcaaacaaaccaacagcaaaggacattttggagagaactggggaaaaccaaatgcagtataaattacaccaaggaattattgctcaagttgttgattgtgaacgttttattacaattatcttttagaaggccttacctattaaaaatacttagtgaagtatttaaaggaaaaaaaatgatgtctgggatttgtttcgaatgttccggatgtatttatgaattactttttcaaagaggaaaacttttttaatgaaaaaaaaaacatggagacacatggtggcgctacaggataagacgaaaacagtacataggctggcacggtgagcttcgctattcaggagaacagaaagcatccaacccactgaaaagacaggcattaaaggagcttcgcctacagagctgctggaggatacactctccagggggttcctgttaaaaaccagagcttcagcttccaaaattacggctgagcttcagtttttccacaagagattgcctaaaggaaccatggagatcagaggggcactcgatctgcgaaaaaggcaagttctaatattccttgttttgctgggattgtctcgggcaggtactgaatctgcacactattctgtggcagaggaaacagaaattggctcttttgtggctaatctagcgagggacctagggctgggggtggaggagctgtcttcacgtgaagcccgggtagtgtctgatgataataaaaagtatttgcaccttgatttgctgactgggaatttgctcctaaatgagaaactagaccgagacgagctgtgtggctccaccgagccctgtgtgctgcattttcaggtggttttggaaaaccctttacagttttttcggtttgagctgtgtgtcaaagacataaatgatcactcccctacatttctagacaaggaaatacttattaaaatatcagaaggtaccactgttggagctacctttctaatggagagtgctcaagatttggatgtcggaagcaacagtctccaaaactacacaattagccccaattctcacttctacattaaaattcccgacagtagtgacagaaagatatacccagagctggtcctagatagagctttagattatgaacaggaagctgaactcagattaacactcacagcagtggatggtggatccccgcccaagtctgggacaactttggttctcatcaaggtgttggacatcaatgataatgcccctgagtttcctcagagtctctatgaggtgcaagtccccgaggacagaccccttggctcctggattgccaccatctcagctaaggatctggatgcaggaaactatggaaaaatatcttacacatttttccatgcatcagaagatattcgtaaaacatttgaaattaatccaatatctggggaagttaatttgagatcacccctggattttgaagtaatacagtcctacactataaatattcaggcaacagatggtgggggtctttcaggaaaatgcacccttctagttaaagttatggatataaacgacaacccaccagaagtgaccatatcgtcgattacaaagagaattccagagaatgcctcagagaccctagtagctctttttagtatcctagaccaagactctggagacaatgggaggatgatttgctctattcaagataacctcccttttttcctgaaaccgaccttcaagaactttttcactctagtttctgaaaaagcactggacagagagagccaagccgagtacaacatcacgatcaccgtcacagacttggggacacccaggctgaaaaccgagtacaacataaccgtgctgctctctgacgtcaatgacaacgcccccaccttcacccaaacctcctacaccctgttcgtccgcgagaacaacagccccgccctgcacatcggcagcgtcagcgccacagacagagactcaggcaccaacgcccaggtcaactactcgctgctgccgccccaggaccggcacctgcccctcgcctccttggtctccatcaacgcggacaatggccacctgtttgccctcaggtcgctggactacgaggccctacaggagttcgagtttcgcgtgggcgccacagaccgcgggtccccggcgttgagcagcgaggcgctggtgcgcgtgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggcgtgtgggcgcacaatggcgaggtgcgcaccgccaggctgctgagcgagcgcgacgcggccaagcacaggctggtggtgctggtcaaggacaatggcgagcctcctcgctcggccaccgccacgctgcacgtgctcctggtggacggcttctcccagccctacctgccgctccctgaggcggccccggcccaggcccaggccgactccctcaccgtctacctggtggtggcattggcctcggtgtcgtcgctcttcctcttctcggtgctcctgttcgtggcggtgcggctgtgcaggaggagcagggcggcctcggtgggtcgctgctcggtgcccgagggtccctttccagggcatctggtggacgtgagcggcaccgggaccctgtcccagagctaccaatacgaggtgtgtctgacaggaggttccgggacaaatgagttcaaatttctgaagccgattatccccaattttcaagttcatgacactggtaggaatatgggggaaatcgagaactttcgaaatagctttggacttaacattcaataaaacaatttattttaaatgtctaatttttggttattcttggcaagctgatggtactttttgcataatcttttgtggattcttggttgtactgtagttgcatgcatgattatagctcttgtttttctcacagtttctttaaaaatctttattagtggctataatgacgtggaaatgtaatctgtgttttctggtttttcatttatttggccaaaatgttatattaatggagttattgctatttttgctgtgataatggtattatgcaagaccatattctcaattatttggatatgcaaactaaagtattaagagctaatgtcattatatatgtaacttaaatctagacaccatcaaagcataaaataaaaataaaaagcgttgctgaatctgggtcgaaaatgtagtgcgtttatcccactattctctctgaaaatgttctttagaaagggtaacaaagatgctatccctccattttcagttctggagaaccttattagtttttcaaatatttactttatgatgaaacttaagtggtcacattggaaattattaatttcttaagtaattttttctgtaactgcttttgttgataatcctgttgtggaggaagagtcttataatgctctgggctttgctgtcactctttggttttcttaatttaattctatttatttatgttttttgagacagggtctcattccattgacctggctggaatgcagtggcaccatcatggctcactgccgccttgacttcctgggttcaggtgattctcctgcctcagcctcctgagtagctggatcaccagcacaggccactacggcctggctaattcttttgtattttttttgtacagatggaatcttgccatgtttcccagtctggtctggaactccttggctcaagcgatctgcccgccttagctagttttttgtttttgttttttgagacaaagtctcactttgttgtccaggctagagagtagtggcaggatcttggctcactgcagcctcgacatcctgggctcaggcaatcctcctgcttcggcctattaaatagctcaaactacaggcacccgccacgatgcctagctaaatttttgtatatgtggtagagatggagttttgccatgtggcccaggctagtctcgaactcctgaactcaagtgatccacctgctttggcctcccaacgtgctaggattacaggcatgagccattacgtctggcctagttttctttaaatacaccgtgtttactagcttaaattttgtgttgtttattactaaagcagaaaataatttagggtcttatcctgggtaaaatagccttccatcagatgagtacaaagcaagaacttcataagaaattgaaatgaagattcaaactgttaaagaaatgatttagtttcactttcctattaattattgagtaaatataaaacatcattaacactttgtggcctctctcagatgcctacaaagaaggaatgggtaggcatttatggtttatagttgcctcatcatgtaacatattatatctcagctctaaaagaaagttctatagaagattatagatagagattttgataactggaatgtagtatggatatagggctggtgtacatatacattttgaaattgctcttacaagattaaatactattatagaccagatgatgtagtaaaatggaatttcacttgccattgtgaaataggtgaaacaaattccagtttccttagatttcttccctctactttatgcaattatcactgattttatttttcgttgtaacaagtagttatttgttgtgtggatttcttaaaattgacatttaaacaataaaatcctgaaaagaa

SEQ ID NO: 172145 - DNA, 2367 bp, Homo sapiens
  Payload ID: 13831
  Gene Symbol: PCDHB14
  Gene Name: protocadherin beta 14
  Uniprot ID: Q9Y5E9
  ENST ID: ENST00000624896
  CDS Start-End: 239-2176
actgaaaagacaggcattaaaggagcttcgcctacagagctgctggaggatacactctccagggggttcctgttaaaaaccagagcttcagcttccaaaattacggctgagcttcagtttttccacaagagattgcctaaaggaaccatggagatcagaggggcactcgatctgcgaaaaagacaaggaaatacttattaaaatatcagaaggtaccactgttggagctacctttctaatggagagtgctcaagatttggatgtcggaagcaacagtctccaaaactacacaattagccccaattctcacttctacattaaaattcccgacagtagtgacagaaagatatacccagagctggtcctagatagagctttagattatgaacaggaagctgaactcagattaacactcacagcagtggatggtggatccccgcccaagtctgggacaactttggttctcatcaaggtgttggacatcaatgataatgcccctgagtttcctcagagtctctatgaggtgcaagtccccgaggacagaccccttggctcctggattgccaccatctcagctaaggatctggatgcaggaaactatggaaaaatatcttacacatttttccatgcatcagaagatattcgtaaaacatttgaaattaatccaatatctggggaagttaatttgagatcacccctggattttgaagtaatacagtcctacactataaatattcaggcaacagatggtgggggtctttcaggaaaatgcacccttctagttaaagttatggatataaacgacaacccaccagaagtgaccatatcgtcgattacaaagagaattccagagaatgcctcagagaccctagtagctctttttagtatcctagaccaagactctggagacaatgggaggatgatttgctctattcaagataacctcccttttttcctgaaaccgaccttcaagaactttttcactctagtttctgaaaaagcactggacagagagagccaagccgagtacaacatcacgatcaccgtcacagacttggggacacccaggctgaaaaccgagtacaacataaccgtgctgctctctgacgtcaatgacaacgcccccaccttcacccaaacctcctacaccctgttcgtccgcgagaacaacagccccgccctgcacatcggcagcgtcagcgccacagacagagactcaggcaccaacgcccaggtcaactactcgctgctgccgccccaggaccggcacctgcccctcgcctccttggtctccatcaacgcggacaatggccacctgtttgccctcaggtcgctggactacgaggccctacaggagttcgagtttcgcgtgggcgccacagaccgcgggtccccggcgttgagcagcgaggcgctggtgcgcgtgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggcgtgtgggcgcacaatggcgaggtgcgcaccgccaggctgctgagcgagcgcgacgcggccaagcacaggctggtggtgctggtcaaggacaatggcgagcctcctcgctcggccaccgccacgctgcacgtgctcctggtggacggcttctcccagccctacctgccgctccctgaggcggccccggcccaggcccaggccgactccctcaccgtctacctggtggtggcattggcctcggtgtcgtcgctcttcctcttctcggtgctcctgttcgtggcggtgcggctgtgcaggaggagcagggcggcctcggtgggtcgctgctcggtgcccgagggtccctttccagggcatctggtggacgtgagcggcaccgggaccctgtcccagagctaccaatacgaggtgtgtctgacaggaggttccgggacaaatgagttcaaatttctgaagccgattatccccaattttcaagttcatgacactggtaggaatatgggggaaatcgagaactttcgaaatagctttggacttaacattcaataaaacaatttattttaaatgtctaatttttggttattcttggcaagctgatggtactttttgcataatcttttgtggattcttggttgtactgtagttgcatgcatgattatagctcttgtttttctcacagtttctttaaaaatctttattagtggctataatgacgtggaaatgtaatctgtgttttctgg

SEQ ID NO: 172146 - DNA, 4017 bp, Homo sapiens
  Payload ID: 13832
  Gene Symbol: PCDHB15
  Gene Name: protocadherin beta 15
  Uniprot ID: Q9Y5E8
  ENST ID: ENST00000231173
  CDS Start-End: 231-2594
aaaaaaaggaaaaggaaaaagcccatgaaatgctactagctacttcagacctctttcagcctaagaggaaagcctgttagcagagcacggaccagtgtctccggagaatgctattctcctacatttccgaacaggttatcaacgcacagatcgatcactgcctctgtcccatcgctccctgaagtagctctgactccggttccttgaaaggggcgtgtacagaagtaaagatggagcctgcaggggagcgctttcccgaacaaaggcaagtcctgattctccttcttttactggaagtgactctggcaggctgggaaccccgtcgctattctgtgatggaggaaacagagagaggttcttttgtagccaacctggccaatgacctagggctgggagtgggggagctagccgagcggggagcccgggtagtttctgaggataacgaacaaggcttgcagcttgatctgcagaccgggcagttgatattaaatgagaagctggaccgggagaagctgtgtggccctactgagccctgtataatgcatttccaagtgttactgaaaaaacctttggaagtatttcgagctgaactactagtgacagacataaacgatcattctcctgagtttcctgaaagagaaatgaccctgaaaatcccagaaactagctcccttgggactgtgtttcctctgaaaaaagctcgggacttggacgtgggcagcaataatgttcaaaactacaatatttctcccaattctcatttccatgtttccactcgcacccgaggggatggcaggaaatacccagagctggtgctggacacagaactggatcgcgaggagcaggccgagctcagattaaccttgacagcggtggacggtggctctccaccccgatctggcaccgtccagatcctcatcttggtcttggacgccaatgacaatgccccggagtttgtgcaggcgctctacgaggtgcaggtcccagagaacagcccagtaggctccctagttgtcaaggtctctgctagggatttagacactgggacaaatggagagatatcatactccctttattacagctctcaggagatagacaaaccttttgagctaagcagcctttcaggagaaattcgactaattaaaaaactagattttgagacaatgtcttcgtatgatctagatatagaggcatctgatggcgggggactttctggaaaatgctctgtctctgttaaggtgctggatgttaacgataacttcccggaactaagtatttcatcacttaccagccctattcccgagaattctccagagacagaagtggccctgtttaggattagagaccgagactctggggaaaatggaaaaatgatttgctcaattcaggatgatgttccttttaagctaaaaccttctgttgagaatttctacaggctggtaacagaaggggcgctggacagagagaccagagccgagtacaacatcaccatcaccatcacagacttggggactccaaggctgaaaaccgagcagagcataaccgtgctggtgtcggacgtcaatgacaacgcccccgccttcacccaaacctcctacaccctgttcgtccgcgagaacaacagccccgccctgcacatcggcagtgtcagcgccacagacagagactcgggcaccaacgcccaggtcacctactcgctgctgccgccccgggacccgcacctgcccctcacctccctggtctccattaacacggacaacggccacctgttcgctctccagtcgctggactacgaggccctgcaggctttcgagttccgcgtgggcgccacagaccgcggcttcccggcgctgagcagcgaggcgctggtgcgagtgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggcgtgtgggcgcacaatggcgaggtgcgcaccgccaggctgctgagcgagcgcgacgtggccaagcacaggctagtggtgctggtcaaggacaatggcgagcctccgcgctcggccaccgccacgctgcaagtgctcctggtggacggcttctctcagccctacctgccgctcccagaggcggccccggcccaagcccaggccgactcgcttaccgtctacctggtggtggcattggcctcggtgtcttcgctcttcctcttctcggtgttcctgttcgtggcagtgcggctgtgcaggaggagcagggcggcctcagtgggtcgctgctcggtgcccgagggcccctttccagggcatctggtggacgtgagcggcaccgggaccctttcccagagctaccagtacgaggtgtgtctgacgggaggctctgaaagtaatgatttcaagttcttgaagcctatattcccaaatattgtaagccaggactctaggaggaaatcagaatttctagaataatgtaggtatctgtagctttccgaccgtctgttaattttgtcttcctcacttttcaccttagttttttttaaccctttagtaatcttgaattctacttttttttaaatttctactgttgtctttagtaatgttactcatttcctttgtctgattgttagttttcaaattattgtattattataaatattttatatcaggaaagttcatatttctgaataaattaatagtattcattcctgaagggtgatatgaaagttaaccccacctaataaacataactctaattctgaaattacctttcacactatatgacactacataagaatgtatgatttttgaagtcatattttaagttttttttatagtttttcttattcacacagcttgactttttgacaaaagtttggggtgtaatcatttcatatttatccatgtgtaatttcttccaagcttcatatttggagttttgttttttccaataaggagcaacatggataagtttaagctactcttttcaaggtcacacttgtaagcattagattttcattctaaaacacatatgtcatctcataaaaatatatctgcgtaatgtattctgtctcatgtaaattaacatagaaaagactaatgggttcttccttatctctatctaatgttatgatcctattggggggactggacaggctttctaatacccagatttactgtgtttaaggtgttcgtataaggccaatagacactaggaccaagtaatgcatctcctgcaatttcctcttttcacagcaggaaaatcttaacgagttccaaattctgggcttagaggagcttctgatggtacagtatgccaacatctacttgttttggatggcaacattgttctgattcataaggaatttgaaagaaaatacattgtagaattaatattagttaaccaaacaaaatttattaaaggatatgttggtgaaggagttgaattatttgaggaaaaaacatctgctctcttgtcaggacttttctgtctccaggagcttctcaactttgcagatactctagaatggtattgcatgcaaaataatgaccgccaagatgttcctgccctaatccccagaacctatgaatatgttatattgcaaagaaattaaggttcaaacagaattaaggttgccaatcagctaaacttaaaatagggagactctcctagataatctgggtgggtctatttcaatcagtggaaaggccataaaagcagagttgagtcttccgtgagatgaaaataaattttgtttaaggacagcagcttcagcttatgccccagaattccagcctgcccctcctaactgcctgctgtacagattttggacttgtccagccacgtttcaaaactgagtaagtcacttccttgcaataaattgattactacaca

SEQ ID NO: 172147 - DNA, 572 bp, Homo sapiens
  Payload ID: 13832
  Gene Symbol: PCDHB15
  Gene Name: protocadherin beta 15
  ENST ID: ENST00000623671
  CDS Start-End: 185-572
agacctctttcagcctaagaggaaagcctgttagcagagcacggaccagtgtctccggagaatgctattctcctacatttccgaacaggttatcaacgcacagatcgatcactgcctctgtcccatcgctccctgaagtagctctgactccggttccttgaaaggggcgtgtacagaagtaaagatggagcctgcaggggagcgctttcccgaacaaaggaaatacccagagctggtgctggacacagaactggatcgcgaggagcaggccgagctcagattaaccttgacagcggtggacggtggctctccaccccgatctggcaccgtccagatcctcatcttggtcttggacgccaatgacaatgccccggagtttgtgcaggcgctctacgaggtgcaggtcccagagaacagcccagtaggctccctagttgtcaaggtctctgctagggatttagacactgggacaaatggagagatatcatactccctttattacagctctcaggagatagacaaaccttttgagctaagcagcctttcaggagaaattcgactaattaaaaaac

SEQ ID NO: 172148 - DNA, 5001 bp, Homo sapiens
  Payload ID: 13833
  Gene Symbol: PCDHB16
  Gene Name: protocadherin beta 16
  Uniprot ID: Q9NRJ7
  ENST ID: ENST00000609684
  CDS Start-End: 1162-3492
caaagctctaagtatgctgggacagatactacaaatgaactttatgatgagcgaattaacctgatttatagtcctgtactttctctacgtgccatatccattattaaagaaatgagtctaagtaggaagtagagttaacctatagtttcatttcttgaatttcttattctctttcttcagtctttttcagttaacctacacacacacacacacacacacacacacacacacacacacacatatgtttataagtgggatgggagaacgggtacggtgataattaaaagaggtaaggtttctcttgagatgaaaatgttctaaaattgtgatggcggatgcacacctctgaatatattaaaagccattgaaatgaaaaaagggtggggggaatccaaaagtgtagcagacccaaccttgagatttgcttgtttgggaatgaattttccaataacttgaaagttgtaaaaactcacacttctcagggttaggtgtcagaaagaaaaggaagtaatttattctttaataaagcaattgttaaatactctttagaactaccactgattgcaattttgcagtgtctactcatagtgtctatataggtaccatgaaaaagatgtacttgtgaaactgttctcatgttacttcagaaaaattttgcttctaagtgtgtattctatgtctggttaaatgttcattgaattttatttaatcattaatctcaacagcattaaacagtcaataacataaatgacagtcttctctttgtactcctccctgtacaacatcacagagctccatctgtatacacgaaagtcacatgaaaatagaactcagtgttttgtattacatagtctattcagtacatttagaagtattttgcctccaatattcaaccacagtaaaagactcagtgagaacgcgtggtggcgctgcaggttaagatgacggaaaatacaactgcctacgcagctccaggatccagcaaaccgtttcccaaagcctggaagcagaagaatagctgagccagagcgaacgtgagtgtgaaacctctttaagacaccgttgggctgcttggttctgacattctggactgcaaaacagttctactaggatcctggggatacatgaagcttctgtgaaccaacttttcaagaaaaagcaatggagattggatggatgcacaatcggagacaaaggcaagtccttgttttctttgttttgctgagcttgtctggggcgggcgccgagttggggtcctattccgtagtggaagaaacggagagaggctcttttgtggcaaatctaggaaaagacctggggttggggttgacagagatgtccacccgcaaggccaggatcatttcccaggggaacaaacagcatttgcagctcaaggctcaaactggggatttgctcataaatgagaagctagatcgagaggagctatgcggtcccactgagccttgcatactacatttccaagtgttaatggaaaaccctttagaaatatttcaggctgaactgagggtgatagatataaatgaccattctcccatgttcactgaaaaggaaatgattctaaaaataccggaaaacagtcctctaggaactgagttccctctgaatcatgctttggacttggacgtaggaagcaataatgttcaaaactataaaatcagcccaagctctcatttccgggttctaatccatgaattcagagatggcaggaaataccctgagctagtgttggataaagagctggatcgggaggaggagcctcaactaagattaaccctgacagcgctggatggtggctctccaccgcgatctggaactgctcaggtccgtattgaagtggtggacatcaatgataacgctcctgagtttgagcagcccatctacaaagtgcagattccagagaacagtcctcttggctccctggttgccaccgtctccgccagggatttagacggcggagccaatggaaaaatatcatacacactctttcagccttcggaggatattagtaaaactttggaggtaaatcctatgacaggggaagttcgactgagaaagcaagtagatttcgaaatggttacgtcttatgaagtgcgcatcaaagccacagatgggggaggtctttcaggaaagtgcactcttctcctgcaggtggtggacgtgaatgacaatcccccacaggtgaccatgtctgcactcaccagccccatcccagagaactcgcctgagatagtagttgctgttttcagcgtttcagatcctgactccggaaacaatgggaagacgatttcctccatccaggaagaccttccctttcttctaaaaccttcagtcaagaacttttacaccttggtaacggagagagcactcgacagagaagcaagagctgaatataatatcaccctcaccgtcacagatatggggactccaaggctgaaaacggagcacaacataacagtgcagatatcagatgtcaatgataacgcccccactttcacccaaacctcctacaccctgttcgtccgcgagaacaacagccccgccctgcacatcggcagcgtcagcgccacagacagagactcgggcaccaacgcccaggtcacctactcgctgctgccgccccaagacccgcacctgcccctcgcctccctggtctccatcaacgcggacaacggccacctgttcgccctcaggtcgctggactacgaggccctgcaggctttcgagttccgcgtgggcgccacagaccgcggctcccccgcgctgagcagagaggcgctggtgcgcgtgctggtgctggacgccaacgacaactcgcccttcgtgctgtacccgctgcagaacggctccgcgccctgcactgagctggtgccccgggcggccgagccgggctacctggtgaccaaggtggtggcggtggacggcgactcgggccagaatgcctggctgtcgtaccagctgctcaaggccacggagcccgggctgttcggtgtgtgggcgcacaatggcgaggtgcgcaccgccaggctgctgagcgagcgcgacgcagccaagcagaggctggtggtgctggtcaaggacaatggcgagcctccgcgctcggccaccgccacgctgcacgtgctcctggtggacggcttctcccagcccttcctgccgctcccagaggcggcccccggccagacccaggccaactcgctcactgtctacctggtggtggcgttggcctcggtgtcgtcgctcttcctcttttcggtgctcctgttcgtggcggtgcggctgtgcaggaggagcagggcggcctcggtgggccgctgctcgatgcctgagggcccctttccagggcgtctggtggacgtaagcggcaccgggaccctgtcccagagctaccaatacgaggtgtgtctgacaggaggctcagaaacaagtgagttcaagttcctgaagccgattatccccaacttctctccttagggcactaggaaagaaatagattaaaattccacccttcacaatagctttggatttaattattgataggaacccatttgataaattccttaacttcttatgattgtcttgttgattaaattgttcatgctcaccaccaccaataaggtatttttctctgattgttagttcaaattatattgttaattccagtttcccttttcctcatatttaccccgaagaggtgttgcatatagaatcccaattaacaaaatatactttatcttcaaagttgatgtcatttaaaatttttccgtctttatattttatttacttcctattcattttttgctccatttttcatgttacttctcagtttcctagaacttcaagtattaaaataacctgttgcatgtattaggcatatttcctatgttacatttcttttgtctattttcctttcaaaattggtatttttgttgggctcaattttcattataatacttttcttaaagtttctttctttcttttcttttctttctttttttttttttcctttttgagacagggtcttactcttgtcacccaggctggagtgcagtggtacaatcttggctcactgcaacctctgcctcctgggcccaacggatccttccacctcagcctcccaagtagcttggactataggtgcatgccaccatgcctggctaatcttttgcagcgatgggattttgccaagttgcccaggctgatcttgaactcctgggctcaagccatcctccctcctcagcctcccaaaattctgggattacaggcataagccaatgtgcccatccaaagttttatttatttatttttttgagatggagtctcgtaaagttacctttaaaaaaaaagttctattttccctgtattggtatctccttaaataaaataaaatattcctattgtaagtgatatgagaaatctttaaccagccttatctaaaaataaaaagagaagccattgtaagacattcagtatgtgtaaatgtgtttgtgtttgtagacaaaaggcaaaggtattatgtaaaaatatttaataatttattctttctattactgaattaaaaaatcagaggtccctgttatatttttaatggctaacaactcaatctcattaagttggaaaaaaaacttatcaaagagacatttacatggtttggcttttatattcatcatagtatacattggcggtatctagccctttctctgtaaaatatccctatgtttaatctgtatttcttgcttattatatgtaaagttgagcttctttctagatattaggcctttgaataaaattctatgtgagtcagatttaataatttgttttcactttcaatagtgttaggataggtgttagtttgatctgttctttacctccgcttatttggttcagagaaattagggcctactagatttccactaaaagggacttgaaaataaaggtcagtcccttctttaattctgcaagttactttaaagctaatctaag

SEQ ID NO: 172149 - DNA, 894 bp, Homo sapiens
  Payload ID: 13833
  Gene Symbol: PCDHB16
  Gene Name: protocadherin beta 16
  ENST ID: ENST00000625044
  CDS Start-End: 229-894
aagcagaagaatagctgagccagagcgaacgtgagtgtgaaacctctttaagacaccgttgggctgcttggttctgacattctggactgcaaaacagttctactaggatcctggggatacatgaagcttctgtgaaccaacttttcaagaaaaagcaatggagattggatggatgcacaatcggagacaaaggtggtggacgtgaatgacaatcccccacaggtgaccatgtctgcactcaccagccccatcccagagaactcgcctgagatagtagttgctgttttcagcgtttcagatcctgactccggaaacaatgggaagacgatttcctccatccaggaagaccttccctttcttctaaaaccttcagtcaagaacttttacaccttggtaacggagagagcactcgacagagaagcaagagctgaatataatatcaccctcaccgtcacagatatggggactccaaggctgaaaacggagcacaacataacagtgcagatatcagatgtcaatgataacgcccccactttcacccaaacctcctacaccctgttcgtccgcgagaacaacagccccgccctgcacatcggcagcgtcagcgccacagacagagactcgggcaccaacgcccaggtcacctactcgctgctgccgccccaagacccgcacctgcccctcgcctccctggtctccatcaacgcggacaacggccacctgttcgccctcaggtcgctggactacgaggccctgcaggctttcgagttccgcgtgggcgccacagaccgcggctcccccgcgctgagcagagaggcgctggtgcgcgtgctggtgctggacgccaacgacaactcgcccttcgtgctgtacccgctgcagaacggctccgcg

SEQ ID NO: 172150 - DNA, 4126 bp, Homo sapiens
  Payload ID: 13834
  Gene Symbol: PCDHB2
  Gene Name: protocadherin beta 2
  Uniprot ID: Q9Y5E7
  ENST ID: ENST00000194155
  CDS Start-End: 214-2610
agcagaaacaaagcacccagccgacgctcccttacccagatactcagctaaagaagcagcaagcaggaagaggaggctttctaaggcggtcgctccgggaaatccgggccctaggattgtccactcatcccagtatcagcgagatacggggagatagagttagcgacaacgtgagccagagctggagcacgtttggtgagagaccagaaagcaatggaggccggagaggggaaggagcgcgttccgaaacaaaggcaagtcctgatattctttgttttgctgggcatagctcaggctagttgccagcctaggcactattcagtggccgaggaaacggagagtggctcctttgtggccaatttgttaaaagacctggggctggagataggagaacttgctgtgaggggggccagggtcgtttccaaaggaaaaaaaatgcatttgcagttcgataggcagaccggggatttgttgttaaatgagaaattggaccgggaggagctgtgcggccccacagagccctgtgtcctacctttccaggtgttactagaaaatcccttgcagttttttcaggcggagctacggattagggacgtaaatgatcattccccagttttcctagacaaagaaatacttttgaaaattccagaaagtatcactcctggaactactttcttaatagaacgtgcccaggacttggatgtaggaaccaacagtctccaaaattacacaatcagtcccaatttccactttcatcttaatttacaagacagtctcgatggcataatattaccacagctggtgctgaacagagccctggatcgcgaggagcagcctgagatcaggttaaccctcacagcgctagatggcgggagtccacccaggtccggcacggccctggtacggattgaagttgtggacatcaatgacaacgtcccagagtttgcaaagctgctctatgaggtgcagatcccggaggacagccccgttggatcccaggttgccatcgtctctgccagggatttagacattggaactaatggagaaatatcttatgcattttcccaagcatctgaagacattcgcaaaacgtttcgattaagtgcaaaatcgggagaactgcttttaagacagaaactggatttcgaatccatccagacatacacagtaaatattcaggcgacagatggtgggggcctatctggaacttgtgtggtatttgtccaagtgatggatttgaatgacaatcctccggaactaactatgtcgacacttatcaatcagatcccagaaaacttgcaggacaccctcattgctgtattcagcgtttcagatcctgactccggagacaacggaaggatggtgtgctccatccaagatgatcttccttttttcttgaaaccttctgttgagaacttttacactctggtgataagcacggccctggaccgggagaccagatccgaatacaacatcaccatcaccgtcaccgacttcgggacacccaggctgaaaaccgagcacaacataaccgtgctggtctccgacgtcaatgacaacgcccccgccttcacccaaacctcctacaccctgttcgtccgcgagaacaacagccccgccctgcacatcggcagcgtcagcgccacagacagagactcgggcaccaacgcccaggtcacctactcgctgctgccgccccaggacccgcacctgcccctcgcctccctggtctccatcaacgcggacaacggccacctgttcgctctccagtcgctggactacgaggccctgcaggcgttcgagttccgcgtgggcgccgcagaccgcggctccccggcgttgagcagcgaggcgctggtgcgcgtgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggcgtgtgggcgcacaatggcgaggtgcgcaccgccaggctgctgagggagcgcgacgctgccaagcagaggctggtggtgctggtcaaggacaatggcgagcctccgcgctcggccaccgccacgctgcacgtgctcctggtggacggcttctcccagccctacctgctgctcccggaggcggcaccggcccaggcccaggccgacttgctcaccgtctacctggtggtggcgttggcctcggtgtcttcgctcttcctcttctcggtgctcctgttcgtggcggtgcggctgtgcaggaggagcagggcggcctcggtgggtcgctgctcggtgcccgagggcccctttccagggcagatggtggacgtgagcggcaccgggaccctgtcccagagctaccagtacgaggtgtgtctgactggaggctccgggacaaatgagttcaagttcctgaagccaattatccccaacttcgttgctcagggtgcagagagggttagcgaggcaaatcccagtttcaggaagagctttgaattcacttaagtgttaataaggatctactgaggctagtctcgtttaatttgtggaaagtccttttttactgctttgcccattggaggtgtctccttttattagaaagtaaccatcttattccaattctatgcatgttactggtatttataaatgtatgagtttttttgcggtataataaatgtaaattttctttgtattctaattgttggttagtttcattgcaatttaattgcatttaaagtgtaaaagtaaattttgtattttcagaaatctttaagttagagcatcttttccagacctcacagtctatggtcctagataattttgaagtcctacatttgaaaatatttgttatcattacatgagttatattttccagcccagaatatttgtgttttttatatcctcttaggctagtgtaaattctatcctgtgaattcacattggctaaccctttaaataggtatatttatgaataatatagcaagcaccgtccttacgtttttcaatatatgtaatttttttttttttttgagatggagttttgcacttgttgctcaggctgtagtggagtgcaatggcgcaatctcggctcgccgcaacctctgcctcccgggttcaagcgattctcctgcctcagcctcccaagtagctgggattacaggcatgcatcattatgcccggctaattttgtatttttagtagagacagggtgtctccatgttggtcaggttggtcttgaactcctgaccttaggtgatctgcccacctcagcctcccaaagtgctgggattacaggcgtgagccaccgccccccagtccaatatgtatacttctttcaagtgttgacatatgaaaagtattagtctttagagattgtaagaattttaactgttggattctacaaggcactaacatcataagtgctctaataaatttttgtcaaaagtcaatcattaatattcaaaaatgtagataaataatacatgtctagcaattttcaaaggcatgctaattcatcatgctttctctttcaaatagtttttttaagagccctctgcttattccagtccccccctttaaaatcttttaaaattattaataacctattaactttgagcacttcattaaaatccaaaaaatttgagggagtacatgtctttgtcctttacctttagaaccctcaaacatagcttggtattgctgtttttaaaattttctggagcatttaggattcacttagaaacaagcctttagggagaaaaatttatctagcaccactcactctatttttttgcactgactacttctatttttccccctttcatttccctagacttttcaatgcttttttataaaggtgcttgagttctgtttctcaacagctccctcatttattgaatgattcacacagtcactggaatattataggctcttaataaaatttttgaatgattgaaagagagaaaagtattttacctgtgatatattgatatttaaataaactagaacacttaaaggaaaa

SEQ ID NO: 172151 - DNA, 2231 bp, Homo sapiens
  Payload ID: 13834
  Gene Symbol: PCDHB2
  Gene Name: protocadherin beta 2
  ENST ID: ENST00000622947
  CDS Start-End: 186-305
cccttacccagatactcagctaaagaagcagcaagcaggaagaggaggctttctaaggcggtcgctccgggaaatccgggccctaggattgtccactcatcccagtatcagcgagatacggggagatagagttagcgacaacgtgagccagagctggagcacgtttggtgagagaccagaaagcaatggaggccggagaggggaaggagcgcgttccgaaacaaagaacgtgcccaggacttggatgtaggaaccaacagtctccaaaattacacaatcagtcccaatttccactttcatcttaatttacaagacagtctcgatggcataatattaccacagctggtgctgaacagagccctggatcgcgaggagcagcctgagatcaggttaaccctcacagcgctagatggcgggagtccacccaggtccggcacggccctggtacggattgaagttgtggacatcaatgacaacgtcccagagtttgcaaagctgctctatgaggtgcagatcccggaggacagccccgttggatcccaggttgccatcgtctctgccagggatttagacattggaactaatggagaaatatcttatgcattttcccaagcatctgaagacattcgcaaaacgtttcgattaagtgcaaaatcgggagaactgcttttaagacagaaactggatttcgaatccatccagacatacacagtaaatattcaggcgacagatggtgggggcctatctggaacttgtgtggtatttgtccaagtgatggatttgaatgacaatcctccggaactaactatgtcgacacttatcaatcagatcccagaaaacttgcaggacaccctcattgctgtattcagcgtttcagatcctgactccggagacaacggaaggatggtgtgctccatccaagatgatcttccttttttcttgaaaccttctgttgagaacttttacactctggtgataagcacggccctggaccgggagaccagatccgaatacaacatcaccatcaccgtcaccgacttcgggacacccaggctgaaaaccgagcacaacataaccgtgctggtctccgacgtcaatgacaacgcccccgccttcacccaaacctcctacaccctgttcgtccgcgagaacaacagccccgccctgcacatcggcagcgtcagcgccacagacagagactcgggcaccaacgcccaggtcacctactcgctgctgccgccccaggacccgcacctgcccctcgcctccctggtctccatcaacgcggacaacggccacctgttcgctctccagtcgctggactacgaggccctgcaggcgttcgagttccgcgtgggcgccgcagaccgcggctccccggcgttgagcagcgaggcgctggtgcgcgtgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggcgtgtgggcgcacaatggcgaggtgcgcaccgccaggctgctgagggagcgcgacgctgccaagcagaggctggtggtgctggtcaaggacaatggcgagcctccgcgctcggccaccgccacgctgcacgtgctcctggtggacggcttctcccagccctacctgctgctcccggaggcggcaccggcccaggcccaggccgacttgctcaccgtctacctggtggtggcgttggcctcggtgtcttcgctcttcctcttctcggtgctcctgttcgtggcggtgcggctgtgcaggaggagcagggcggcctcggtgggtcgctgctcggtgcccgagggcccctttccagggcagatggtggacgtgagcggcaccgggaccctgtcccagagctaccagtacgaggtgtgtctgactggaggctccgggacaaatgagttcaagttcctgaagccaattatccccaacttcgttgctcagggtgcagagagggttagcgaggcaaatcccagtttcaggaagagctttgaattcacttaagtgttaataaggatctactgaggctagtctcgtttaatttgtggaaagtccttttttactgctttgcccattggagg

SEQ ID NO: 172152 - DNA, 565 bp, Homo sapiens
  Payload ID: 13834
  Gene Symbol: PCDHB2
  Gene Name: protocadherin beta 2
  ENST ID: ENST00000624874
  CDS Start-End: 170-322
cagctaaagaagcagcaagcaggaagaggaggctttctaaggcggtcgctccgggaaatccgggccctaggattgtccactcatcccagtatcagcgagatacggggagatagagttagcgacaacgtgagccagagctggagcacgtttggtgagagaccagaaagcaatggaggccggagaggggaaggagcgcgttccgaaacaaagaaagtatcactcctggaactactttcttaatagaacgtgcccaggacttggatgtaggaaccaacagtctccaaaattacacaatcagtcccaatttccactttcatcttaatttacaagacagtctcgatggcataatattaccacagctggtgctgaacagagccctggatcgcgaggagcagcctgagatcaggttaaccctcacagcgctagatggcgggagtccacccaggtccggcacggccctggtacggattgaagttgtggacatcaatgacaacgtcccagagtttgcaaagctgctctatgaggtgcagatcccggaggacagccccgttggatcccaggttgc

SEQ ID NO: 172153 - DNA, 519 bp, Homo sapiens
  Payload ID: 13834
  Gene Symbol: PCDHB2
  Gene Name: protocadherin beta 2
  ENST ID: ENST00000625033
  CDS Start-End: 165-275
aaagaagcagcaagcaggaagaggaggctttctaaggcggtcgctccgggaaatccgggccctaggattgtccactcatcccagtatcagcgagatacggggagatagagttagcgacaacgtgagccagagctggagcacgtttggtgagagaccagaaagcaatggaggccggagaggggaaggagcgcgttccgaaacaaagacagtctcgatggcataatattaccacagctggtgctgaacagagccctggatcgcgaggagcagcctgagatcaggttaaccctcacagcgctagatggcgggagtccacccaggtccggcacggccctggtacggattgaagttgtggacatcaatgacaacgtcccagagtttgcaaagctgctctatgaggtgcagatcccggaggacagccccgttggatcccaggttgccatcgtctctgccagggatttagacattggaactaatggagaaatatcttatgcattttcccaagcatctgaagacatt

SEQ ID NO: 172154 - DNA, 162 bp, Homo sapiens
  Payload ID: 13834
  Gene Symbol: PCDHB2
  Gene Name: protocadherin beta 2
  ENST ID: ENST00000624994
  CDS Start-End: 1-162
caggcccaggccgacttgctcaccgtctacctgatggtggacgtgagcggcaccgggaccctgtcccagagctaccagtacgaggtgtgtctgactggaggctccgggacaaatgagttcaagttcctgaagccaattatccccaacttcgttgctcagggt

SEQ ID NO: 172155 - DNA, 3355 bp, Homo sapiens
  Payload ID: 13835
  Gene Symbol: PCDHB3
  Gene Name: protocadherin beta 3
  Uniprot ID: Q9Y5E6
  ENST ID: ENST00000231130
  CDS Start-End: 178-2568
agtgtggtaaaccagcggttgagagcccaggcagatttttgagccagcaagtctgagcctctggaaaggcttattcactaggccgtctacaaaggttgtggggcaaaagactgtttcccagctctgtctgaggttcagcttggcgacattccctggaagagcgtgacggaaagtgcaatggaggcgggaggagagcgatttcttagacaaaggcaagtcttgcttctctttgtttttctgggagggtctctggctgggtccgagtcaagacgctattctgtggctgaggaaaaagagaagggctttttaatagccaacctagcaaaggatctgggactaagggtagaggaactggccgcgaggggggcccaagttgtgtccaaagggaacaaacagcattttcagctcagtcatcagacaggtgatttgctcctgaatgagaaattggaccgggaggagctatgcggccccacagaaccatgcatactacattttcagatattactgcaaaaccctttgcaattcgttacaaacgagctccgtatcatagatgtaaatgaccattctccggtattctttgaaaatgaaatgcatctgaaaatcctagaaagcactctgccaggaacagtaattcctttgggaaatgctgaggacttggatgtgggaagaaacagcctccaaaactacactatcactccgaattcccacttccacgtactcactcgcagtcgtagggacggaaggaagtacccggaactagtactggataaagcgctcgatccggaggagcagccggaactcagcttaacgctcaccgcgctggacggcggctctccccctcggtctgggacagcccagataaacatccaggtcttagatataaacgacaatgcaccagaatttgcacagccgctctatgaggttgcagttctagagaatacccccgttaactctgtcattgtcactgtctcggcttctgacttagatacaggaagttttgggacaatatcatatgcattttttcatgcttctgaagaaattcgcaaaacttttcagctaaatccaattactggtgatatgcaactggtcaaatatttgaattttgaagcgattaatagttatgaagtcgacatcgaggccaaggatggcggaggcctatccggaaagtctacagtcatagtccaggtggttgatgtcaacgacaacccaccggaactgaccttgtcttcagtaaacagccctattcctgagaactcgggagagactgtactggctgttttcagtgtttctgatctagactctggagacaacggaagagtgatgtgttccattgagaacaatctccccttcttcctgaaaccatctgtagagaatttttacaccctagtgtcagaaggcgcgctggacagagagaccagatccgagtacaacattaccatcactatcactgacctggggacacccaggctgaaaaccaagtacaacataaccgtgctggtctccgacgtcaatgacaacgcccccgccttcacccaaatctcctacaccctgttcgtccgcgagaacaacagccccgccctgcacatcggcagtgtcagcgccacagacagagactcaggcaccaacgcccaggtaacctactcgctgctgccgccccaggacccgcacctgcccctctcttccctggtctccatcaacgcggacaacggccacctgtttgccctcaggtcgctggactacgaggccctgcaggcgttcgagttccgcgtgggcgccacagaccgtggctccccggctttgagcagcgaggcgctggtgcgcgtgctggtgctggacgccaacgacaactcgcccttcgtgctgtacccgctgcagaacggctccgcgccctgcaccgagctggtgccccgggcggctgagccgggctacctggtgaccaaggtggtggcggtggacggcgactcgggccagaacgcctggctgtcgtaccagctgctcaaggccacggagcccgggctgttcggcgtgtgggcgcacaatggcgaagtgcgcaccgccaggctgctgagcgagcgcgacgcggccaagcacaggctggtggtgctggtcaaggacaatggcgagcctccgcgctcggccaccgccacgctgcatgtgctcctggtggacggcttctcccagccctacctgcctctcccggaggcggcaccggcccaggcccaggccgacttgctcaccgtctacctggtggtggcattggcctcggtgtcttcgctcttcctcttttcggtgctcctgttcgtggcggtgcggctgtgcaggaggagcagggcggcctcggtgggtcgctgctcggtgcccgagggcccctttccagggcagatggtggacgtgagcggcaccgggaccctgtcccagagctaccagtacgaggtgtgtctgactggaggctccgggacaaatgagttcaagttcctgaagccaattatccccaacttcgttgctcagggtgcagagagggttagcgaggcaaatcccagtttcaggaagagctttgaattcagttaagtgttaataaggatctactgagcctcgtcttagttaatctgtggaaagtccttttttactgctttgtccattggagaggtcttttttggtctggttcaaggcaagtagcaagaatagagcaaaatatcaaatccagggatggcttaggtttcattaacagtactggaaagtagttgtgtggctctgaatgttttgtatttcaatcgagaatccttagtcgatagaacattttgtttatatattgattctactttttctgtagttaatccttgcatattctcctttcatcctggcttgccaacgcagtcttaattccgccttttttttttctaatggggagcaaaaagaaattcactgtcttttaatagtgatttcaaatagcttattaaaataactccattcaaattttacattataaagcaatgtagagagagttccaaaccaccaattttataatttcccttgttgaatatattcatataatgtgttctataatatgcccaaagcagctttgtctatagttaacaaagttttaaggatagacaagaatgtgttttctttaataaatagtaatatatcatctttttagggatatagtactcaaatgaaagtaatttagttcattttctgtgttgacatttgcaattaatatttcaatattttatgtgcttatattggccaaaatatggacacaaatatagactaatatgggtaattaccctttggtttatctaaagtgtgttcatgatgactgaggaaaaaaattaaacctatgccatttaaaaaa

SEQ ID NO: 172156 - DNA, 162 bp, Homo sapiens; identical to SEQ ID NO: 172154
  Payload ID: 13835
  Gene Symbol: PCDHB3
  Gene Name: protocadherin beta 3
  ENST ID: ENST00000624513
  CDS Start-End: 1-162

SEQ ID NO: 172157 - DNA, 3825 bp, Homo sapiens
  Payload ID: 13836
  Gene Symbol: PCDHB4
  Gene Name: protocadherin beta 4
  Uniprot ID: Q9Y5E5
  ENST ID: ENST00000194152
  CDS Start-End: 201-2588
gctagacgcaatcaaaaacacacggaagaagcgttacaagcagtgcaggtttaccaacggcttggggcagcgatatactaaacaaatttaatattaaaagcaactgtgtgacgattcctccaagcaagaaattggaattgaatgtctcaagtctcgttgcggttgctgaggggattggatatagggacctggactccaacatgaagaagctagggagaattcatccaaacaggcaagtgttggcctttattttgatggtgttcttgtctcaggttcgcctcgagcctattcgttattctgtgttggaggaaacagagagcggctcctttgtagcccatctggccaaggatctgggcctgggaattggggaactggcctcccggtcagcccgggtgctgtctgacgatgacaagcagcgtttgcagctggatcgtcagactggagatttgcttctgagggagaaactagaccgggaagagctctgtggtcctattgaaccgtgtgtactgcatttccaagtgttcctggaaatgccggtgcaattttttcaaggagaattattgatccaggacataaatgatcactctccaatattccctgaaagggaagtgctcttgaaaatactagaaaatagccagccgggtactctatttccgttgctaatagctgaggatttggatgtgggcagcaatggtcttcaaaaatacacaatcagccccaattctcattttcacattctcactcgaaatcatagtgagggcaagaaatacccagatttggtgcaggacaaaccactggatcgagaggagcagcctgagttcagcttaaccctcgtggcgctggatggtgggtcaccacctaggtctggcacggtcatggttcgaatcctgatcatggacatcaatgacaatgctcctgagtttgtgcacactccatatggggtgcaggtcctggaaaacagccccctagactctccaattgttagggtcttagctagagatatagatgctggaaacttcgggagtgtttcttatggcttattccaagcatcagatgaaattaaacaaactttctcaataaatgaagtcacgggagaaatactgttgaaaaaaaaattggatttcgaaaaaattaaatcttaccatgtagaaattgaggccacagatggaggaggcctttctggaaaaggcactgtagtcatagaggtggtggatgtgaatgacaatcccccagaacttatcatatcttcactcaccagctccatcccagaaaatgctcctgagacggtagtctctatcttccgaattcgagatagagattccggagaaaatggaaagatgatttgctctattccagataatctaccgtttattctaaaaccaactttgaagaatttttacaccctggtaacagagagaccactggaccgagagaccagcgctgagtacaacatcaccatcgccgtcactgacttggggacacccaggctgaaaacccagcagaacataaccgtgcaggtctccgacgtcaatgacaacgcccccgccttcacccaaacctcctacaccctgttcgtccgcgagaacaacagccccgccctgcacatcggcagtgtcagcgccacagacagagactcgggcaccaacgcccaggtcacctactcgctgctgccgccccaggacccgcacctgcccctcgcctccctggtctccatcaacgcagacaacggccacctgttcgccctcaggtcgctggactacgaggccctgcaggcgttcgagttccgcgtgggcgcctcagaccgcggttctccggctttgagcagcgaggcgctggtgcgcgtgctggtgctggacaccaacgacaactcgcccttcgtgctgtacccgctgcagaatggctccgcgccctgcaccgagctggtgccccgggcggccgagccgggctacctggtgaccaaggtggtggcggtggacggcgactcgggccagaacgcctggctgtcgtaccagctgctcaaggccacggagcctgggctgttcggcgtgtgggcgcacaatggcgaggtgcgcaccgccaggctgctgagcgagcgcgacgcagccaagcacaggctcgtggtgcttgtcaaggacaatggcgagcctccgcgctcggccaccgccacgctgcacgtgctcctggtggatggcttctcccagccctacctgcctctccctgaggcggccccggcccaggcccaggccgactctctcaccgtctacctggtggtggcgttggcctcggtgtcgtcgctcttcctcttctcggtgctcctgttcgtggcggtgcggctgtgcaggaggagcagggcggcctcggtgggtcgctgctcggtgcccgagggcccctttccagggcatctggtggacgtaagcggcaccgggaccctgtcccagagctaccagtacgaggtgtgtctgacaggagactctgggactggtgagttcaagttcctgaagccaatatttcctaatctcttggttcaggacaccgggagggaagttaaggaaaaccccaagttcagaaatagcttggtattcagttaagtattgtatttagttcagtgaaccgcccgttagttttgtcaaacttcccactgcaatgcctttatttaaaaaaattgtctacttatctaaatattcataccacaatttcaaacctactcatgtccctgataaagctaaatttgtcccttttttattgttattaattgcacttaacatttttagttatactggatattgagtatggattttctctatatttgatctattggtgattaatctttttgtaatcataaattactcaattaggataaaaataaattatgttttaatgaaattcttaaattaacatctttttaatggaacatttaagtgaatatatgaatattgaatttctaaatatttgttgtgcctgtctttaccatgtaacttaatgtttgcaaggccagagtgtttgaaagttttgtatttaactttataattaccttgtcctttctggttgactatactaggctaagccctcttaatagccatgagtgtaaaatttagtttactcatttttcacaaattgtatataaacatgcacttcactacattggtaatacactaaaattgtggtccttttcctcttgtgaccaccacatgtctagtgattattttgtttatttggttgctacttacctagcacattgtaatgttccatgaatgctaatattaaattttgtaaaaataacttatttataaataatttttaaagagaaaaatctcatataatttgtcataacctttcaataaataaaactgttaaatcatggcctgatatcatcttaaaaaaaaatctcagaatctgaaataagccctaaatttctccccaaaatcaagactcttgagagcatcataggtctccttgtgctaccttttactccctataaatagaaatccaagtatactttaatatgtgtatattttttggttttcctacagcttctccccatctttcaaaagaatcacgaaatttcttctgcaccttggctattctgtttaaatctgataatcagttgatctcaggtttttcactgtacattactttgcagatatggacagcctttacaaaaataatttttaaatgcttaattattttaatttgttctttaaggtaaccttcagttattttgaattaatttaacttctcaattatgccaaagttgcacttgcatgaaataaatattattttgtccttgtatagactggaacagtaataaatttatctgaattaaaa

SEQ ID NO: 172158 - DNA, 3408 bp, Homo sapiens
  Payload ID: 13837
  Gene Symbol: PCDHB5
  Gene Name: protocadherin beta 5
  Uniprot ID: Q9Y5E4
  ENST ID: ENST00000231134
  CDS Start-End: 218-2605
agtgggctctgcggataactcagacgccattaagctggggaatccaaactctaaaagaaggacgcattttaggtaagatctagtggctagatcttcagggtgggcttcgttcttgtggaaatcagtcaagaaagatcggattcgcggttatttatgcaaatcatctgggtggattgtgtacggagttaaactgcgccttctggaccgggtctgaacaatggagactgcgctagcaaaaacgccacagaaaaggcaagttatgtttcttgctatattgttgcttttgtgggaggctggctctgaggcagttaggtattccataccagaagaaacagaaagtggctattctgtggccaacctggcaaaagacctgggtcttggggtgggggaactggccactcggggcgcgcgaatgcattacaaaggaaacaaagagctcttgcagcttgatataaagaccggcaatttgcttctatatgaaaaactagaccgggaggtgatgtgcggggcgacagaaccctgtatattgcatttccagctcttactagaaaatccagtgcagttttttcaaactgatctgcagctcacagatataaatgaccatgccccagagttcccagagaaggaaatgctcctaaaaatcccagagagcacccagccagggactgtgtttcccttaaaaatagcccaggactttgacataggtagcaacactgttcagaactacacaatcagcccaaattcacactttcatgttgctacgcataatcgcggagatggcagaaaatacccagagctggtgctggacaaagcgctggaccgggaggagcggcctgagctcagcttaacactcactgcactggacggtggggctccgcccaggtccgggaccaccacaattcgcattgtcgtcttggataataatgacaacgcccccgaatttttacaatcattctatgaggtacaggtgcccgagaacagcccccttaactccttagttgtcgttgtctccgctcgagatttagatgcaggagcatatgggagtgtagcctatgctctattccaaggcgatgaagttactcaaccatttgtaatagacgagaaaacagcagaaattcgcctgaaaagggcattggatttcgaggcaactccatattataacgtggaaattgtagccacagatggtgggggcctttcaggaaaatgcactgtggctatagaagtggtggatgtgaatgacaacgcccctgaactcaccatgtctacgctctccagccctaccccagaaaatgccccggaaactgtagttgccgttttcagtgtttctgatccagactccggggacaacggtaggatgatttgctccatccagaatgatctcccctttcttttgaagcccacattaaaaaacttttacaccctagtgacacagagaacactggacagagagagccaagccgagtacaacatcaccatcactgtcaccgacatggggacacccaggctgaaaaccgagcacaacataacggtcctggtctccgacgtcaatgacaacgcccccgccttcacccaaacctcctacaccctgttcgtccgagagaacaacagccccgccctgcacatcggcagtgtcagcgccacagacagagactcaggcaccaacgcccaggtcacctactcgctgctgccgccccagaacccacacctgcgcctcgcctccctggtctccatcaacgcggacaacggccacctgtttgccctcaggtcgctggactacgaggccctgcaggcgttcgagttccgcgtgggagccacagaccgcggctccccggcgctgagcagcgaggcgctggtgcgcgtgctggtgctggacgccaacgacaactcgcccttcgtgctgtatccgctgcagaacggctcggcgccttgcaccgagctggtgccccgggcggccgagccgggctacctggtgaccaaggtggtggcggtggacggtgactcgggccagaacgcctggctgtcgtaccagctgctcaaggccacggagcccgggctgttcagcatgtgggcgcacaatggcgaggtgcgcaccgccaggctgctgagcgagcgcgacgcggccaagcacaggctggtggtgctggtcaaggacaatggcgagcctccgcgctcggccaccgccacgctgcacgtgctcctggtggacggcttctcccagccctacctgccgctgccggaggcggccccggcccaggcccaggccgactcgctcactgtctacctggtggtggcattggcctcggtgtcgtcgctcttcctcttttcggtgctcctgttcgtggcagtgcggctgtgcaggaggagcagggcggccccggtcggtcgctgctcggtgcccgagggcccctttccagggcatctggtggacgtgagcggcaccgggaccctatcccagagctaccactacgaggtgtgtttgaccggagactcaggggccggcgagttcaagttcctgaagccgattattcctaaccttttgccccagggcgctggtgaagaaatagggaaaactgctgccttccggaatagctttggattaaattagagatctcgtgatgacgcgttgttttctgccatttatcccaaactttttcagatctagaattcgagagtgtcatggacaaaaatttcaccttgagattgagcttttatttccctttttaatggatttgtctgttgaacttcatgctgtccaagtgttgaaaagtcaattttatttcattgcatttatttacatagtgtcattccaaatccatgcatgctgttgattttcctgagatttttttctcttcttgttggtatttgttgtgataaaccaccttaataaaatcaagtattaattttattttctatatattctgcccattctatttcatcacactcttaagtattatatatttgatgctaaaatgcaaaaattaaaaatgtttcacatcatcatattttaattgtttaaaacaaagacaaatacatacatatgctaacaaatgaaatatgtgaaaaaatatgtaaaaggaaacaatcttctatttactcttttttgcagccctgagtcctattagcaaactttttaaaaacagtttaattgaattattacttacatgaagaaaaatgaacaaatcctttatgttcaactcaatatatattcacaaagtaacatatttattaccagcagcttgaagagaaaatgaaacatcactggcaccccaggtgccacacaaattactccttacaatcactactaccccaagtatagcaaatatgctgacttccaataccatagtttaattttgcctcttctgaatttatataaatggagtaataaagtatgaactgcttgtgtctggc

SEQ ID NO: 172159 - DNA, 869 bp, Homo sapiens
  Payload ID: 13837
  Gene Symbol: PCDHB5
  Gene Name: protocadherin beta 5
  ENST ID: ENST00000623915
  CDS Start-End: 127-869
cggataactcagacgccattaagctggggaatccaaactctaaaagaaggacgcattttagtgacacagagaacactggacagagagagccaagccgagtacaacatcaccatcactgtcaccgacatggggacacccaggctgaaaaccgagcacaacataacggtcctggtctccgacgtcaatgacaacgcccccgccttcacccaaacctcctacaccctgttcgtccgagagaacaacagccccgccctgcacatcggcagtgtcagcgccacagacagagactcaggcaccaacgcccaggtcacctactcgctgctgccgccccagaacccacacctgcgcctcgcctccctggtctccatcaacgcggacaacggccacctgtttgccctcaggtcgctggactacgaggccctgcaggcgttcgagttccgcgtgggagccacagaccgcggctccccggcgctgagcagcgaggcgctggtgcgcgtgctggtgctggacgccaacgacaactcgcccttcgtgctgtatccgctgcagaacggctcggcgccttgcaccgagctggtgccccgggcggccgagccgggctacctggtgaccaaggtggtggcggtggacggtgactcgggccagaacgcctggctgtcgtaccagctgctcaaggccacggagcccgggctgttcagcatgtgggcgcacaatggcgaggtgcgcaccgccaggctgctgagcgagcgcgacgcggccaagcacaggctggtggtgctggtcaaggacaatggcgagcctccgcgctcggccaccgccacgctgcacgtgctcctggtggacggcttctcccagccctacctgccgct

SEQ ID NO: 172160 - DNA, 3266 bp, Homo sapiens
  Payload ID: 13838
  Gene Symbol: PCDHB6
  Gene Name: protocadherin beta 6
  Uniprot ID: Q9Y5E3
  ENST ID: ENST00000231136
  CDS Start-End: 237-2621
gagtgaatgaaagctctgcagactcggtggactccgtttcatccagaagccaagtaaaaatacagaccacgtttacagctaaagctgagatagatgtgtccgggaaggcagtcgtcgccagacaagttgtaagaacgaatttaaaaatctctgcaaagacatccgagagggtcgacggtagatgtggtgattgggagctgaaaaggatttttcttccgtattcagacataatagacatgatgcaaactaaagtacagaacaagaaaaggcaagtggctttcttcattttattgatgctttggggagaggtgggttctgaatcgattcagtattccgtattggaggagacagaaagtggcacgtttgtggccaacttgacaaaggacctgggactgagggtgggggagctggcttcgcggggcgctcgggttgttttcaaagggaacagacaacatttgcagtttgatccacagacccatgatttactgctaaatgaaaaactggaccgggaggagctgtgtggctccactgagccgtgtgtgctacctttccaagtgttactggaaaaccccttgcagttttttcaggcttccttgcgagtcagagatataaatgaccacgccccggaattccctgccagagaaatgctcctgaaaatatcagaaattactatgccaggaaagatatttcctttgaaaatggcacacgatttagacaccggcagcaacggccttcagaggtacacaatcagctccaaccctcacttccacgttctcacccgcaatcgcagcgaaggcaggaagttcccggagctggtgctagacaaaccgttggaccgcgaggagcagccccaactcaggctaacgctgatcgcgctggatggcgggtctccgccccggtcagggacctccgagattcagatccaggttttggacatcaatgacaacgtccccgagtttgctcaggagctctatgaagcacaagtccctgagaacaaccccctcggctctctggttattaccgtctcagccagagatttagatgcaggatcgtttgggaaggtatcttacgccctgtttcaagtcgatgacgtcaaccaacccttcgaaataaacgcaatcacaggagaaattcggctgagaaaggctttggattttgaggaaattcagtcttatgacgtggatgttgaggctacagatggtggaggcctatcaggaaaatgctctttagtcgtcagggtcctggacgtgaatgacaatgcccctgaactcaccatgtcgttcttcatcagcctcatcccagaaaacttaccagagatcacagtggcagttttcagtgtttcagatgcagactctggacataaccaacaggttatttgttcaatagagaacaatctcccctttctactaagaccttccgtggagaatttctacaccctggtaacagaaggcgcgctggacagagagagcagagccgagtacaacatcactatcacggtcactgatttggggacaccaaggctgaaaacccagcagagcataactgtgcaggtctccgacgtcaatgacaacgcccccgccttcacccaaacctcctacaccctgttcgtccgcgagaacaacagccccgccctgcacatcggcagcgtcagcgccacagacagagactcaggcatcaacgcccaggtcacctactcgctgctgccgccccaggacccgcacctgcccctctcttccctggtctccatcaacgcggacaacggccacctgtttgccctcaggtcgctggactacgaggccctgcagtctttcgagttccgcgtgggcgccacagaccgcggctccccggcgttgagcagcgaggcgctggtgcgcttgctggtgctggacgccaacgacaactcgcccttcgtgttgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagctcggtctgttcggcgtgtgggcgcacaatggcgaggtgcgcaccgccaggctgctgagcgagcgagacgcagccaagcacaggctggtggtgcttgtcaaggacaatggcgagcctccgcgctcggccaccgccacgctgcacgtgctcctggtggacggcttctcccagccctacctgcctctccctgaggcggccccggcccaagcccaggccgactctctcaccgtctacctggtggtggcgttggcctcggtgtcgtcgctcttcctcttttcggtgctcctgttcgtggcggtgcggctgtgcaggaggagcagggcggcctcggtgggtcgctactcggtgcccgagggtccctttccagggcatctggtggatgtgagcggcaccgggaccctatcccagagctaccagtacaaggtgtgtctgacgggaggctcagaaacaaatgagttcaagttcctgaagccgattatgcccaacttccctcctcagggcactgagagagaaatggaagaaacccccacctctcggaatagcttcccgttcagttaagtgtgggattattttactaaatcttacttatgtttggagatctcttttaacttaaagttacatggtctgtttcttgtttattttacctctattctttaggttgaaattttatataaagtaagatactggtatcttagtatttcctgttcatgcttagtagtttattacttcacttgagggtacttgacaatatgaacaaaaagtaaatttttatttgcataattttaagcttttgaaattaaattatctattcttcccccccccaaaaaaaagtattgtaaatccttaagtaaaattgtatttctagctattggtaagagttgtttcactattgctatgtaggactgtttaaaatgtgagtatctgatattatttaatcctccaatgtctcattttgcagtaactcctacagtgtgtaacactaaaaataagaactaatgatggctaaacactaaagtagccattcatacttatgcatattttagtatcccataatagtcaatccaaaatttttgtgactatagactttactgaagtgtcaacacattagtttgtgagcctcatgtaagaacatgatggtctttttttaaaaaaaaagtcgtgccaattataagtgcttaataaatatttgctgaatgttactaa

SEQ ID NO: 172161 - DNA, 2608 bp, Homo sapiens
  Payload ID: 13838
  Gene Symbol: PCDHB6
  Gene Name: protocadherin beta 6
  ENST ID: ENST00000622991
  CDS Start-End: 360-2336
aaagctgagatagatgtgtccgggaaggcagtcgtcgccagacaagttgtaagaacgaatttaaaaatctctgcaaagacatccgagagggtcgacggtagatgtggtgattgggagctgaaaaggatttttcttccgtattcagacataatagacatgatgcaaactaaagtacagaacaagaaaagacccatgatttactgctaaatgaaaaactggaccgggaggagctgtgtggctccactgagccgtgtgtgctacctttccaagtgttactggaaaaccccttgcagttttttcaggcttccttgcgagtcagagatataaatgaccacgccccggaattccctgccagagaaatgctcctgaaaatatcagaaattactatgccaggaaagatatttcctttgaaaatggcacacgatttagacaccggcagcaacggccttcagaggtacacaatcagctccaaccctcacttccacgttctcacccgcaatcgcagcgaaggcaggaagttcccggagctggtgctagacaaaccgttggaccgcgaggagcagccccaactcaggctaacgctgatcgcgctggatggcgggtctccgccccggtcagggacctccgagattcagatccaggttttggacatcaatgacaacgtccccgagtttgctcaggagctctatgaagcacaagtccctgagaacaaccccctcggctctctggttattaccgtctcagccagagatttagatgcaggatcgtttgggaaggtatcttacgccctgtttcaagtcgatgacgtcaaccaacccttcgaaataaacgcaatcacaggagaaattcggctgagaaaggctttggattttgaggaaattcagtcttatgacgtggatgttgaggctacagatggtggaggcctatcaggaaaatgctctttagtcgtcagggtcctggacgtgaatgacaatgcccctgaactcaccatgtcgttcttcatcagcctcatcccagaaaacttaccagagatcacagtggcagttttcagtgtttcagatgcagactctggacataaccaacaggttatttgttcaatagagaacaatctcccctttctactaagaccttccgtggagaatttctacaccctggtaacagaaggcgcgctggacagagagagcagagccgagtacaacatcactatcacggtcactgatttggggacaccaaggctgaaaacccagcagagcataactgtgcaggtctccgacgtcaatgacaacgcccccgccttcacccaaacctcctacaccctgttcgtccgcgagaacaacagccccgccctgcacatcggcagcgtcagcgccacagacagagactcaggcatcaacgcccaggtcacctactcgctgctgccgccccaggacccgcacctgcccctctcttccctggtctccatcaacgcggacaacggccacctgtttgccctcaggtcgctggactacgaggccctgcagtctttcgagttccgcgtgggcgccacagaccgcggctccccggcgttgagcagcgaggcgctggtgcgcttgctggtgctggacgccaacgacaactcgcccttcgtgttgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagctcggtctgttcggcgtgtgggcgcacaatggcgaggtgcgcaccgccaggctgctgagcgagcgagacgcagccaagcacaggctggtggtgcttgtcaaggacaatggcgagcctccgcgctcggccaccgccacgctgcacgtgctcctggtggacggcttctcccagccctacctgcctctccctgaggcggccccggcccaagcccaggccgactctctcaccgtctacctggtggtggcgttggcctcggtgtcgtcgctcttcctcttttcggtgctcctgttcgtggcggtgcggctgtgcaggaggagcagggcggcctcggtgggtcgctactcggtgcccgagggtccctttccagggcatctggtggatgtgagcggcaccgggaccctatcccagagctaccagtacaaggtgtgtctgacgggaggctcagaaacaaatgagttcaagttcctgaagccgattatgcccaacttccctcctcagggcactgagagagaaatggaagaaacccccacctctcggaatagcttcccgttcagttaagtgtgggattattttactaaatcttacttatgtttggagatctcttttaacttaaagttacatggtctgtttcttgtttattttacctctattctttaggttgaaattttatataaagtaagatactggtatcttagtatttcctgttcatgcttagtagtttattacttcacttgagggtacttgacaatatgaacaaaaagtaaatttttatttgcataattttaagcttttgaaattaaattatctattcttcccccccccaaaaaaaa

SEQ ID NO: 172162 - DNA, 3765 bp, Homo sapiens
  Payload ID: 13839
  Gene Symbol: PCDHB7
  Gene Name: protocadherin beta 7
  Uniprot ID: Q9Y5E2
  ENST ID: ENST00000231137
  CDS Start-End: 218-2599
acaaagaaaggatgttacagattccagagcaaagaggcaatctgaagagaaaagcataggaaaggaaacagtggtaataggaattggggtaaaatgaggatccttccccacaaacattgctattattcagctcatttcaaaggattccgctgctgccatttgtgagagccgctggaggctgagtgaaagtcattttgaaagactgatccaaagaagaatggaggccagagtggagcgtgctgtgcagaaaaggcaagtcttatttctttgtgtatttctgggaatgtcttgggctggcgccgaaccgcttcggtattttgtggcggaggaaaccgagagaggcacctttcttaccaacttggcaaaagacctagggttaggggtaggggaactgagagcccggggaactagaattgtttcagaccagaacatgcaaattttactgctcagttcgcttactggtgatctacttctaaatgagaaattggaccgagaggaactgtgtggccccagagagccctgtgtgctgcctttccagttgttattggaaaaaccttttcagattttccgtgctgaactatgggtcagagacatcaatgatcacgctccagtatttctagacagagagatttccttgaaaatattagaaagtaccactccaggggcggcatttctcctagagagtgcacaggattcagatgttggaaccaacagcctgagtaactacaccatcagccccaatgcctatttccatattaatgtccatgatagcggggaggggaatatctatcccgaattggtgctgaatcaagtgctggatcgggaagagataccagagttcagtttaaccctcaccgctttagacggcggctctcctccaagatcagggaccgccctcgtgcgcattctggttctagacgtaaatgacaacgcccctgattttgtgcggtcgctctacaaggtgcaggtgcccgaaaatagccccgttggttccatggttgtctccgtgtcagccagagatttagataccggaagtaatggggaaatagcctatgcattttcttacgccactgaaagaattctcaaaacgtttcaaatcaatccaacatctggcagtcttcatcttaaagcgcaattggactatgaggcaattcaaacttacacattaactattcaggccaaagacggcggcgggctttctggaaaatgcactgtagtggttgatgtaacagatataaacgataatcgacccgagctgctcctgtcttcacttactagcccaattgcagaaaactcacccgagacagtcgtggctgtttttaggattagagacagagattccgggaacaatggaaagacagtgtgctccatccaggacgatgtccccttcatcctgaagccatctgtcgaaaacttctatactctggtaacagagaaacctttggatcgagagaggaacactgagtacaacatcaccatcaccgtcaccgacttggggacacccaggctgaaaaccgagcacaacataaccgtgctggtctccgacgtcaatgacaacgctcccgccttcacccaaacctcctacaccctgtttgtccgtgagaacaacagccccgccctgcccatcggcagtgtcagcgccacagacagagactcgggcaccaacgcccaggtcatctactccctgctgccgtcccaggacccgcacctgcccctcgcctccctggtctccatcaacgcggacaacggccacctgtttgccctcaggtccctggactacgaggccctgcaggcgttcgagttccgcgtgggcgccacagaccgcggctcccccgcgctgagcagcgaggcgctggtgcgcgtgctggtgctggacgccaacgacaactcgcccttcgtgctgtacccgctgcagaacagctccgcgccctgcaccgagccgttgccccgggcggccgagccgggctacctggtgaccaaggtggtggcggtggacggcgactcgggccagaacgcctggctgtcgtaccagctgctcaaggccacggagcccgggctattcggcgtgtgggcgcacaatggcgaggtgcgtaccgccaggctgctgagcgagcgcgacgcagccaagcagaggctggtggtgctggtcaaggacaatggcgagcctccgcgctcggccaccgccacgctgcacgtgctcctggtggacggcttctcccagccctacctgcggctcccggaggcggccccggaccaggccaactcgctcaccgtctacctggtggtggcgttggcctcggtgtcttcgctcttcctcctctcggtgctcctgttcgtggcggtgcggctgtgcaggaggagcagggcggccccggtgggtcgctgctcggtgcctgagggcccctttccacgacatctggtggacttgagcggcaccgggaccctatcccagagctaccagtatgaggtgtgcctgactggaggctccgggacaaatgagttcaagtttctgaaaccaattatccccaacctgctaccccagagcacaggcagggaagtggaagaaaatcgcccatttcagaataatttgggtttctgataaagaatgtaaactaaatccgcgtctgtgaatacgtttctgattaggaacttattgcgaggttcccttaagggagtgtctttacatcatttcaaatatgtactcttgaagtcaagcaataaatttctatacataaaataggatcctgatttagtatcaagaacccttcacaaagcatgaaatgtatatgtgtaatgttttatgtcaaacaattatgcttaatatacagtctattaaatgtaagtcttgtttgagatattttaaattgctttccattgttttcaatctctactgagacttcctgagttgattagaaagctgtatgagtgtacctaccctagtctcagaagcatagactgtagagtatctttttaagcatttttaaaaaatgcttttaatgcatcatacactattttaacacttttaatctgagaagaagcatatgaggcatggtattttaggaatgaacaaatagatggtcttagagattcagtaagttcactaagttccactaactaataagtgacaaaactgagcatccatcccagatctgtctgactctgggtcagtgaccctgctccgattccatactgttttctgtcattagatatcacctggcaagtttctgcctaattaaggagaagtcttttatcatatttatactgctgtccaatcttttctatatttagaaataataatgtacatatttatctatggttttattttcttatacaccaaaagtcctgcttttctgggtcaattttcaactattattactaatgctctgatctgtccaaactcaagcggaaaacaaaattgaaagggcaacctgtgccttctcctttcttcagaacatatgactttcatttcccagaaaaaagattaatggtcctgagtaggaatattacataattttgattgcatcattagttaattattttcttcatattgtagattttctgcagtcacccatacttaacatttgtaatacattttcctgatttgaaagtttgtttttaaaagttttctattaattatagtgcactattgaatcaggaaaatttaagaaaaagaatagttagttttaaatgcataatatcaaagagaatcatagatgatcattaaatttttagaaattctcggaagttaaggagaagcactgtttt

SEQ ID NO: 172163 - DNA, 2740 bp, Homo sapiens
  Payload ID: 13840
  Gene Symbol: PCDHB8
  Gene Name: protocadherin beta 8
  Uniprot ID: Q9UN66
  ENST ID: ENST00000239444
  CDS Start-End: 246-2651
tggcgctgcaggataagaaggcacaaaccagaaccgcagctgcagctccattaaccggcaaaaagcagcagaacctggaagtccacggggagcttggatgccaaagggaggacggctgggtcctctggagaggactactcactggcatatttctgaggtatctgtagaaaaccacagcctcagatactggggactttacagtcccacagaaccgtcctcccaggaagctgaattcagcaagaacaatggaggccagcgggaagctcatttgcagacaaaggcaagtccttttttcctttctccttttgggcttatctctggcgggcgcggcggaacctagaagctattctgtggtggaggaaactgagggcagctcctttgtcaccaatttagcaaaggacctgggtctggagcagagggaattctccaggcggggggttagggttgtttccagagggaacaaactacatttgcagctcaatcaggagaccgcggatttgttgctaaatgagaaattggaccgtgaggatctgtgcggtcacacagagccctgtgtgctacgtttccaagtgttgctagagagtcccttcgagttttttcaagctgagctgcaagtaatagacataaacgaccactctccagtatttctggacaaacaaatgttggtgaaagtatcagagagcagtcctcctgggactgcgtttcctctgaagaatgctgaagacttagatataggccaaaacaatattgagaactatataatcagccccaactcctattttcgggtcctcacccgcaaacgcagtgatggcaggaaatacccagagctggtgctggacaaagcgctggaccgagaggaagaagctgagctcaggttaacactcacagcactggatggtggctctccgcccagatctggcactgctcaggtctacattgaagttgtcgatgtcaatgataatgcccctgaatttgagcagcctttctatagggtgcagatctctgaggacagtccaataagcttcctggttgtgaaggtctctgccacggatgtagacacaggagtcaacggagagatttcctattcacttttccaagcttcagatgagataagcaaaacttttaaggtcgatttcttgacaggagaaattcgactaaagaaacaacttgatttcgaaaaatttcagtcctatgaagtcaatatcgaggcgagagatgctggaggcttttctggaaaatgcaccgttctgattcaagtgatagatgtgaacgaccatgccccagaagttaccatgtctgcatttaccagcccaatacctgagaatgcgcctgaaactgtggttgcacttttcagtgtttcagaccttgattcaggagaaaatgggaaaataagttgctccattcaggaggatctacccttcctcctgaaatcttctgtggggaacttttacaccctactaacagagacaccactagacagagaaagcagagccgagtacaacgtcactatcaccgtcactgacttagggacacccaggctgacaacacatctcaatatgaccgtgctggtgtcggacgtcaatgacaacgcccccgccttcacccaaacctcctacaccctgttcgtccgcgagaacaacagccccgccctgcacatcggcagcgtcagcgccacagacagagactcgggcaccaacgcccaggtcacctactcgctgctgccgccccaggatccgcacctgcccctcgcctccctggtctccatcaacacagacaacggccacctgttcgccctcaggtcgctggactacgaggccctgcaggcgttcgagttccgggtgggcgcttcagaccgcggctccccggctttgagcagcgaggcgctggtgcgcgtgctggtgctggacgccaacgacaactcgcccttcgtgctgtacccgctgcagaatggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggtgtgtgggcgcacaatggcgaggtgcgcaccgccaggctgctgagcgagcgcgacgcggccaagcagaggctggtggtgctggtcaaggacaatggcgagcctccgtgctcggccaccgccacgctgcacgtgctcctggtggacggcttctcccagccctacctgccgcttccggaggctgccccagcccagggccaggccgactctctcaccgtctacctggtggtggcgttggcctcggtgtcttcgctcttcctcttctcggtgctcctgttcgtggcggtgctgctgtgtaggaggagcagggcggcctcggtgggtcgctgctcagtgcctgagggcccctttccagggcatctggtggacgtgaggggcaccgggagcctgtctcagaactatcagtacgaggtgtgcctggcaggaggctcagggacgaatgagttccagctcctgaaaccagtattacctaatattcagggccattcttttgggccagaaatggaacaaaactctaactttaggaatggctttggtttcagccttcagttaaagtaattgatttcatattatatattttaatttttatgatcaattcaaaggaatggttttctgtcaacttagcataaattttaaattacactaca

SEQ ID NO: 172164 - DNA, 4415 bp, Homo sapiens
  Payload ID: 13841
  Gene Symbol: PCDHB9
  Gene Name: protocadherin beta 9
  Uniprot ID: Q9Y5E1
  ENST ID: ENST00000316105
  CDS Start-End: 193-2586
agaatgctacggaagtccttgacaaaaaggaaacactgagacagatgggctgagaagaagagctgtcgagtccctgattgggaaaggaaaaattaaaaaccctagatctctggtacacataagtctgggtttgcgattgctatttgtgctggggcagtgtgattgagactgacattgaggaaagaagcagctatgaagaccagggggttcagctttccaagacaaaggcaagtcctgtttctttttcttttctggggagtgtccttggcaggttctgggtttggacgttattcggtgactgaggaaacagagaaaggatcctttgtggtcaatctggcaaaggatctgggactagcagagggggagctggctgcaaggggaaccagggtggtttccgatgataacaaacaatacctgctcctggattcacataccgggaatttgctcacaaatgagaaactggaccgagagaagctgtgtggccctaaagagccctgtatgctgtatttccaaattttaatggatgatccctttcagatttaccgggctgagctgagagtcagggatataaatgatcactcgccagtgtttcggcacaaagagatggtcttaaaaatatcagaaaatacagctgaagggacagcatttagactagaaagagcacaggatccagatgaaggtcataacagtatccaaaactacacgatcagctccaactcttttttccatattaaaattagtggcagtgatgaaggcatgatatatccagagctagtgttggacaaagcactggatcgggaggagcaggaagagctcagcttaaccctcacagcgctggatggtgggtctccatccaggtctgggacctccactatacgcattgtggtcttggatgtcaatgacaatgtcccacagtttgcccaggctctgtatgagacccaggctccagaaaacagtccagtagggtcccttattgttaaagtgtctgcaggagatgcagactcaggagtcaatgcagaagtatcctattcattttttgatgcttctgaagatattttaacaacgtttcaaatcaatcctttttctggggaaatctttctcagagaattgcttgattatgagttagtaaattcttacaaaataaatatacaggcaatggacggcggaggcctttctgcaagatgtacagttttgataaaagtattagattccaatgacaatcctcctgaactgatcatatcatcactttccaactctgttgctgaaaactctcctgggatagtattggctgtttttaagattaaagacagagactccggagaaaatggaaagacaatttgctatgttcaagataatctgcctttttttctgaaaccgtctgttgacaatttttacatcctaatgactgaaggtgcactggacagagagagcaaagctgagtacaacatcaccatcaccgtcactgacttggggacacccaggctgaaaaccgagcacagcataaccctgcaggtctccgacgtcaatgacaacgcccccgccttcacccaaacctcctacaccctgttcgtccgggagaacaacagccccgccctgcacatcggcagtgtcagcgccacagacagagactcaggcaccaacgcccaggtcacctactcgctgctgccgccccaggacccacacctgcccctcgcctccctggtctccatcaacgcggacaatggccacctgtttgccctcaggtcgctggactacgaggccctgcaggctttcgacttccgcgtgggcgcctcagaccgcggctccccggctttgagcagcgaggcgctggtgcgcgtactggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggtgtgtgggcgcacaatggggaggtgcgcaccgccaggctgctgagcgagcgcgacgcggccaagcacaggctggtggtgcttgtcaaggacaatggcgagcctcctcgctcggccaccgccacgctgcacgtgctcctggtggacggcttctcccagccctacctgcctctcccggaggcggccccggcccaggcccaggccgacttgctcaccgtctacctggtggtggcgttggcctcggtgtcttcgctcttcctcctctcggtgctcctgttcgtggcggtgcggctgtgcaggaggagcagggcggcctcggtgggtcgctgctcggtgcccgagggtccttttccagggcatctggtggacgtgagcggcaccgggaccctgttccagagctaccagtacgaggtgtgtctgactggaggttcagagaccggcgagttcaagttcttgaagccgattaccccccacctcccgccccataggggtgggaaagaaatagaggaaaattctactctccccaatagctttggatttaattattgaaaggaacccacttaataaagacatttacttctttaatatattcttgttggctaactaaattgtgtatgcccaccacaaagaaggtactattttttgtttgattcatcttcaactttgcgtattatgcttaacttcacaagttaactttttcttattttgtatcctgatgaggcatttcttactagaatcccataagtgaaatataatatttttcaaagttgatatcatttaaaaatttttggtcgttttaaatgtctttattgactttaaattcattgcctctacattattcattagttcttcttttcctaaaactttttacttgttaaaatagtctgctgcatgtaatatgtgcttttactatttgatatttcttctatttttcttttgaaaccggtgttcttattggtttgccatccttgttcattacaactgttttttgtttgtttgtttgttttttggtttgtttgttttttttttttttgagacggagtctcgctctgtcgcccaggctggagtgcagtggcgcgatctcagctcactgcaacctccgcctcccaggttcaagcgattctcctgcctcagcctccagagtatctgggactacagttgcatgtcaccacgttcggctaatttttgtattttcagtagagacgggtttcatcatggtggccaggatggtctatctcttgacctcgtgatccaccccactcagcctcccaaattgctgggatttacaggcatgagccaccgcacccagcctacaataattttcttaaactttaccttttattttaaagttctagtttcccggcattgatagttccctatttgaaatataatgtttctcttgtaagtgatatgataaataaacccctaattagccttagaagaaaaaccactgcaagatattaagcgtgtgtaaatgggctttagtctggaaaccaaaaaaaaaaaaaaaatttagtcattctataggatcatgtgaaaatatttaatttgctccttttaattctgtataaacaaatcagaggttcctgaggttcctgttaaatttttaatggctaatagcccagtgccatccagttgaaaaaacaacagcaatcacaaagtagaggtttatattgtgcggcttttatattcagctattagagtgttattggtagtgtctagccttttcctccacgacattccttgacttaatccatttgggcctattatagacaaaatagagcttctttctagatataaggtctttgaggcagggctcagtggctcattcctgtaatcccagcactttgggaggccaaggcgggcagatcaccttaggtcacgagtttgagaccagcctgaccaacgttaagtaaccccgtctttactaaaaatacaaaattagccaggcatggtggcacatgcttgtaatcccagctactcgggaggctgaggcaggagaatcgcttgaacccaggaggtggaagttgctttgagccgagattgcaccattgtactccagcctgggcaataagagcaaaactccatcaaaataaaataaaataaaatataaaataacttaaaaagaactttgaataaaattctatgaaaaaagacactagaatgctgttcttaattttaatagtgttaagataggtgttagtgtggtctgttctttacctccctttatttggtgcagagaagttagatcctgctaaatttcaattaagaggggaccttaaaataaggatcaatctcttatttaaccctgtaagttactttaaagctaatacaagaaaaacaaagacaagtgaaagtaaggaaacagaaattgcaaa

SEQ ID NO: 172165 - DNA, 616 bp, Homo sapiens
  Payload ID: 13841
  Gene Symbol: PCDHB9
  Gene Name: protocadherin beta 9
  ENST ID: ENST00000624909
  CDS Start-End: 397-616
ggaaaggaaaaattaaaaaccctagatctctggtacacataagtctgggtttgcgattgctatttgtgctggggcagtgtgattgagactgacattgaggaaagaagcagctatgaagaccagggggttcagctttccaagacaaaggcaatggacggcggaggcctttctgcaagatgtacagttttgataaaagtattagattccaatgacaatcctcctgaactgatcatatcatcactttccaactctgttgctgaaaactctcctgggatagtattggctgtttttaagattaaagacagagactccggagaaaatggaaagacaatttgctatgttcaagataatctgcctttttttctgaaaccgtctgttgacaatttttacatcctaatgactgaaggtgcactggacagagagagcaaagctgagtacaacatcaccatcaccgtcactgacttggggacacccaggctgaaaaccgagcacagcataaccctgcaggtctccgacgtcaatgacaacgcccccgccttcacccaaacctcctacaccctgttcgtccgggagaacaacagccccgccctgcacatcggcagtgtcagcgccacag

SEQ ID NO: 172166 - DNA, 4069 bp, Homo sapiens
  Payload ID: 13842
  Gene Symbol: PCDHGA1
  Gene Name: protocadherin gamma subfamily A, 1
  Uniprot ID: Q9Y5H4
  ENST ID: ENST00000378105
  CDS Start-End: 115-2586
tctggatgactctccagtcagaattctcctgaaaattgggttaatttcagctcagaaaagcagaaacgatacccttggtactggactggaagaaaactacgaagtgagagagccatgaagattcagaaaaagctgactggctgcagcaggctgatgcttctgtgtctttctctggagctgctgttggaagctggggctgggaatattcactactcagtgccggaagagacagacaaaggttccttcgtaggcaacatcgccaaggacctagggctgcaaccccaggagctggcagatggcggagtccgcatcgtctccagaggtaggatgccgcttttcgctctgaatcctagaagtggcagcttgatcaccgcgcgcaggatagaccgggaggagctctgcgctcagagcatgccgtgtctcgtgagttttaatatccttgttgaggataaaatgaagctttttcctgttgaagtagaaataattgatattaatgacaacactccccaattccagttagaggaactggagtttaaaatgaatgaaataacgactccaggtaccagagtctcattgccttttgggcaagaccttgatgtgggtatgaactcactccagagctaccaactcagctctaaccctcatttctccctggatgtgcaacagggagccgatgggcctcaacatccagagatggtgctgcagagtcccttagacagagaagaagaagctgtccaccacctcatcctcacagcttctgatgggggtgaaccagtccgttcagggaccctcagaatttacattcaggtggtggatgcaaatgacaatcctccagcatttactcaggcacaataccatataaatgtccccgaaaacgtgccgctgggtactcagctgctcatggtaaatgccactgaccctgatgagggagccaatggggaagtaacgtactcctttcacaatgtagaccacagagtggcccaaatatttcgtttagattcttacacaggagaaatatcaaataaagaaccactagatttcgaagaatacaaaatgtattcaatggaagttcaagcccaggatggtgcggggctcatggctaaagttaaggtactgatcaaagttttggatgtaaatgataatgccccagaagtgaccatcacctctgtcaccactgcagttccagaaaactttcctcctgggaccataattgctcttatcagtgtgcatgaccaggactcaggagacaatggctacaccacatgtttcattcctggaaatttaccctttaaattggaaaagttagttgataattattaccgtttagtgactgaaagaacactggacagagaacttatctctgggtacaacatcacaataacagcaatagaccaaggaactccagctctatctactgaaactcacatttcactactagtgacagatatcaatgacaactccccagtcttccatcaggactcctactctgcctacattcccgaaaacaaccccagaggagcctccatcttctctgtgagggcccacgacttggacagcaatgagaatgcacaaatcacttactccctaatagaggacactatccagggggcacccctatctgcctacctctccatcaactccgacactggggtcctgtatgcgctgcgatccttcgactatgagcagttccgggacatgcaactgaaagtgatggcgcgggacagtggggatccgcccctcagcagcaacgtgtctctcagcctattcctgctggaccagaacgacaacgcgcccgagatcctgtaccccgccctccccacagatggttctaccggcgtggagctggcgcccctctccgcagagcccggctacctggtgaccaaggtggtggcggtggacagagactcgggccagaacgcctggctgtcctaccgcctgctcaaggccagcgagccgggactcttctcggtgggtctgcacacgggcgaggtgcgcacggcgcgagccctgctggacagagacgcgctcaagcagagtctcgtggtggccgtccaggaccacggccagcccccgctctccgccactgtcacgctcaccgtggccgtggccgacaggatctccgacatcctggccgacctgggcagcctcgagccctccgccaaacccaacgattcggacctcactctgtacctggtggtggcggcggccgcggtctcctgcgtcttcctggccttcgtcatcgtgctgctggcgcacaggctgcggcgctggcacaagtcacgtctgctacaggcttcgggaggcggcttagcgagcatgcccggttcgcactttgtgggcgtggacggggttcgggctttcctgcagacctattcccacgaggtctccctcactgcggactcgcggaagagccacctgattttcccccagcccaactatgcggacacactcatcagccaggagagctgtgagaaaaagggttttctatcagcaccccagtctttacttgaagacaaaaaggaaccattttctcaggtaaacttttgtgatgaatgtatcagctatctagagaaaaataattcttgatttaacttactagcgttcgctctttgctacagatagttcttctaacccatgtatctttgtagctttttattacaagtcctgcaaaatcacgattgagtctacacgttcatatgcaggtatatttataattgttcttgcactgaaaaggagactgtgatcataatgtaggtggttgggttgaaggtatgtgtgagatgccatctctgtttggaaagagcactgcattagaaacggcgatctagcttctaacattttcttacttgcctctgggctaaaaggtttgattagaaaaggctcaccaatatttaaatgactaacactattttcaaattttctttttataagtacctgctaatctacccctgaatttaatgtagatgtcatctgtcaggacactgtgatagtttatttggggacatttgaagaggtgaagattgtctaaagtagtatttttagttgtgttcatataagattatagagatctatataaactgcaattttaaattattgttgaatattttagccttttattctatctttattatcagatttttttggttttgagatggggtcatgctagagtgcagtggcatgatcatggctcactgcagccactacctcctgggctcaagcgatcctcccacctcagcctctcaaagtgctgatattacaggtgtgagctgtggtgcctgtactgaagaatacgtctatttaagtaatgtatgaagtaacaaaatgaacaacacaaaatttatcatgcaacttgagaaatatctttgaagcctcctgacttatacattatacctgtaatgaaatcagctaacaaaaatcaagtatatatcctattttaatgtgtgttaacttttcagaagaaaaaaaaagtatggtcggggagtaagtccatgctttgatgtatttactctgctccaataaaatacagagatacataaaatataagaggaaagcaaaagcaaagtggtgagctagtctaaagccatgtgagttatagtcttggacttaaaagcagaaattgaaggttaggaaactgcctccagcaatgtaatagggacagaagtgcttcagactagataaatatctggaccaggcttactgcctgaatccaaaataagcaatgaggcccttcagctggttaaaaaggaaaagaaagatgcattaacatgctgcctagctgggcgcagtggctcacgtctgtatttccaacaatttgagaggctgaggcggaaagatccttggagccctggagttcaagaccagccggacagggcggcctgcgactgtagtcccagctacgcggggcggggaggggcggggcggggcggggcaggagctgacgtgggaggatcccttgagcccaggaagtcaaggcttcagcgaaccgtgatcgcgccactgccctccagcctgggcgacagagccacaccctgttaaataaataaatataataataaaagctgtttcccaa

SEQ ID NO: 172167 - DNA, 4604 bp, Homo sapiens
  Payload ID: 13842
  Gene Symbol: PCDHGA1
  Gene Name: protocadherin gamma subfamily A, 1
  Uniprot ID: Q9Y5H4
  ENST ID: ENST00000517417
  CDS Start-End: 1-2796
atgaagattcagaaaaagctgactggctgcagcaggctgatgcttctgtgtctttctctggagctgctgttggaagctggggctgggaatattcactactcagtgccggaagagacagacaaaggttccttcgtaggcaacatcgccaaggacctagggctgcaaccccaggagctggcagatggcggagtccgcatcgtctccagaggtaggatgccgcttttcgctctgaatcctagaagtggcagcttgatcaccgcgcgcaggatagaccgggaggagctctgcgctcagagcatgccgtgtctcgtgagttttaatatccttgttgaggataaaatgaagctttttcctgttgaagtagaaataattgatattaatgacaacactccccaattccagttagaggaactggagtttaaaatgaatgaaataacgactccaggtaccagagtctcattgccttttgggcaagaccttgatgtgggtatgaactcactccagagctaccaactcagctctaaccctcatttctccctggatgtgcaacagggagccgatgggcctcaacatccagagatggtgctgcagagtcccttagacagagaagaagaagctgtccaccacctcatcctcacagcttctgatgggggtgaaccagtccgttcagggaccctcagaatttacattcaggtggtggatgcaaatgacaatcctccagcatttactcaggcacaataccatataaatgtccccgaaaacgtgccgctgggtactcagctgctcatggtaaatgccactgaccctgatgagggagccaatggggaagtaacgtactcctttcacaatgtagaccacagagtggcccaaatatttcgtttagattcttacacaggagaaatatcaaataaagaaccactagatttcgaagaatacaaaatgtattcaatggaagttcaagcccaggatggtgcggggctcatggctaaagttaaggtactgatcaaagttttggatgtaaatgataatgccccagaagtgaccatcacctctgtcaccactgcagttccagaaaactttcctcctgggaccataattgctcttatcagtgtgcatgaccaggactcaggagacaatggctacaccacatgtttcattcctggaaatttaccctttaaattggaaaagttagttgataattattaccgtttagtgactgaaagaacactggacagagaacttatctctgggtacaacatcacaataacagcaatagaccaaggaactccagctctatctactgaaactcacatttcactactagtgacagatatcaatgacaactccccagtcttccatcaggactcctactctgcctacattcccgaaaacaaccccagaggagcctccatcttctctgtgagggcccacgacttggacagcaatgagaatgcacaaatcacttactccctaatagaggacactatccagggggcacccctatctgcctacctctccatcaactccgacactggggtcctgtatgcgctgcgatccttcgactatgagcagttccgggacatgcaactgaaagtgatggcgcgggacagtggggatccgcccctcagcagcaacgtgtctctcagcctattcctgctggaccagaacgacaacgcgcccgagatcctgtaccccgccctccccacagatggttctaccggcgtggagctggcgcccctctccgcagagcccggctacctggtgaccaaggtggtggcggtggacagagactcgggccagaacgcctggctgtcctaccgcctgctcaaggccagcgagccgggactcttctcggtgggtctgcacacgggcgaggtgcgcacggcgcgagccctgctggacagagacgcgctcaagcagagtctcgtggtggccgtccaggaccacggccagcccccgctctccgccactgtcacgctcaccgtggccgtggccgacaggatctccgacatcctggccgacctgggcagcctcgagccctccgccaaacccaacgattcggacctcactctgtacctggtggtggcggcggccgcggtctcctgcgtcttcctggccttcgtcatcgtgctgctggcgcacaggctgcggcgctggcacaagtcacgtctgctacaggcttcgggaggcggcttagcgagcatgcccggttcgcactttgtgggcgtggacggggttcgggctttcctgcagacctattcccacgaggtctccctcactgcggactcgcggaagagccacctgattttcccccagcccaactatgcggacacactcatcagccaggagagctgtgagaaaaagggttttctatcagcaccccagtctttacttgaagacaaaaaggaaccattttctcagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctgaa

SEQ ID NO: 172168 - DNA, 4617 bp, Homo sapiens
  Payload ID: 13843
  Gene Symbol: PCDHGA10
  Gene Name: protocadherin gamma subfamily A, 10
  Uniprot ID: Q9Y5H3
  ENST ID: ENST00000398610
  CDS Start-End: 1-2811
atggccgctcaaaggaatcgctcaaaggaatcaaaggattgcagcgggctggtcctgctctgccttttcttcgggattccatgggaggctggagcccggcagatctcctactcaattcctgaggaattagagaaaggctctttcgtgggcaacatctccaaggacttgggtctggcgccccgggagctggcggagcgcggagtccgcatagtctccagaggtaggacgcagcttttctctctgaacccgcgcagcggcagcttgatcaccgcgggcaggatagaccgggaggagctctgcgctcagagcgcgcggtgcgtggtgagttttaatatccttgtggaagacagggtgaaactttttgggatagaaatagaagtaactgatatcaatgacaatgctccaaaattccaagcagaaaatctagacgtaaaaattaatgaaaatgtcgctgcgggaatgcgttttcctctcccggaagctattgatccggatgtgggcgtgaactccctgcagagctatcagctcagccccaataagcacttctccctaagagttcagagccgtgccaatggcgtcaagtacccggagctggtactggagcactccctagatcgcgaggaagaggccattcaccacctggtcctcaccgcctccgacgggggtgaccctctccgatctggcactgtccttgtcagtgtgactgtcttcgatgcaaatgacaacgcgccggtcttcaccttgccagaataccgagtgagtgttcctgagaatttgcctgtgggcactcagctgctgacagtcacagccaccgacagggacgaaggtgccaatggagaagtgacatattcattccgaaaattacctgacacgcaattgttgaagttccaactaaacaaatatactggagaaataaaaatatcagaaaatctagattatgaagaaaccggtttctatgaaatagaaatacaagcagaagatggaggagcatatcttgcaactgcaaaagtgttgattacagtagaagatgtaaatgacaacagtccagagctgaccatcacgtctctatttagtccagtgactgaagattcacctctgggaacagtcgtagcccttttaaatgtgcatgatttagactctgagcagaatggacaggtaacctgttccattttggcgtatctaccatttaaattagaaaagtccattgacagttattacagattggtgatacacagagcccttgacagggaacaggtatcctcttacaatatcacagtgacagccacagatgggggaagtcctcctctatcaacggaagctcactttatgctacaagtggcagatatcaatgacaacccacctaccttctctcaagtctcctactttacctatatcccagagaacaacgccaggggtgcctccatcttctcagtgacagcgctggacccggacagcaaagagaatgcccagattatttactccctggctgaagacaccatccagggggtacctctgtcctcatacatatccatcaactcagacactggcgtcctgtatgcactcagatccttcgactatgagcagtttcatgagctacagatgcaggtgacagccagcgacagcggggatcctccactcagcagcaacgtgtcgttgagcctgtttgtgctggaccagaacgacaatgcgcccgagatcctgtaccccgccctccccacagacggttccacaggcgtggagctggcgccccgctccgcagagcccggctacctggtgaccaaggtggtggcggtggacagagactccggccagaacgcctggctgtcctaccgtctgctcaaggccagcgagccgggactcttcgcggtgggggagcacacgggcgaggtgcgcacggcgcgagccctgctggacagagacgcgctcaagcaaagcctcgtagtggccgtccaggaccacggccagccccctctctccgccactgtcacgctcaccgtggccgtggccgacagcatcccccaagtcctggcggacctcggcagcttcgagtctccagctaactctgaaacctcagacctcactctgtacctggtggtagcggtggccgcggtctcctgcgtcttcctggccttcgtcatcgtgctgctggcgcacaggctgcggcgctggcacaagtcacgcctgctgcaggcttcaggaggcggcttgacaggtgtgtccggctcgcactttgtgggcgtggacggggttcgggctttcctgcagacctattcccacgaggtctctctcaccgcggactcgcgaaagagtcacctgatcttcccccagcccaattatgcggacacgctcatcagccaggagagctgtgagaaaaacgatcctttgtctttgttagatgattcgaagtttcctatagaggataccccattggttccacaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 172169 - DNA, 4462 bp, Homo sapiens
  Payload ID: 13843
  Gene Symbol: PCDHGA10
  Gene Name: protocadherin gamma subfamily A, 10
  Uniprot ID: Q9Y5H3
  ENST ID: ENST00000612503
  CDS Start-End: 190-2742
aatccggattctcagggcttcaactacacaagccccacaaaccggctgctgggctgcagggaagctcactccagaatttaaagtgcccaggctacagagacaccctgaagccacagaaagacaaaggaaccggttgaaacacacaacgtgtccagtgaggactttgcagaattctgtaaccagactacaatggccgctcaaaggaatcgctcaaaggaatcaaaggattgcagcgggctggtcctgctctgccttttcttcgggattccatgggaggctggagcccggcagatctcctactcaattcctgaggaattagagaaaggctctttcgtgggcaacatctccaaggacttgggtctggcgccccgggagctggcggagcgcggagtccgcatagtctccagaggtaggacgcagcttttctctctgaacccgcgcagcggcagcttgatcaccgcgggcaggatagaccgggaggagctctgcgctcagagcgcgcggtgcgtggtgagttttaatatccttgtggaagacagggtgaaactttttgggatagaaatagaagtaactgatatcaatgacaatgctccaaaattccaagcagaaaatctagacgtaaaaattaatgaaaatgtcgctgcgggaatgcgttttcctctcccggaagctattgatccggatgtgggcgtgaactccctgcagagctatcagctcagccccaataagcacttctccctaagagttcagagccgtgccaatggcgtcaagtacccggagctggtactggagcactccctagatcgcgaggaagaggccattcaccacctggtcctcaccgcctccgacgggggtgaccctctccgatctggcactgtccttgtcagtgtgactgtcttcgatgcaaatgacaacgcgccggtcttcaccttgccagaataccgagtgagtgttcctgagaatttgcctgtgggcactcagctgctgacagtcacagccaccgacagggacgaaggtgccaatggagaagtgacatattcattccgaaaattacctgacacgcaattgttgaagttccaactaaacaaatatactggagaaataaaaatatcagaaaatctagattatgaagaaaccggtttctatgaaatagaaatacaagcagaagatggaggagcatatcttgcaactgcaaaagtgttgattacagtagaagatgtaaatgacaacagtccagagctgaccatcacgtctctatttagtccagtgactgaagattcacctctgggaacagtcgtagcccttttaaatgtgcatgatttagactctgagcagaatggacaggtaacctgttccattttggcgtatctaccatttaaattagaaaagtccattgacagttattacagattggtgatacacagagcccttgacagggaacaggtatcctcttacaatatcacagtgacagccacagatgggggaagtcctcctctatcaacggaagctcactttatgctacaagtggcagatatcaatgacaacccacctaccttctctcaagtctcctactttacctatatcccagagaacaacgccaggggtgcctccatcttctcagtgacagcgctggacccggacagcaaagagaatgcccagattatttactccctggctgaagacaccatccagggggtacctctgtcctcatacatatccatcaactcagacactggcgtcctgtatgcactcagatccttcgactatgagcagtttcatgagctacagatgcaggtgacagccagcgacagcggggatcctccactcagcagcaacgtgtcgttgagcctgtttgtgctggaccagaacgacaatgcgcccgagatcctgtaccccgccctccccacagacggttccacaggcgtggagctggcgccccgctccgcagagcccggctacctggtgaccaaggtggtggcggtggacagagactccggccagaacgcctggctgtcctaccgtctgctcaaggccagcgagccgggactcttcgcggtgggggagcacacgggcgaggtgcgcacggcgcgagccctgctggacagagacgcgctcaagcaaagcctcgtagtggccgtccaggaccacggccagccccctctctccgccactgtcacgctcaccgtggccgtggccgacagcatcccccaagtcctggcggacctcggcagcttcgagtctccagctaactctgaaacctcagacctcactctgtacctggtggtagcggtggccgcggtctcctgcgtcttcctggccttcgtcatcgtgctgctggcgcacaggctgcggcgctggcacaagtcacgcctgctgcaggcttcaggaggcggcttgacaggtgtgtccggctcgcactttgtgggcgtggacggggttcgggctttcctgcagacctattcccacgaggtctctctcaccgcggactcgcgaaagagtcacctgatcttcccccagcccaattatgcggacacgctcatcagccaggagagctgtgagaaaaacgatcctttgtctttgttagatgattcgaagtttcctatagaggataccccattggttccagtgagttttattttcatttttacttttgttaaaaaaaaaaagattggtttttactttgaagtttgcggcatgatggtggaaagtgtaaatgctaaaacactgatgagtagaatttgatgtttattaaggttttttttttttttttttttttttttttttttactttctggtaaaattcacctagtctcaatcaaggcctatatatcataaggctttgttatgattagctttgcagaaccttgtagtttatagtgttgttgagtacaatattgacaattcctaagacagacttccatacagaagtgcctgtcaatttatatttcctcctgggtggtcacatattgaaactccagccccttaagcaaccctcttgttctgaaggcaggtctggtaagaataggtaagtatcagaaagaaatcacctctggaaacacaacccaaatccaagaatactcaatgcagttcttcccaaggagaagggcaataggcctttttcaaactacattttatatatttttcaatctatactttgtggtgatagttgcagttgaatatactaagtttttcattaatattgaattaacaatttatttataacaatgtatgcttagatttttccagccctatttataactgataacactgcagtatcctttttgcatacaattctctaatttcacactgctatgtggaagatatagcattttaatttaactttcattgctcaatagggatcctgaggaggctatagagggtgaaattaagaatatttgggattctgcttttgtcttttttgttaaattttctagtgactaaggctgaaagtaaatatgggttgggaagacagataaatttgtacatgttcccgagaacaggagcaagagatatatgacaaagctatttcagtggctctttaatgtataaggaggcaaacacctgaaactctgaaaactctgaaattgagaggcaaaataaacttagagtcaagaaagaaatgccatttctgcagatcagaatataaacaccaaccacagctgtaaaaaagaaaagaatatatgcaacgaagggaaattatataaacaaaggatcattggaggtactgatgagttcatttagttcaatgaaaatagtgacgtattaggtagatctcttaattttattactagtattctactaaatgtggtagtataaagtcaaaaagcattccgaagtttctcaagacccttataattccatgatttttttcaggtcagtcaacatttgttgaatgataggtctgtggaaggaaagcacactctttagggtcatagttattaactattaaaccattgaaactattattttatatttgtgttaatgagagtcaaaattattgtgcattcatctcaaataattctattattttgaaaaatacaggttttttttttaaaaaaaactgctcttgacattgtagctattgtgagaaaatattttgattataattatttaaaagcaatacaggacaccctggatgatggtaatgactagggcaatggttgcattccagtacttaagtatgaaataaggaattattactttctgggtgaatataggctagaattgaagacaaaaaaatttgttgcttatcttcagtacttccagcttcatagataattactcttaaaaggaacaagaatgactgcctctggatggaggaattggatagcaatgggccgtgggataggagacctataaaccttcatgctatattattttgtgcctttttaaattttgaagaaaaaatattcatttattcaagatatatgtaaattcagtaaataaaaagatatgatagtta

SEQ ID NO: 172170 - DNA, 4647 bp, Homo sapiens
  Payload ID: 13844
  Gene Symbol: PCDHGA11
  Gene Name: protocadherin gamma subfamily A, 11
  Uniprot ID: Q9Y5H2
  ENST ID: ENST00000398587
  CDS Start-End: 34-2841
gagaaaccgcggaatatcggcttagagcctgccatggcgaatcggctacagcgcggggaccgcagtcggctgctgctgctgctgtgcattttcctggggacgctgcgggggttccgggccaggcagatccgatattcggtgccagaagagaccgaaaagggctccttcgtgggcaatatctccaaggacctggggctggagccccgggagctggcgaagcgcggagtccgcatcgtctccagagggaagacacagcttttcgctgtgaatccgcgaagcggcagcttgatcacggcaggcaggatagaccgggaggagctctgtgagacggtgtcctcctgttttttaaatatggaacttctcgtggaagacaccttgaagatttacggagtggaggtggaaataatagatattaatgataacgcccccagcttccaggaggacgaagtggagataaaagtcagtgagcacgcaattcctggggcgcgatttgctcttcctaatgctagggatccagatgtgggcgtgaactccctccagagctaccagctcagccctaataattacttttccttgcaactgcggggcagaacggatggggccaagaatccagagctagtactggagggaagcctggaccgagagaaagaggctgctcacctgctcctcctcacagctttagatggaggcgatcccatccgaaagggcgcagttcccattcgtgtggtggtcctcgatgtaaatgatcacatcccaatgtttacacagtccgtatatcgcgtgagtgttccagaaaacatcagctccggaactcgggtgctgatggttaatgcaacggatccagacgagggaatcaacggggaagtaatgtattcatttcggaacatggaaagcaaggcttctgaaatattccaattggattcacaaactggagaagttcaagtacgggggtctctggattttgaaaaatatagattctatgagatggaaattcaaggccaagatggtggaggtctctttaccaccacgacgatgttgatcactgttgtggatgtgaatgataacgctccagaaataactatcacctcttctattaattcaattctggaaaactctcctccaggtacagtgattgctcttctaaatgtgcaagatcaagattctggagaaaatggtcaagtctcctgttttattcctaaccacctgccttttaaattagaaaagacttatggaaattattacaaattgataacaagcagagtgctggacagggagttggtccagagctacaatataacgttgacagccacagaccagggaagcccgcctttgtctgcagaaactcatgtctggctgaatgtggcagatgacaacgataaccctcccgtttttcctcactcctcttactctgcctacattcccgaaaacaaccccaggggtgcctccatcttctcagtgaccgccctcgacccggacagcaaacagaatgccctggtcacttactctctgacggatgacactgtccagggggtgcctctgtcctcctatgtctctattaactccaacactggtgttctctatgccctacaatccttcgactatgagcagtttcgagacttagaactgagagtgatagcacgtgacagcggggacccgcccctcagcagcaacgtgtcgctgagcctgttcgtgctggaccagaacgacaatgcgcccgagatcctgtaccctgccctccccacagacggctccactggcgtggagctggcgccccgctctgcggaacctggctacctggtgaccaaggtggttgcggtggacaaagattcaggccagaacgcctggctgtcctatcgcctgcttaaggccagcgagccgggactcttcgcggtgggggagcacacgggcgaggtgcgtacagcgcgggcactgctggacagagacgcgctcaagcagagcctcgtggtggccgtccaggaccacggccagccccctctctcggccaccgtcacgctcaccgtggctgtggccgacagcatccccgaagtcctggcggacctcggcagcctcgagtctctggctaactctgaaacctcagacctctcgctgtacttggtggtggcggtggccgcagtctcctgcatcttcctggtctttgtcatcgtgctgctggcactcaggctgtggcgctggcataagtcacgcctgctgcaggcttctgaaggcgggttggcaggtatgcccacgtcacattttgtaggcgtggacggggtacaggctttcctgcaaacctattcccacgaggtctctctcattgcggactcgcagaagagtcacctgattttcccccagcccaactatggggacacgctcatcagccaggagagctgtgagaaaagcgagccactcttgatagctgaagactcagctatcattttaggcaaatgtgacccgacaagtaatcagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 172171 - DNA, 2263 bp, Homo sapiens
  Payload ID: 13844
  Gene Symbol: PCDHGA11
  Gene Name: protocadherin gamma subfamily A, 11
  Uniprot ID: Q9Y5H2
  ENST ID: ENST00000518882
  CDS Start-End: 1-2253
atggcgaatcggctacagcgcggggaccgcagtcggctgctgctgctgctgtgcattttcctggggacgctgcgggggttccgggccaggcagatccgatattcggtgccagaagagaccgaaaagggctccttcgtgggcaatatctccaaggacctggggctggagccccgggagctggcgaagcgcggagtccgcatcgtctccagagggaagacacagcttttcgctgtgaatccgcgaagcggcagcttgatcacggcaggcaggatagaccgggaggagctctgtgagacggtgtcctcctgttttttaaatatggaacttctcgtggaagacaccttgaagatttacggagtggaggtggaaataatagatattaatgataacgcccccagcttccaggaggacgaagtggagataaaagtcagtgagcacgcaattcctggggcgcgatttgctcttcctaatgctagggatccagatgtgggcgtgaactccctccagagctaccagctcagccctaataattacttttccttgcaactgcggggcagaacggatggggccaagaatccagagctagtactggagggaagcctggaccgagagaaagaggctgctcacctgctcctcctcacagctttagatggaggcgatcccatccgaaagggcgcagttcccattcgtgtggtggtcctcgatgtaaatgatcacatcccaatgtttacacagtccgtatatcgcgtgagtgttccagaaaacatcagctccggaactcgggtgctgatggttaatgcaacggatccagacgagggaatcaacggggaagtaatgtattcatttcggaacatggaaagcaaggcttctgaaatattccaattggattcacaaactggagaagttcaagtacgggggtctctggattttgaaaaatatagattctatgagatggaaattcaaggccaagatggtggaggtctctttaccaccacgacgatgttgatcactgttgtggatgtgaatgataacgctccagaaataactatcacctcttctattaattcaattctggaaaactctcctccaggtacagtgattgctcttctaaatgtgcaagatcaagattctggagaaaatggtcaagtctcctgttttattcctaaccacctgccttttaaattagaaaagacttatggaaattattacaaattgataacaagcagagtgctggacagggagttggtccagagctacaatataacgttgacagccacagaccagggaagcccgcctttgtctgcagaaactcatgtctggctgaatgtggcagatgacaacgataaccctcccgtttttcctcactcctcttactctgcctacattcccgaaaacaaccccaggggtgcctccatcttctcagtgaccgccctcgacccggacagcaaacagaatgccctggtcacttactctctgacggatgacactgtccagggggtgcctctgtcctcctatgtctctattaactccaacactggtgttctctatgccctacaatccttcgactatgagcagtttcgagacttagaactgagagtgatagcacgtgacagcggggacccgcccctcagcagcaacgtgtcgctgagcctgttcgtgctggaccagaacgacaatgcgcccgagatcctgtaccctgccctccccacagacggctccactggcgtggagctggcgccccgctctgcggaacctggctacctggtgaccaaggtggttgcggtggacaaagattcaggccagaacgcctggctgtcctatcgcctgcttaaggccagcgagccgggactcttcgcggtgggggagcacacgggcgagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggcc

SEQ ID NO: 172172 - DNA, 3633 bp, Homo sapiens
  Payload ID: 13844
  Gene Symbol: PCDHGA11
  Gene Name: protocadherin gamma subfamily A, 11
  Uniprot ID: Q9Y5H2
  ENST ID: ENST00000622044
  CDS Start-End: 182-2695
ctctaccacacaaagcggaatgagatggatactcacagatcctgacactggagacttagaagtattttccttcgctttctgatatattttggatgtagtcggcctaggacttcatagatacataagccgattcacaaccaaccagctcgagaaaccgcggaatatcggcttagagcctgccatggcgaatcggctacagcgcggggaccgcagtcggctgctgctgctgctgtgcattttcctggggacgctgcgggggttccgggccaggcagatccgatattcggtgccagaagagaccgaaaagggctccttcgtgggcaatatctccaaggacctggggctggagccccgggagctggcgaagcgcggagtccgcatcgtctccagagggaagacacagcttttcgctgtgaatccgcgaagcggcagcttgatcacggcaggcaggatagaccgggaggagctctgtgagacggtgtcctcctgttttttaaatatggaacttctcgtggaagacaccttgaagatttacggagtggaggtggaaataatagatattaatgataacgcccccagcttccaggaggacgaagtggagataaaagtcagtgagcacgcaattcctggggcgcgatttgctcttcctaatgctagggatccagatgtgggcgtgaactccctccagagctaccagctcagccctaataattacttttccttgcaactgcggggcagaacggatggggccaagaatccagagctagtactggagggaagcctggaccgagagaaagaggctgctcacctgctcctcctcacagctttagatggaggcgatcccatccgaaagggcgcagttcccattcgtgtggtggtcctcgatgtaaatgatcacatcccaatgtttacacagtccgtatatcgcgtgagtgttccagaaaacatcagctccggaactcgggtgctgatggttaatgcaacggatccagacgagggaatcaacggggaagtaatgtattcatttcggaacatggaaagcaaggcttctgaaatattccaattggattcacaaactggagaagttcaagtacgggggtctctggattttgaaaaatatagattctatgagatggaaattcaaggccaagatggtggaggtctctttaccaccacgacgatgttgatcactgttgtggatgtgaatgataacgctccagaaataactatcacctcttctattaattcaattctggaaaactctcctccaggtacagtgattgctcttctaaatgtgcaagatcaagattctggagaaaatggtcaagtctcctgttttattcctaaccacctgccttttaaattagaaaagacttatggaaattattacaaattgataacaagcagagtgctggacagggagttggtccagagctacaatataacgttgacagccacagaccagggaagcccgcctttgtctgcagaaactcatgtctggctgaatgtggcagatgacaacgataaccctcccgtttttcctcactcctcttactctgcctacattcccgaaaacaaccccaggggtgcctccatcttctcagtgaccgccctcgacccggacagcaaacagaatgccctggtcacttactctctgacggatgacactgtccagggggtgcctctgtcctcctatgtctctattaactccaacactggtgttctctatgccctacaatccttcgactatgagcagtttcgagacttagaactgagagtgatagcacgtgacagcggggacccgcccctcagcagcaacgtgtcgctgagcctgttcgtgctggaccagaacgacaatgcgcccgagatcctgtaccctgccctccccacagacggctccactggcgtggagctggcgccccgctctgcggaacctggctacctggtgaccaaggtggttgcggtggacaaagattcaggccagaacgcctggctgtcctatcgcctgcttaaggccagcgagccgggactcttcgcggtgggggagcacacgggcgaggtgcgtacagcgcgggcactgctggacagagacgcgctcaagcagagcctcgtggtggccgtccaggaccacggccagccccctctctcggccaccgtcacgctcaccgtggctgtggccgacagcatccccgaagtcctggcggacctcggcagcctcgagtctctggctaactctgaaacctcagacctctcgctgtacttggtggtggcggtggccgcagtctcctgcatcttcctggtctttgtcatcgtgctgctggcactcaggctgtggcgctggcataagtcacgcctgctgcaggcttctgaaggcgggttggcaggtatgcccacgtcacattttgtaggcgtggacggggtacaggctttcctgcaaacctattcccacgaggtctctctcattgcggactcgcagaagagtcacctgattttcccccagcccaactatggggacacgctcatcagccaggagagctgtgagaaaagcgagccactcttgatagctgaagactcagctatcattttaggcaaatgtgacccgacaagtaatcaggtgagatttatttctctgcctcctaattgttggtgtcttggcacaagtcttttaaggagatgttttttgagcctgttatgaaaactgtttggggggggggtggggcggcatatatttagttcatatatatttagagcaatacatgtgagttttactttgcctttcatgagattacgataatctttcagaacgtttttgtgaaagtcatttttcaatcttggcatattttcttttgatttcaaaggggccattcaactatgctggtttggtttgaagtaagttgaattttagtattatttttctattatcagtgtatgaggctctcaatttattatatatagatacaaattaatgattcacaaacactttttatttccatttcaattttgctgtgccttcactgatttgtagttatattccaccattatttgctattactgctaatgttcaaattttgatcctgttgatttaatagcatgctccctctagctctccttctcatctatctatctatacacatgcacacacacttatacacgtaagcttttctctgagcaattttattttgattcttggtggctggtaatatgcttagatcctgttgactatttcaactttgtctcatttcttcatcctatcaacacagacatattgactggcttttaactactggatttccttgggagataaaatttagatcacattttttcttaagctctagatgtcttttccattactatggtgaagttacattgactgttctgaggaaataattgaattattgaactggtattatttccttttattcttttactttggtgtctgtgtttgtatgtatggaaggttttttaatgtagtaaatccatatatagaaataacttgattttgattcagtgcttctcaaaaacctattttcaaatgtgctaaagatgtctacagatttattcaaatagagtagtttgtgaatatataaatagattgaaggtatttggactttaattaaactgatttagctagta

SEQ ID NO: 172173 - DNA, 4747 bp, Homo sapiens
  Payload ID: 13845
  Gene Symbol: PCDHGA12
  Gene Name: protocadherin gamma subfamily A, 12
  Uniprot ID: O60330
  ENST ID: ENST00000252085
  CDS Start-End: 143-2941
taggaatgaaccatccctgggagtatgtggaaacaacggaggagctctgacttcccaactgtcccattctatgggcgaaggaactgctcctgacttcagtggttaagggcagaattgaaaataattctggaggaagataagaatgattcctgcgcgactgcaccgggactacaaagggcttgtcctgctgggaatcctcctggggactctgtgggagaccggatgcacccagatacgctattcagttccggaagagctggagaaaggctctagggtgggcgacatctccagggacctggggctggagccccgggagctcgcggagcgcggagtccgcatcatccccagaggtaggacgcagcttttcgccctgaatccgcgcagcggcagcttggtcacggcgggcaggatagaccgggaggagctctgtatgggggccatcaagtgtcaattaaatctagacattctgatggaggataaagtgaaaatatatggagtagaagtagaagtaagggacattaacgacaatgcgccttactttcgtgaaagtgaattagaaataaaaattagtgaaaatgcagccactgagatgcggttccctctaccccacgcctgggatccggatatcgggaagaactctctgcagagctacgagctcagcccgaacactcacttctccctcatcgtgcaaaatggagccgacggtagtaagtaccccgaattggtgctgaaacgcgccctggaccgcgaagaaaaggctgctcaccacctggtccttacggcctccgacgggggcgacccggtgcgcacaggcaccgcgcgcatccgcgtgatggttctggatgcgaacgacaacgcaccagcgtttgctcagcccgagtaccgcgcgagcgttccggagaatctggccttgggcacgcagctgcttgtagtcaacgctaccgaccctgacgaaggagtcaatgcggaagtgaggtattccttccggtatgtggacgacaaggcggcccaagttttcaaactagattgtaattcagggacaatatcaacaataggggagttggaccacgaggagtcaggattctaccagatggaagtgcaagcaatggataatgcaggatattctgcgcgagccaaagtcctgatcactgttctggacgtgaacgacaatgccccagaagtggtcctcacctctctcgccagctcggttcccgaaaactctcccagagggacattaattgcccttttaaatgtaaatgaccaagattctgaggaaaacggacaggtgatctgtttcatccaaggaaatctgccctttaaattagaaaaatcttacggaaattactatagtttagtcacagacatagtcttggatagggaacaggttcctagctacaacatcacagtgaccgccactgaccggggaaccccgcccctatccacggaaactcatatctcgctgaacgtggcagacaccaacgacaacccgccggtcttccctcaggcctcctattccgcttatatcccagagaacaatcccagaggagtttccctcgtctctgtgaccgcccacgaccccgactgtgaagagaacgcccagatcacttattccctggctgagaacaccatccaaggggcaagcctatcgtcctacgtgtccatcaactccgacactggggtactgtatgcgctgagctccttcgactacgagcagttccgagacttgcaagtgaaagtgatggcgcgggacaacgggcacccgcccctcagcagcaacgtgtcgttgagcctgttcgtgctggaccagaacgacaatgcgcccgagatcctgtaccccgccctccccacggacggttccactggcgtggagctggctccccgctccgcagagcccggctacctggtgaccaaggtggtggcggtggacagagactccggccagaacgcctggctgtcctaccgtctgctcaaggccagcgagccgggactcttctcggtgggtctgcacacgggcgaggtgcgcacggcgcgagccctgctggacagagacgcgctcaagcagagcctcgtagtggccgtccaggaccacggccagccccctctctccgccactgtcacgctcaccgtggccgtggccgacagcatcccccaagtcctggcggacctcggcagcctcgagtctccagctaactctgaaacctcagacctcactctgtacctggtggtagcggtggccgcggtctcctgcgtcttcctggccttcgtcatcttgctgctggcgctcaggctgcggcgctggcacaagtcacgcctgctgcaggcttcaggaggcggcttgacaggagcgccggcgtcgcactttgtgggcgtggacggggtgcaggctttcctgcagacctattcccacgaggtttccctcaccacggactcgcggaagagtcacctgatcttcccccagcccaactatgcagacatgctcgtcagccaggagagctttgaaaaaagcgagccccttttgctgtcaggtgattcggtattttctaaagacagtcatgggttaattgagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 172174 - DNA, 2634 bp, Homo sapiens
  Payload ID: 13845
  Gene Symbol: PCDHGA12
  Gene Name: protocadherin gamma subfamily A, 12
  Uniprot ID: O60330
  ENST ID: ENST00000613314
  CDS Start-End: 172-2634
gcacgcgcctgaagcacaaagcagatagctaggaatgaaccatccctgggagtatgtggaaacaacggaggagctctgacttcccaactgtcccattctatgggcgaaggaactgctcctgacttcagtggttaagggcagaattgaaaataattctggaggaagataagaatgattcctgcgcgactgcaccgggactacaaagggcttgtcctgctgggaatcctcctggggactctgtgggagaccggatgcacccagatacgctattcagttccggaagagctggagaaaggctctagggtgggcgacatctccagggacctggggctggagccccgggagctcgcggagcgcggagtccgcatcatccccagaggtaggacgcagcttttcgccctgaatccgcgcagcggcagcttggtcacggcgggcaggatagaccgggaggagctctgtatgggggccatcaagtgtcaattaaatctagacattctgatggaggataaagtgaaaatatatggagtagaagtagaagtaagggacattaacgacaatgcgccttactttcgtgaaagtgaattagaaataaaaattagtgaaaatgcagccactgagatgcggttccctctaccccacgcctgggatccggatatcgggaagaactctctgcagagctacgagctcagcccgaacactcacttctccctcatcgtgcaaaatggagccgacggtagtaagtaccccgaattggtgctgaaacgcgccctggaccgcgaagaaaaggctgctcaccacctggtccttacggcctccgacgggggcgacccggtgcgcacaggcaccgcgcgcatccgcgtgatggttctggatgcgaacgacaacgcaccagcgtttgctcagcccgagtaccgcgcgagcgttccggagaatctggccttgggcacgcagctgcttgtagtcaacgctaccgaccctgacgaaggagtcaatgcggaagtgaggtattccttccggtatgtggacgacaaggcggcccaagttttcaaactagattgtaattcagggacaatatcaacaataggggagttggaccacgaggagtcaggattctaccagatggaagtgcaagcaatggataatgcaggatattctgcgcgagccaaagtcctgatcactgttctggacgtgaacgacaatgccccagaagtggtcctcacctctctcgccagctcggttcccgaaaactctcccagagggacattaattgcccttttaaatgtaaatgaccaagattctgaggaaaacggacaggtgatctgtttcatccaaggaaatctgccctttaaattagaaaaatcttacggaaattactatagtttagtcacagacatagtcttggatagggaacaggttcctagctacaacatcacagtgaccgccactgaccggggaaccccgcccctatccacggaaactcatatctcgctgaacgtggcagacaccaacgacaacccgccggtcttccctcaggcctcctattccgcttatatcccagagaacaatcccagaggagtttccctcgtctctgtgaccgcccacgaccccgactgtgaagagaacgcccagatcacttattccctggctgagaacaccatccaaggggcaagcctatcgtcctacgtgtccatcaactccgacactggggtactgtatgcgctgagctccttcgactacgagcagttccgagacttgcaagtgaaagtgatggcgcgggacaacgggcacccgcccctcagcagcaacgtgtcgttgagcctgttcgtgctggaccagaacgacaatgcgcccgagatcctgtaccccgccctccccacggacggttccactggcgtggagctggctccccgctccgcagagcccggctacctggtgaccaaggtggtggcggtggacagagactccggccagaacgcctggctgtcctaccgtctgctcaaggccagcgagccgggactcttctcggtgggtctgcacacgggcgaggtgcgcacggcgcgagccctgctggacagagacgcgctcaagcagagcctcgtagtggccgtccaggaccacggccagccccctctctccgccactgtcacgctcaccgtggccgtggccgacagcatcccccaagtcctggcggacctcggcagcctcgagtctccagctaactctgaaacctcagacctcactctgtacctggtggtagcggtggccgcggtctcctgcgtcttcctggccttcgtcatcttgctgctggcgctcaggctgcggcgctggcacaagtcacgcctgctgcaggcttcaggaggcggcttgacaggagcgccggcgtcgcactttgtgggcgtggacggggtgcaggctttcctgcagacctattcccacgaggtttccctcaccacggactcgcggaagagtcacctgatcttcccccagcccaactatgcagacatgctcgtcagccaggagagctttgaaaaaagcgagccccttttgctgtcaggtgattcggtattttctaaagacagtcatgggttaattgaggtgagtttatatcaaatcttctttcttttttttttttaa

SEQ ID NO: 172175 - DNA, 4605 bp, Homo sapiens
  Payload ID: 13846
  Gene Symbol: PCDHGA2
  Gene Name: protocadherin gamma subfamily A, 2
  Uniprot ID: Q9Y5H1
  ENST ID: ENST00000394576
  CDS Start-End: 1-2799
atggcggctctgcaaaagttgccacactgcagaaagctggtcctgctgtgcttccttttggcgaccctgtgggaggccagggccgggcagattcgctattctgtgcgggaagagatcgacagaggctccttcgtaggcaacatcgccaaggacttgggtttggagcccctggcactggcagagcagggagtccgcatcgtctccagaggtaggtcccagctctttgctctgaacccgcgaagcggcagcttggtcactgcgaacaggatagaccgggaggagctctgcgctcagagcgcaccctgtctgttgaattttaacattctgctggaggataaattgactatttattcagtagaggtggaaataacagatattaacgataatgcccctcgctttggagtagaggaactggagctaaaaatcagtgaaaccactacgccaggattccggattcctcttaagaatgcgcatgatgcagacgtaggtgagaacgcccttcagaagtacgcactcaacccaaatgaccacttctccctggacgtgcgaaggggagctgatgggaacaagtacccagaactggtgctggagcgctctctggaccgcgaggaagaggctgttcaccacctcgttctcgtggcttctgatgggggtgacccagtgctatctggcacctcccgcatctgcgtgaaggtcctggatgcgaacgacaatgcgcctgtttttacacagcccgagtaccgcataagcattccggagaatacgctcgtgggcacccggatactcacggtgaccgccactgacgcagatgagggctactacgctcaagtggtatattttctagagaaaagccctggagaaacctcagaggtatttgagcttaagtcaacatctggagaactgacaatcataaaagatctagattatgaggatgctacattccatgaaattgatattgaagctcaggatggtccgggccttctaaccagagcgaaggttatcgtcacggttctggatgtgaatgacaatgccccagaattttacatgacatctgctactagctcagtttctgaagactctcttccaggaaccataattgggctttttaatgtacatgatagagactctgggcagaacgcattcaccacctgttcactccccgaggatcttccttttaagttagaaaagtcagtagacaattactaccgactggttacaaccagagcccttgacagggaacagttttccttttacaacatcactctaaccgctaaagatggagggaacccctccctgtccacggatgctcacattttgctccaggtggcagacatcaacgacaacgcacccgccttctcccgcacatcctactccacctacattcccgaaaacaaccccagaggagcctctgtcttctcagtgacggcccatgaccccgacagcaacgacaatgctcatgtaacttactctttcgcggaggacactgttcagggggcacccttatcctcttacatctctatcaactccgacactggagtactctatgcactgcgctcctttgattatgagcagttgcgagacttgcaagtgtgggtgatagcgcgggacagcgggaaccctccactcagtagcaatgtatcattaagcctgttcgtgctggaccagaacgacaacgcgcccgagatcctgtaccctgccttccccacagacggttccactggcgtggagctggcgccccgctccgcagagcccggctacctggtgaccaaggtggtggcggtggacagagactcgggccagaacgcctggctgtcttaccacctgctcaaggccagcgagccgggactcttctcggtgggtctgcacacgggcgaggtgcgcacggcgcgagccctgctggacagagacgcgctcaagcagagcctcgtggtggccatccaggaccacggccagccccctctctccgccactgtcacgctcaccgtggccgtggccgacaggatccccgacatcctggccgacctgggcagcctcgagccctccgccatacccaacgattcggacctcactctgtacctggtggtggcggtggccgcggtctcctgcgtcttcctggccttcgtcatcgtgttgctggcgcacaggctgcggcgctggcacaagtcacgcctgctgcaggcttcaggaggcagcttgacaggcatgcagagctcgcactttgtgggcgtggacggggttcgggctttcctgcagacctattcccacgaggtctccctcactgcggactcgcggaagagccacctgattttcccccagcccaactatgcggacacgctcatcagccaggagagctgtgagaaaaaggattttttatcagcgcctcaatctctactcgaagaagaaagagaagaaacgttttctcagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 172176 - DNA, 4543 bp, Homo sapiens
  Payload ID: 13846
  Gene Symbol: PCDHGA2
  Gene Name: protocadherin gamma subfamily A, 2
  Uniprot ID: Q9Y5H1
  ENST ID: ENST00000528330
  CDS Start-End: 213-2684
aatccagcaatacggctcccacagcacaagggggtggaggtttggccctaaagcttcaggacaccaaagaaattcagtcgaacagcccaccagttctctccatagggacctgggtcccgtgaatgctggttatctcacaccctgaggaataaagattggaatccgcactggatgctggaagttgactcggagaaaattgcgacaggagggaaatggcggctctgcaaaagttgccacactgcagaaagctggtcctgctgtgcttccttttggcgaccctgtgggaggccagggccgggcagattcgctattctgtgcgggaagagatcgacagaggctccttcgtaggcaacatcgccaaggacttgggtttggagcccctggcactggcagagcagggagtccgcatcgtctccagaggtaggtcccagctctttgctctgaacccgcgaagcggcagcttggtcactgcgaacaggatagaccgggaggagctctgcgctcagagcgcaccctgtctgttgaattttaacattctgctggaggataaattgactatttattcagtagaggtggaaataacagatattaacgataatgcccctcgctttggagtagaggaactggagctaaaaatcagtgaaaccactacgccaggattccggattcctcttaagaatgcgcatgatgcagacgtaggtgagaacgcccttcagaagtacgcactcaacccaaatgaccacttctccctggacgtgcgaaggggagctgatgggaacaagtacccagaactggtgctggagcgctctctggaccgcgaggaagaggctgttcaccacctcgttctcgtggcttctgatgggggtgacccagtgctatctggcacctcccgcatctgcgtgaaggtcctggatgcgaacgacaatgcgcctgtttttacacagcccgagtaccgcataagcattccggagaatacgctcgtgggcacccggatactcacggtgaccgccactgacgcagatgagggctactacgctcaagtggtatattttctagagaaaagccctggagaaacctcagaggtatttgagcttaagtcaacatctggagaactgacaatcataaaagatctagattatgaggatgctacattccatgaaattgatattgaagctcaggatggtccgggccttctaaccagagcgaaggttatcgtcacggttctggatgtgaatgacaatgccccagaattttacatgacatctgctactagctcagtttctgaagactctcttccaggaaccataattgggctttttaatgtacatgatagagactctgggcagaacgcattcaccacctgttcactccccgaggatcttccttttaagttagaaaagtcagtagacaattactaccgactggttacaaccagagcccttgacagggaacagttttccttttacaacatcactctaaccgctaaagatggagggaacccctccctgtccacggatgctcacattttgctccaggtggcagacatcaacgacaacgcacccgccttctcccgcacatcctactccacctacattcccgaaaacaaccccagaggagcctctgtcttctcagtgacggcccatgaccccgacagcaacgacaatgctcatgtaacttactctttcgcggaggacactgttcagggggcacccttatcctcttacatctctatcaactccgacactggagtactctatgcactgcgctcctttgattatgagcagttgcgagacttgcaagtgtgggtgatagcgcgggacagcgggaaccctccactcagtagcaatgtatcattaagcctgttcgtgctggaccagaacgacaacgcgcccgagatcctgtaccctgccttccccacagacggttccactggcgtggagctggcgccccgctccgcagagcccggctacctggtgaccaaggtggtggcggtggacagagactcgggccagaacgcctggctgtcttaccacctgctcaaggccagcgagccgggactcttctcggtgggtctgcacacgggcgaggtgcgcacggcgcgagccctgctggacagagacgcgctcaagcagagcctcgtggtggccatccaggaccacggccagccccctctctccgccactgtcacgctcaccgtggccgtggccgacaggatccccgacatcctggccgacctgggcagcctcgagccctccgccatacccaacgattcggacctcactctgtacctggtggtggcggtggccgcggtctcctgcgtcttcctggccttcgtcatcgtgttgctggcgcacaggctgcggcgctggcacaagtcacgcctgctgcaggcttcaggaggcagcttgacaggcatgcagagctcgcactttgtgggcgtggacggggttcgggctttcctgcagacctattcccacgaggtctccctcactgcggactcgcggaagagccacctgattttcccccagcccaactatgcggacacgctcatcagccaggagagctgtgagaaaaaggattttttatcagcgcctcaatctctactcgaagaagaaagagaagaaacgttttctcaggtaatctatcttttcacaacatacgtactagctagtttgctgaagtaattcacttacttgtttactatatctattttgttccccatatttccttgagggtagagtcaagttttaggaagtgagtcttggtgaattatttcttggtaggtcttagtgttcacaggctgtaagaggaagaagagacgtgagaatctttgtgcaatgaatgtaaaccaggagttaatagataagattatccaaagagcactgcattaggaactagggtgtctggtttcttatactttcttctccatccctgggcaaatcatctcatccacccagatcaacaattttttctttgttaaaaatataaagattggagtttatgtttactcaagtcctttcttcttttaagttatgactcttactctatatttgaatctgtatatgaacagtgaaacatgttagttggctagttctttctcattcagtcttaatacatttctttcagtttggcagcaaaattgttttccttaacttgcatgcccttccctgttaaaaatatggaaatttagaaatatacattccttacagtgtttcaggaaggtatgtcatattattttggcttagttttaaaaatcacattaacctctaagctatatgcttcttgaagaagtgactgacttatcatctgctctataataaagctgtagagtggtaataaacaggtttctcctttttttttatctttctcatacgtgggaaccatactgtattttaatctttaaaataatatatatcctcaatatagttttgcttaaagaaaagatacaaaagattcatatcatacaattgcccagaaccaacttctttatacatctctcttctcaaggtttctactcacaatagctgctagaaatgttcccaatccctcacccaatcccagtgcccctctgatcaattttcttttcccattcctcttcctatattggcttttagtatgttggttatgtatttaataacagagaataataagcacactaatgttctatgtaactggcatcattttttatttttatttgaaaattatcatgtaccaattgagccttttattgaatgataccatatttctcaaagtgctgtgattctttccgttgcatttgatcaagaaaaaattttctgagacaaggtgttgttttggttactattacataattgtctatgagtaaaattggaactcactgtggaataatatgtcataatagctttacttgtaagtgaataataaagtataaacaggaaaattaaagcaaagttatttttagtgtgtgtagtaactccacaagaataaatgtcttatgcatagatatgtaatgcatcatgattgaaacgacaaatatattgtatttatatttctgtgcttggaaacttatggggaaagagattctggaacataaaagcttatttctactagtttcagttggttttgaaaaaacatccttacagtctagatttaaacaaaggaaacttctttcagtaccctgaaggtctgtgatttctctctcacacctaggcattgtcatgctgttctctcccacatccaggccttttcactgatccactcctctcatgtttcctgggaaagcgtttgctaacattaaaggcccaattgaaggcccccctaacccccttggcttctcccattatggtaattatctcagtacactgcaattccctgtttgcttttatatccttataatctctgtgaaggaagctactgtgtctatattgttcaccttaaatccccaaacatattgtctgatgcctaattatgtgtttgtttaatgaatattaaataacaacaaatatcgaaactaagttatcaggtcaccaagaacaaacttaaagaaatataatgtataaatatg

SEQ ID NO: 172177 - DNA, 4771 bp, Homo sapiens
  Payload ID: 13847
  Gene Symbol: PCDHGA3
  Gene Name: protocadherin gamma subfamily A, 3
  Uniprot ID: Q9Y5H0
  ENST ID: ENST00000253812
  CDS Start-End: 167-2965
cagactcagaagatccggggcggctgccaacctcacctcttagtcaaccagctgtttgacctgtgaattaggcccgtaaaagacttcgtttcttgagaaaataagattggagtccgtcgtaggaaactggaaccgaattcagagaaagcgattcaccgaaaaggaaatgaccaattgcctgagtttccgaaatggcagaggactggccctgctgtgcgcgctcctggggacgctgtgcgaaacaggatccggtcagatccgctactcggtgtctgaggagctagataaaggttccttcgtgggcaacatcgctaacgacctggggctagagccccgggagctggcggagcgcggagtccgcatcgtctccagaggtaggacgcagcttttctctctgaatccgcaaagcggcagcttggtcaccgcggagaggatagaccgggaggagctctgcgctcagatcccgctgtgtctggtaaaaattaacattctggttgaggataaattgaaaatttttgaagtagaaatagaaattaaagatattaatgataatgctcctaatttcccaacagaggaattggaaataaaaattggtgaactaacggttcctggaacccgatttccaattaaaactgcttttgacccagatgtaggcattaactccctgcagaactacaagcttagccccaatgactacttctctctggctgtgaatagcgtctctgagggggccaagtatccagagctggtgctggagcgggccctggaccgtgagaaaaaagaaattcaccagcttgtcctggttgcctctgatggtggcgaccctgtccactctggcaacttgcacatccaagtgatagtcctggatgcaaatgacaacccaccaatgtttactcagcctgagtaccgtgtgagtgtttgggagaacgtgcctgtgggtacccggctgctcacggtgaatgccactgaccctgacgagggattcaatgctcaagtgtcttatattctagataaaatgcctgggaaaatcgctgagattttccatcttaactcagtgagtggagaagtatcaatattaaaaagtctagattatgaggatgccatgttctatgaaattaaaattgaagcacaggatggaccaggtcttctttcaagagccaagattctagtcacggttctggatgtgaatgacaatgctccagaaattacaatcacgtctctcacaagctcagtcccagaagagggcaccgttggaagagaaattgctcttatcgacgtgcatgaccgagattctgggcagaatgggcaggttgaagtttttgtcctgggaaatctgccatttaagttagaaaaatcaatagatcaatattaccgcttagtgacggccacatccctggaccgcgaacaaatatcagaatataacattagtctgagagcctcagatgggggaagcccgccactgtccacagaaactcacatcaccctgcatgtgattgacatcaatgacaacccacccaccttccctcatttatcctactccgcctacattccagaaaacaaccccagaggagcctccatcttctcagtgacagcccaggacccagatagcaacaacaacgcccgcatcacttatgcattgaccgaggacactctccagggggcgcccctgtcctccttcgtctctatcaactccaacactggcgtcctatacgcgctgagatccttcgactacgagcaatttagagacttaaagctactggtgacagccagcgacagcgggaaccctccactcagcagcaacgtgtcgctgaacctgttcgtgctggaccagaacgacaacgcgcccgagatcctgtaccccgccctccccacagacggttccactggcgtggagctggcgcctcgctccgcagagcccggctacctggtgaccaaggtggtggcggtggacagagactcgggccagaacgcctggctgtcctaccgcctgctcaaggccagcgagccgggactcttctcggtgggtctgcacacgggcgaggtgcgcacggcgcgagccctgctggacagagacgcgctcaagcagagcctcgtggtggccgtccaggaccacggccagccccctctctccgccactgtcacgctcaccgtggccgtggccgacaggatccccgacatcctggccgacctgggcagcctcgagccctccgccaaacccaacgattcggacctcactctgtacctggtggtggcggtggccgcggtctcctgcgtcttcctggccttcgtcatcgtgctgctggcgctcaggctgcggcgctggcacaagtcacgcctgctgcaggcttcgggaggcggcttggcgagtacgcccggctcgcactttgtgggcgcggacggggttcgggctttcctgcagacctattcccacgaggtctccctcactgcggactcgcggaagagccacctgattttcccccagcccaactatgcggacacgctcatcagccaggagagctgtgagaaaagcgagcctcttctgataactcaggatttacttgaaatgaaaggagattccaacctacttcagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 172178 - DNA, 2695 bp, Homo sapiens
  Payload ID: 13847
  Gene Symbol: PCDHGA3
  Gene Name: protocadherin gamma subfamily A, 3
  Uniprot ID: Q9Y5H0
  ENST ID: ENST00000619750
  CDS Start-End: 206-2695
accatttccttgctcctaaaatgcaaagaaccagcaaatcagactcagaagatccggggcggctgccaacctcacctcttagtcaaccagctgtttgacctgtgaattaggcccgtaaaagacttcgtttcttgagaaaataagattggagtccgtcgtaggaaactggaaccgaattcagagaaagcgattcaccgaaaaggaaatgaccaattgcctgagtttccgaaatggcagaggactggccctgctgtgcgcgctcctggggacgctgtgcgaaacaggatccggtcagatccgctactcggtgtctgaggagctagataaaggttccttcgtgggcaacatcgctaacgacctggggctagagccccgggagctggcggagcgcggagtccgcatcgtctccagaggtaggacgcagcttttctctctgaatccgcaaagcggcagcttggtcaccgcggagaggatagaccgggaggagctctgcgctcagatcccgctgtgtctggtaaaaattaacattctggttgaggataaattgaaaatttttgaagtagaaatagaaattaaagatattaatgataatgctcctaatttcccaacagaggaattggaaataaaaattggtgaactaacggttcctggaacccgatttccaattaaaactgcttttgacccagatgtaggcattaactccctgcagaactacaagcttagccccaatgactacttctctctggctgtgaatagcgtctctgagggggccaagtatccagagctggtgctggagcgggccctggaccgtgagaaaaaagaaattcaccagcttgtcctggttgcctctgatggtggcgaccctgtccactctggcaacttgcacatccaagtgatagtcctggatgcaaatgacaacccaccaatgtttactcagcctgagtaccgtgtgagtgtttgggagaacgtgcctgtgggtacccggctgctcacggtgaatgccactgaccctgacgagggattcaatgctcaagtgtcttatattctagataaaatgcctgggaaaatcgctgagattttccatcttaactcagtgagtggagaagtatcaatattaaaaagtctagattatgaggatgccatgttctatgaaattaaaattgaagcacaggatggaccaggtcttctttcaagagccaagattctagtcacggttctggatgtgaatgacaatgctccagaaattacaatcacgtctctcacaagctcagtcccagaagagggcaccgttggaagagaaattgctcttatcgacgtgcatgaccgagattctgggcagaatgggcaggttgaagtttttgtcctgggaaatctgccatttaagttagaaaaatcaatagatcaatattaccgcttagtgacggccacatccctggaccgcgaacaaatatcagaatataacattagtctgagagcctcagatgggggaagcccgccactgtccacagaaactcacatcaccctgcatgtgattgacatcaatgacaacccacccaccttccctcatttatcctactccgcctacattccagaaaacaaccccagaggagcctccatcttctcagtgacagcccaggacccagatagcaacaacaacgcccgcatcacttatgcattgaccgaggacactctccagggggcgcccctgtcctccttcgtctctatcaactccaacactggcgtcctatacgcgctgagatccttcgactacgagcaatttagagacttaaagctactggtgacagccagcgacagcgggaaccctccactcagcagcaacgtgtcgctgaacctgttcgtgctggaccagaacgacaacgcgcccgagatcctgtaccccgccctccccacagacggttccactggcgtggagctggcgcctcgctccgcagagcccggctacctggtgaccaaggtggtggcggtggacagagactcgggccagaacgcctggctgtcctaccgcctgctcaaggccagcgagccgggactcttctcggtgggtctgcacacgggcgaggtgcgcacggcgcgagccctgctggacagagacgcgctcaagcagagcctcgtggtggccgtccaggaccacggccagccccctctctccgccactgtcacgctcaccgtggccgtggccgacaggatccccgacatcctggccgacctgggcagcctcgagccctccgccaaacccaacgattcggacctcactctgtacctggtggtggcggtggccgcggtctcctgcgtcttcctggccttcgtcatcgtgctgctggcgctcaggctgcggcgctggcacaagtcacgcctgctgcaggcttcgggaggcggcttggcgagtacgcccggctcgcactttgtgggcgcggacggggttcgggctttcctgcagacctattcccacgaggtctccctcactgcggactcgcggaagagccacctgattttcccccagcccaactatgcggacacgctcatcagccaggagagctgtgagaaaagcgagcctcttctgataactcaggatttacttgaaatgaaaggagattccaacctacttcaggtgagtttatttatttctttgattattaagaacaaatatgagaatgtggttattataaagctttaa

SEQ ID NO: 172179 - DNA, 2712 bp, Homo sapiens
  Payload ID: 13847
  Gene Symbol: PCDHGA3
  Gene Name: protocadherin gamma subfamily A, 3
  ENST ID: ENST00000612467
  CDS Start-End: 1-324
atgaccaattgcctgagtttccgaaatggcagaggactggccctgctgtgcgcgctcctggggacgctgtgcgaaacaggatccggtcagatccgctactcggtgtctgaggagctagataaaggttccttcgtgggcaacatcgctaacgacctggggctagagccccgggagctggcggagcgcggagtccgcatcgtctccagaggtaggacgcagcttttctctctgaatccgcaaagcggcagcttggtcaccgcggagaggatagaccgggaggagctctgcgctcagatcccgctgtgtctgaggaattggaaataaaaattggtgaactaacggttcctggaacccgatttccaattaaaactgcttttgacccagatgtaggcattaactccctgcagaactacaagcttagccccaatgactacttctctctggctgtgaatagcgtctctgagggggccaagtatccagagctggtgctggagcgggccctggaccgtgagaaaaaagaaattcaccagcttgtcctggttgcctctgatggtggcgaccctgtccactctggcaacttgcacatccaagtgatagtcctggatgcaaatgacaacccaccaatgtttactcagcctgagtaccgtgtgagtgtttgggagaacgtgcctgtgggtacccggctgctcacggtgaatgccactgaccctgacgagggattcaatgctcaagtgtcttatattctagataaaatgcctgggaaaatcgctgagattttccatcttaactcagtgagtggagaagtatcaatattaaaaagtctagattatgaggatgccatgttctatgaaattaaaattgaagcacaggatggaccaggtcttctttcaagagccaagattctagtcacggttctggatgtgaatgacaatgctccagaaattacaatcacgtctctcacaagctcagtcccagaagagggcaccgttggaagagaaattgctcttatcgacgtgcatgaccgagattctgggcagaatgggcaggttgaagtttttgtcctgggaaatctgccatttaagttagaaaaatcaatagatcaatattaccgcttagtgacggccacatccctggaccgcgaacaaatatcagaatataacattagtctgagagcctcagatgggggaagcccgccactgtccacagaaactcacatcaccctgcatgtgattgacatcaatgacaacccacccaccttccctcatttatcctactccgcctacattccagaaaacaaccccagaggagcctccatcttctcagtgacagcccaggacccagatagcaacaacaacgcccgcatcacttatgcattgaccgaggacactctccagggggcgcccctgtcctccttcgtctctatcaactccaacactggcgtcctatacgcgctgagatccttcgactacgagcaatttagagacttaaagctactggtgacagccagcgacagcgggaaccctccactcagcagcaacgtgtcgctgaacctgttcgtgctggaccagaacgacaacgcgcccgagatcctgtaccccgccctccccacagacggttccactggcgtggagctggcgcctcgctccgcagagcccggctacctggtgaccaaggtggtggcggtggacagagactcgggccagaacgcctggctgtcctaccgcctgctcaaggccagcgagccgggactcttctcggtgggtctgcacacgggcgaggtgcgcacggcgcgagccctgctggacagagacgcgctcaagcagagcctcgtggtggccgtccaggaccacggccagccccctctctccgccactgtcacgctcaccgtggccgtggccgacaggatccccgacatcctggccgacctgggcagcctcgagccctccgccaaacccaacgattcggacctcactctgtacctggtggtggcggtggccgcggtctcctgcgtcttcctggccttcgtcatcgtgctgctggcgctcaggctgcggcgctggcacaagtcacgcctgctgcaggcttcgggaggcggcttggcgagtacgcccggctcgcactttgtgggcgcggacggggttcgggctttcctgcagacctattcccacgaggtctccctcactgcggactcgcggaagagccacctgattttcccccagcccaactatgcggacacgctcatcagccaggagagctgtgagaaaagcgagcctcttctgataactcaggatttacttgaaatgaaaggagattccaacctacttcagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggcc

SEQ ID NO: 172180 - DNA, 4778 bp, Homo sapiens
  Payload ID: 13848
  Gene Symbol: PCDHGA4
  Gene Name: protocadherin gamma subfamily A, 4
  ENST ID: ENST00000571252
  CDS Start-End: 84-2972
tcacaagatttctgcagcacaaagcactggctctggagctttatgaaagcttcaagcggaagccctgagagctctggctgtgaatgcactttattttggacccagaagatcctggggctcctcaggcctcgacagagggaaaaccgaagcacaggcgactccgcggcggggttgtaatggcggcgcctcctgctcgcccagaccacacccggctgctccagatctgccttctcctgggggttctggtggaaatcagggccgaacagattctctactcggtgtttgaggagcaggaagaaggctcagtggtgggcaacatcgccaaggacctggggttggcgccccgggagctggcggagcgcggagtccgcatcgtctccagaggtaggacgcagcttttcgccctgaacccgcgcagcggcaccttggtcaccgcgggtaggatagacagggaggagctctgcgacagatctccaaactgtgtgacaaacctggagattcttctagaagatacagtgaagattttgcgggtagaggtggaaataatcgatgttaatgataacccacccagttttgggacagaacagagggaaataaaagttgctgaaaatgaaaatcctggggcaagatttcctcttcctgaagcttttgatccggatgtaggtgtaaactccctgcagggttaccagctcaactcaaacggttacttttccctggacgtgcaaagtggggccgatgggattaagtacccagagctggtgctggaacgcgctctagatcgcgaggaagaggcggttcaccacctcgttctcacggccttcgatggaggtgacccggttcgctctggcactgccaggattctcataatacttgtggataccaacgataatgctcccgtgttcactcagcccgagtaccacgtaagtgttcgtgagaacgttcctgtaggcactcggctactcaccgtaaaagccactgatccagatgaaggagccaatggagacgtgacgtattctttccggaaagtaagagacaaaatatcacagctatttcagttgaattctctgagtggggatataacaatattggggggtctagattatgaggactctggattctatgacatagatgtagaagcccatgatgggcctggtctccgagctagaagcaaggtactggtgacagttctggatgaaaatgacaacgcaccagaagtcacagttacatctctcaccagctcagtccaggaatcttcttccccgggtacagtaattgcacttttcaacgtgcatgacagtgactcaggaggaaatggcctagtcacatgttctattccagataatctgccattcacacttgaaaagacctatggaaattattatcggttgttgacacacagaacactggacagggaagaagtctcagaatataacatcactgtaactgccactgaccagggaactcctccactgtctacagaaactcatatttcactgcaagtgatggacatcaatgacaacccacccactttccctcatgcttcctactctgcttacattcctgaaaacaaccccagaggagcctccatcttatctatgactgctcaagaccctgacagtggtgacaatgcccgaatcacttactccctggccgaagacaccttccagggtgcacctctgtcctcctatgtctccatcaactccaatacagggatcctatatgctctttgctccttcgactatgagcagtttagagacctgcagctgctgatgacagccagtgacagtggagaccctccactcagcagcaatgtgtcactgagcctctttgtgctggaccagaacgacaatgtccctgagatcctgtaccccaccttccctactgatggctccactggtgtggagctggcaccccgctccgcagattccggctacctggtgaccaaagtggtggcagtggacagagactcaggtcagaatgcctggctgtcctacagcctactcaagtccagcgagccgggactatttgcagtggggctgcacacaggcgaggtgcgcaccgcacgggccctgctggacagagacgcgctcaagcagaggcttgtagtggtcgtccaggaccatggccagccccctctctcggccaccgtcacactcactgtggctgtggccgacagcatcccagatgtcctggctgacttgggcagcctcaagccttcagcagacccagacgactcgggcctcacactctatctcgtggtggcagtggccgctgtctcctgcgtcttcctggcttttgtcacggtgctgctagcactcaagctgagacgctggcacaagtcacgcctgcttcacgctgaaggcagcaggttggcaggtgtgcctgcctcgcactttgtgggcgtggacggggttcgggctttcctgcagacctattcccacgaggtctccctcaccgcggactcgcggaagagtcacctgatcttctcccaacccagctatgcagacacgctcatcagccgggagagttgtgagaaaagcgagcctcttctgataactcaggatttacttgaaacaaaaggagaccctaatcttcagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 172181 - DNA, 2691 bp, Homo sapiens
  Payload ID: 13848
  Gene Symbol: PCDHGA4
  Gene Name: protocadherin gamma subfamily A, 4
  ENST ID: ENST00000612927
  CDS Start-End: 69-2624
agcacaaagcactggctctggagctttatgaaagcttcaagcggaagccctgagagctctggctgtgaatgcactttattttggacccagaagatcctggggctcctcaggcctcgacagagggaaaaccgaagcacaggcgactccgcggcggggttgtaatggcggcgcctcctgctcgcccagaccacacccggctgctccagatctgccttctcctgggggttctggtggaaatcagggccgaacagattctctactcggtgtttgaggagcaggaagaaggctcagtggtgggcaacatcgccaaggacctggggttggcgccccgggagctggcggagcgcggagtccgcatcgtctccagaggtaggacgcagcttttcgccctgaacccgcgcagcggcaccttggtcaccgcgggtaggatagacagggaggagctctgcgacagatctccaaactgtgtgacaaacctggagattcttctagaagatacagtgaagattttgcgggtagaggtggaaataatcgatgttaatgataacccacccagttttgggacagaacagagggaaataaaagttgctgaaaatgaaaatcctggggcaagatttcctcttcctgaagcttttgatccggatgtaggtgtaaactccctgcagggttaccagctcaactcaaacggttacttttccctggacgtgcaaagtggggccgatgggattaagtacccagagctggtgctggaacgcgctctagatcgcgaggaagaggcggttcaccacctcgttctcacggccttcgatggaggtgacccggttcgctctggcactgccaggattctcataatacttgtggataccaacgataatgctcccgtgttcactcagcccgagtaccacgtaagtgttcgtgagaacgttcctgtaggcactcggctactcaccgtaaaagccactgatccagatgaaggagccaatggagacgtgacgtattctttccggaaagtaagagacaaaatatcacagctatttcagttgaattctctgagtggggatataacaatattggggggtctagattatgaggactctggattctatgacatagatgtagaagcccatgatgggcctggtctccgagctagaagcaaggtactggtgacagttctggatgaaaatgacaacgcaccagaagtcacagttacatctctcaccagctcagtccaggaatcttcttccccgggtacagtaattgcacttttcaacgtgcatgacagtgactcaggaggaaatggcctagtcacatgttctattccagataatctgccattcacacttgaaaagacctatggaaattattatcggttgttgacacacagaacactggacagggaagaagtctcagaatataacatcactgtaactgccactgaccagggaactcctccactgtctacagaaactcatatttcactgcaagtgatggacatcaatgacaacccacccactttccctcatgcttcctactctgcttacattcctgaaaacaaccccagaggagcctccatcttatctatgactgctcaagaccctgacagtggtgacaatgcccgaatcacttactccctggccgaagacaccttccagggtgcacctctgtcctcctatgtctccatcaactccaatacagggatcctatatgctctttgctccttcgactatgagcagtttagagacctgcagctgctgatgacagccagtgacagtggagaccctccactcagcagcaatgtgtcactgagcctctttgtgctggaccagaacgacaatgtccctgagatcctgtaccccaccttccctactgatggctccactggtgtggagctggcaccccgctccgcagattccggctacctggtgaccaaagtggtggcagtggacagagactcaggtcagaatgcctggctgtcctacagcctactcaagtccagcgagccgggactatttgcagtggggctgcacacaggcgaggtgcgcaccgcacgggccctgctggacagagacgcgctcaagcagaggcttgtagtggtcgtccaggaccatggccagccccctctctcggccaccgtcacactcactgtggctgtggccgacagcatcccagatgtcctggctgacttgggcagcctcaagccttcagcagacccagacgactcgggcctcacactctatctcgtggtggcagtggccgctgtctcctgcgtcttcctggcttttgtcacggtgctgctagcactcaagctgagacgctggcacaagtcacgcctgcttcacgctgaaggcagcaggttggcaggtgtgcctgcctcgcactttgtgggcgtggacggggttcgggctttcctgcagacctattcccacgaggtctccctcaccgcggactcgcggaagagtcacctgatcttctcccaacccagctatgcagacacgctcatcagccgggagagttgtgagaaaagcgagcctcttctgataactcaggatttacttgaaacaaaaggagaccctaatcttcaggtgagtcaatcttataatagatcataccacactgaaatatagacaaagagttgtgtaaatgtctctcattttatatgtaatatatcaaataaagttgcctcttttaata

SEQ ID NO: 172182 - DNA, 4602 bp, Homo sapiens
  Payload ID: 13849
  Gene Symbol: PCDHGA5
  Gene Name: protocadherin gamma subfamily A, 5
  Uniprot ID: Q9Y5G8
  ENST ID: ENST00000518069
  CDS Start-End: 1-2796
atggcgagtccacctaggggctggggctgcggagagctgctgctgcccttcatgctcctggggacgctgtgcgagccaggatccgggcagatccgctactcgatgccggaggagctggacaaaggctccttcgtcggcaacatagccaaggaccttgggctggagccccaggagctggcggagcgcggagtccgcatcgtctccagaggtaggacgcagctttttgccctgaacccgcgaagcggcagcttggtcaccgcgggcaggatagaccgggaggagctctgcgctcagagcccactgtgtgtggtgaactttaacatcttggttgagaacaaaatgaaaatttatggagtagaagtagaaataatcgatattaatgataacttcccgcgtttccgggatgaagagttaaaagtaaaagttaatgaaaatgcggctgcagggacacggttagtgcttcccttcgcgcgggatgcggatgtgggtgtgaactctctccggagttaccagctcagctccaatctgcacttctctctggatgtggtaagcggaactgatggacaaaagtatccggagctggtgttggaacagcccctagaccgcgagaaagagactgttcacgacctcctcctcacagctttagatggcggagacccggtactctccggcaccacgcacatccgtgttacggtcctcgacgcaaacgacaatgcgcccctgttcaccccatccgagtacagcgtgagtgttccagagaacatacctgtgggcactcggctgctcatgctaaccgccacggatccagatgagggaataaacgggaaattgacctactcttttcgcaatgaagaagaaaaaatttcggagactttccaacttgattccaacctgggggaaatctcaactctacaatcactggactatgaagaatccagattctacctcatggaagtggtagctcaggatggaggcgctcttgttgccagcgctaaggtggtggtcacagtacaggacgtgaatgacaatgcccccgaagtgatcctcacctctctgaccagttcgatctctgaagactgtcttcccggaactgtaatcgcgctgtttagcgtacatgatggtgattctggagaaaatggtgagattgcatgctctattcctaggaatttgccttttaaattggagaagtcagttgataattactatcacctattaacaactagggacctggacagagaagagacttcagattataatatcactttaaccgtcatggaccatggaaccccgcccctctctacagaaagccacatccccttgaaagtagcagacgttaatgacaacccacccaatttccctcaagcctcctactccacctctgtcacagaaaacaatcccagaggtgtctctatcttctctgtgacagcccatgaccccgacagcggcgacaacgctcgagtcacctactccctggctgaagacacatttcagggggcgcccttgtcctcctatgtatccattaactctgacaccggtgtcctgtatgctctgagatccttcgactatgagcagttgagagacctacagttgtgggtgacagccagcgacagtgggaaccctccacttagcagcaacgtgtcgctgagcctgtttgtgctggaccagaacgacaatacgcctgagatcctgtaccccgccctccccacagacggttccacgggcgtggagctggcgcctcgctccgcagaacctggctacctggtgaccaaggtggtagcggtggacaaagattcaggccagaacgcctggctgtcctaccgcctgcttaaggccagcgagccaggactctttgcggttgggctgcacacgggcgaggtgcgcacagcgcgagccctgctggacagagacgcgctcaagcagagcctcgtggtggccgtcgaagaccatggccagccccctctgtcagccaccttcacggtcaccgttgccgtggccgacaggatccctgacatcctggctgacctaggcagtatcaagacccccattgaccctgaggatctggacctcacactctatcttgtggtggcagtggctgcagtctcctgcgtcttcctggccttcgtcatcgtgctgctggtgctcagactgaggcgctggcacaagtcacgcctgcttcaggctgaaggcagcaggttggcgggtgtgcccgcctcgcactttgtgggcgtggatggggttcgggctttcctgcagacctattcccacgaggtctccctcaccgcggactcgaggaagagtcacctgatctttccccagcccaactacgcagacacgctccttagtgaagagagctgtgagaaaagcgagcctcttctgatgtctgataaggtagatgcaaacaaagaagaacggcgagttcagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 172183 - DNA, 3552 bp, Homo sapiens
  Payload ID: 13849
  Gene Symbol: PCDHGA5
  Gene Name: protocadherin gamma subfamily A, 5
  Uniprot ID: Q9Y5G8
  ENST ID: ENST00000611914
  CDS Start-End: 100-2541
gcccattttcgtcagggaatatgtacccatcggctttagataaataaggaaacagcaggctgaaccagaactaagagaaaattgggcagagagaaggcaatggcgagtccacctaggggctggggctgcggagagctgctgctgcccttcatgctcctggggacgctgtgcgagccaggatccgggcagatccgctactcgatgccggaggagctggacaaaggctccttcgtcggcaacatagccaaggaccttgggctggagccccaggagctggcggagcgcggagtccgcatcgtctccagaggtaggacgcagctttttgccctgaacccgcgaagcggcagcttggtcaccgcgggcaggatagaccgggaggagctctgcgctcagagcccactgtgtgtggtgaactttaacatcttggttgagaacaaaatgaaaatttatggagtagaagtagaaataatcgatattaatgataacttcccgcgtttccgggatgaagagttaaaagtaaaagttaatgaaaatgcggctgcagggacacggttagtgcttcccttcgcgcgggatgcggatgtgggtgtgaactctctccggagttaccagctcagctccaatctgcacttctctctggatgtggtaagcggaactgatggacaaaagtatccggagctggtgttggaacagcccctagaccgcgagaaagagactgttcacgacctcctcctcacagctttagatggcggagacccggtactctccggcaccacgcacatccgtgttacggtcctcgacgcaaacgacaatgcgcccctgttcaccccatccgagtacagcgtgagtgttccagagaacatacctgtgggcactcggctgctcatgctaaccgccacggatccagatgagggaataaacgggaaattgacctactcttttcgcaatgaagaagaaaaaatttcggagactttccaacttgattccaacctgggggaaatctcaactctacaatcactggactatgaagaatccagattctacctcatggaagtggtagctcaggatggaggcgctcttgttgccagcgctaaggtggtggtcacagtacaggacgtgaatgacaatgcccccgaagtgatcctcacctctctgaccagttcgatctctgaagactgtcttcccggaactgtaatcgcgctgtttagcgtacatgatggtgattctggagaaaatggtgagattgcatgctctattcctaggaatttgccttttaaattggagaagtcagttgataattactatcacctattaacaactagggacctggacagagaagagacttcagattataatatcactttaaccgtcatggaccatggaaccccgcccctctctacagaaagccacatccccttgaaagtagcagacgttaatgacaacccacccaatttccctcaagcctcctactccacctctgtcacagaaaacaatcccagaggtgtctctatcttctctgtgacagcccatgaccccgacagcggcgacaacgctcgagtcacctactccctggctgaagacacatttcagggggcgcccttgtcctcctatgtatccattaactctgacaccggtgtcctgtatgctctgagatccttcgactatgagcagttgagagacctacagttgtgggtgacagccagcgacagtgggaaccctccacttagcagcaacgtgtcgctgagcctgtttgtgctggaccagaacgacaatacgcctgagatcctgtaccccgccctccccacagacggttccacgggcgtggagctggcgcctcgctccgcagaacctggctacctggtgaccaaggtggtagcggtggacaaagattcaggccagaacgcctggctgtcctaccgcctgcttaaggccagcgagccaggactctttgcggttgggctgcacacgggcgaggtgcgcacagcgcgagccctgctggacagagacgcgctcaagcagagcctcgtggtggccgtcgaagaccatggccagccccctctgtcagccaccttcacggtcaccgttgccgtggccgacaggatccctgacatcctggctgacctaggcagtatcaagacccccattgaccctgaggatctggacctcacactctatcttgtggtggcagtggctgcagtctcctgcgtcttcctggccttcgtcatcgtgctgctggtgctcagactgaggcgctggcacaagtcacgcctgcttcaggctgaaggcagcaggttggcgggtgtgcccgcctcgcactttgtgggcgtggatggggttcgggctttcctgcagacctattcccacgaggtctccctcaccgcggactcgaggaagagtcacctgatctttccccagcccaactacgcagacacgctccttagtgaagagagctgtgagaaaagcgagcctcttctgatgtctgataaggtagatgcaaacaaagaagaacggcgagttcaggttagttttctctttcggtaaggatgaccagaacattttcatttgtttcctttttcatgtttctgtcatattcagaatcagctagttatgtaaatagtggaacattatttgctgtattggagattaattttttttatataattcatgctttctccatttgttttcaaattctgttttgggaagtctagctgatatctgtagacttaagtgaaacaaataccttaaaggaaagtggttaaatataatcattttacccaaatattttgttatattggaactgcagttctattaatagaaaagatgttttatttattcaaattgttagatatattgttctcttttgagtgtctgcctagacaccattagtgaatgtgttttggaaaggataatgtataggactgatattttagtctacctgaaatttgtttaaggaaataatttacagtatttacataaatcagtggaaaggtacagagaacttctgggtcataaatatcagaaaagaggccgggtgcggtggctgacgcctgtaatcccagcactttgggaggctgaggtgggcggatcacgaggtcaggagatcgagaccatcctggctaacacggtgaaaccctgttctactaaaaatacaaaaaattagccgggcgtggtggcaggcgcctgtagtcccagctactcggaaggctgaggcaggagaatggggtgaacccgggaggaggagcttgcagtaagccgagatcgcgccactgcactccagcctgggagacagaacgagactccgtctcaaaataaataaataaataaataaataaataaataaatatcagaaaagtagataaaatttatattaatgataacatgtagcattctaaagtctggaaagtttgtgttaagccatgtagttattggatatgtgggcttgttgagagaagaaatcagtgtaaaggaaccttaaggttgggcttcgttctgtgatgtaaagcctccagagagttacatactgctgcactcaataaatgtaaatatgtcaca

SEQ ID NO: 172184 - DNA, 4775 bp, Homo sapiens
  Payload ID: 13850
  Gene Symbol: PCDHGA6
  Gene Name: protocadherin gamma subfamily A, 6
  Uniprot ID: Q9Y5G7
  ENST ID: ENST00000517434
  CDS Start-End: 171-2969
gcaaattagacgggaaagcaggaaagctgtgcagaaattctgacctgaaacgcttcgcatccggtctctgcttgttgaaggaccttcaccgctatttctgagaagagcaaaagtgatgcagatctgttcttcctcttcttaatcccagagaagttcctaataagccagtaatggcgcctccgcagaggcatccgcagcgcagcgagcaggtcctgctcctcacgctcctggggacgctgtggggggccgcggcagcgcagatccgctactctattcccgaggagctggagaaaggctccttcgtaggcaacatcgtcaaggatctgggactggagccccaggagttggcggagcacggagtccgcatcgtctccagaggtaggatgcagcttttctctctgaatccgcgaaacggcagcttggtcaccgcgggtaggatagaccgcgaggagctctgtgctcagagcccgcggtgtctggtgagttttaacatccttgtcgaggataaactgaatctttatcccgtggaagtggaaatagtggacattaatgacaatacaccccgattcttaaaggaagaattggaagtgaaaattctcgaaaacgcagctccatcctctcgttttccactaatggaggtctatgaccctgatgtgggaatgaactcccttcagggatttaagctcagtggtaatagtcacttctcagtggacgtgcaaagcgaagcccatgggcccaagtacccggagctggtgctggagggcacactggaccgggaaggagaagccgtttaccgcctggtccttactgccatggatggcggcgaccctgtccgctcaagcgtcgcccaaattctggtaacagttctagatgtgaatgacaacactccaatgtttactcagcctgtctaccgtgtaagtgttcctgaaaacctgccagtaggcacaccagtgttggcagtgactgccaccgaccaggatgaaggagtccacggggaagtaacttattcctttgtgaagattacagaaaagatctcacaaattttctgtttgaatgttttgactggagaaatttcaacttctgcaaatctagactatgaggactcgagtttttatgagctgggtgttgaagcccgggatgggccaggtcttcgagacagagcgaaagtcttaataactatcttggatgtcaatgataatgtaccagaagtggttgttacatctggaagcagaacaattgctgaaagtgcacctccaggaacagtaatcgccctttttcaagtgttcgatcgagactctggcctgaatggcctggtaacctgttccatcccgagaagtctcccatttgaattggaaaaatcagttggcaattattatcgattagtgacaaatgcagctctagaccgggaagaggtattcttgtacaacatcactgtgacagccacggacaaaggaacaccacctctgtctacagaaacaatcatctctctaaatgtggcagacaccaacgacaacccgcccaccttcccccattcatcctactcagtctatgtccttgaaaacaaccccaggggtgcctccatcttctctgtgaatgcactggaccctgacgtggaccagaacgcccaagtctcctactcactggcagaagacaccctccagggggcgcccctgtcctcctacgtgtccatcaactccgacactgggattctgtacgccctgcgctccttcgactatgagcagttgagagacctacagctgtgggtgacagccagcgacagcggggacccgcctcttagcagcaacgtgtcactgagcctgtttgtgctggaccagaatgacaatgcgcccgagatcctgtaccccgccctccccacagacggttccactggcgtggagctggcgccccgctccgcagagcccggctacctggtgaccaaggtggtggcggtggacagagactcgggccagaacgcctggctgtcctaccgcctgctcaaggccagcgagccaggacttttctcagtgggcctgcacacgggcgaggtgcgcacggcgcgcgccctgctggacagagacgcgctcaagcagagcctagtggtggccgtccaggaccacggccagccccctctctccgccactgtcacgctcaccgtggccgtggccgacaggatccccgacatcctggccgacctgggcagcctcgagccctccgccaaacccaacgattcggacctcactctgtacctggtggtggcggtggccgcggtctcctgcgtcttcctggccttcgtcatcgtgctgctggcgctcagactgcagcgctggcacaagtcacgcctgctgcaggcttcgggaggtggcttagcgagcatgcccggctcgcactttgtgggcgtggaaggggttcgggctttcctgcagacctattcccacgaggtctcactcactgcagactcgcgtaagagtcatctgattttcccccagcccaactatgccgacacgcttatcaaccaggagagctatgagaaaagcgagcctcttctgataactcaggatttacttgaaacgaaaggagaacccaggcaacttcagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 172185 - DNA, 5650 bp, Homo sapiens
  Payload ID: 13850
  Gene Symbol: PCDHGA6
  Gene Name: protocadherin gamma subfamily A, 6
  Uniprot ID: Q9Y5G7
  ENST ID: ENST00000610583
  CDS Start-End: 92-2548
ggaccttcaccgctatttctgagaagagcaaaagtgatgcagatctgttcttcctcttcttaatcccagagaagttcctaataagccagtaatggcgcctccgcagaggcatccgcagcgcagcgagcaggtcctgctcctcacgctcctggggacgctgtggggggccgcggcagcgcagatccgctactctattcccgaggagctggagaaaggctccttcgtaggcaacatcgtcaaggatctgggactggagccccaggagttggcggagcacggagtccgcatcgtctccagaggtaggatgcagcttttctctctgaatccgcgaaacggcagcttggtcaccgcgggtaggatagaccgcgaggagctctgtgctcagagcccgcggtgtctggtgagttttaacatccttgtcgaggataaactgaatctttatcccgtggaagtggaaatagtggacattaatgacaatacaccccgattcttaaaggaagaattggaagtgaaaattctcgaaaacgcagctccatcctctcgttttccactaatggaggtctatgaccctgatgtgggaatgaactcccttcagggatttaagctcagtggtaatagtcacttctcagtggacgtgcaaagcgaagcccatgggcccaagtacccggagctggtgctggagggcacactggaccgggaaggagaagccgtttaccgcctggtccttactgccatggatggcggcgaccctgtccgctcaagcgtcgcccaaattctggtaacagttctagatgtgaatgacaacactccaatgtttactcagcctgtctaccgtgtaagtgttcctgaaaacctgccagtaggcacaccagtgttggcagtgactgccaccgaccaggatgaaggagtccacggggaagtaacttattcctttgtgaagattacagaaaagatctcacaaattttctgtttgaatgttttgactggagaaatttcaacttctgcaaatctagactatgaggactcgagtttttatgagctgggtgttgaagcccgggatgggccaggtcttcgagacagagcgaaagtcttaataactatcttggatgtcaatgataatgtaccagaagtggttgttacatctggaagcagaacaattgctgaaagtgcacctccaggaacagtaatcgccctttttcaagtgttcgatcgagactctggcctgaatggcctggtaacctgttccatcccgagaagtctcccatttgaattggaaaaatcagttggcaattattatcgattagtgacaaatgcagctctagaccgggaagaggtattcttgtacaacatcactgtgacagccacggacaaaggaacaccacctctgtctacagaaacaatcatctctctaaatgtggcagacaccaacgacaacccgcccaccttcccccattcatcctactcagtctatgtccttgaaaacaaccccaggggtgcctccatcttctctgtgaatgcactggaccctgacgtggaccagaacgcccaagtctcctactcactggcagaagacaccctccagggggcgcccctgtcctcctacgtgtccatcaactccgacactgggattctgtacgccctgcgctccttcgactatgagcagttgagagacctacagctgtgggtgacagccagcgacagcggggacccgcctcttagcagcaacgtgtcactgagcctgtttgtgctggaccagaatgacaatgcgcccgagatcctgtaccccgccctccccacagacggttccactggcgtggagctggcgccccgctccgcagagcccggctacctggtgaccaaggtggtggcggtggacagagactcgggccagaacgcctggctgtcctaccgcctgctcaaggccagcgagccaggacttttctcagtgggcctgcacacgggcgaggtgcgcacggcgcgcgccctgctggacagagacgcgctcaagcagagcctagtggtggccgtccaggaccacggccagccccctctctccgccactgtcacgctcaccgtggccgtggccgacaggatccccgacatcctggccgacctgggcagcctcgagccctccgccaaacccaacgattcggacctcactctgtacctggtggtggcggtggccgcggtctcctgcgtcttcctggccttcgtcatcgtgctgctggcgctcagactgcagcgctggcacaagtcacgcctgctgcaggcttcgggaggtggcttagcgagcatgcccggctcgcactttgtgggcgtggaaggggttcgggctttcctgcagacctattcccacgaggtctcactcactgcagactcgcgtaagagtcatctgattttcccccagcccaactatgccgacacgcttatcaaccaggagagctatgagaaaagcgagcctcttctgataactcaggatttacttgaaacgaaaggagaacccaggcaacttcaggtgagtttctttccgcctaagcgggaagagtaatctgatcttcccgcaacccaactaatcagacaggctcatcagctagatcggctgttatagaagcgaacctcttttggtacaggaagattcgtgattttgtaaagtggaagactcccttgttcaggtgagggtatcgtttttttttttttttttttttgagacggagtctcgctctgtcgcccaggccggactgcggactgcagtggcgcaatctcggctcactgcaagctccgcttcccgggttcacgccattctcctgcctcagcctccctagtagctgggactacaggcgcccgccaccgcgcccggctaatttttttgtatttttagtagagacggggtttcaccttgttagccaggatggtctcgatctcctgacctcatgatccacccgcctcggcctcccaaagtgctgggattacaggcgtgagccaccgcgcccggccgagggtatcgtttttattggttgacaggaaaattcaagattgtctttgattagtgcttagttttcttagccctttgcagagagtcacataattctaatgtttttcttttatatcaaaagaatgttctgaagtcttaattttgtgggggaaaataatgcatgtcctagtttttctttacctttctcttcttggcaaactatttgtgtcttggattgagtacatctcgtttcttaggttttttcctactatgtgacatttgtaaggttctttctttttctaatgtgggaaaaaaaataaccttaatttaggtcagtgttaaagatcaagatcttggttttagctagcatggtggttcacgcctgtaatcccacctcttcaggaggctgaggcaggaggatcccttgagaccaggagtttgagaccagcctgggtgactctgtctctaccaaaaagaaaaaaaagtagccagatgtgtggcgtacacctgtagtcccagctactcgagaagctctgataggaggattgcttaagtccaggggtatgaggctgcagtgagatataattgtgtcactgcaccctagcctgggagacagaatgagactttttctctctctctctcaaaaaaaaaaaaagattttgttttttctcagtgttacttgataactataaacgacagacgttcatacaagagatctttcacctttactacttaggaatcaaaaattatttttgaaaagataagaatcattggtaactgcagcaggggacaccagatctttggtgttaaaagacctgaataacattcctgtaactatctgttatttacttgggccagttacaatcgccattatcttccaattaaaattaagatttaaaagacttctcttatcagagataggatccccctctgttgcccagtctggagtaaaaatccacctgtaactgctgcttatagagtgtgtatccagggcaacttgaatctatgttcctgggttgcaatcctaaagcttggctcaaataagctctacttatattattttttaaaacaagactttccttatctatctgactcaaattctaagaaaataattttataactttttttcaaactctaaagcagcatagtgaacacgtatttgttgacatcaccattattataattattgggttgttaacaataactaagcaccgatgctgtgtgcctactacagtgtcttttgcatactgtgtgcctgatagtatttaagagtgaaaatggccgggtgcggtggctcatgcctgtaatcccaacactttgggaggccaaggcaggcatctcacgaagtcaggagttcgagaccagcctgaccaacatggtgaaaccccgtctctactaaaaatacaaaaattagccaggtggggtggcatgggcctgtaatcgcagctactcgggaggctgaggcaggagaatcgcttgaacccatgaggcagaggttgcagtgagccaagatcgtgccactgcactccagtctgggtgacagagcgagactctgtctcaaaaaataataatgataattaataaataaagagtgaacatgaattttaaaacatgctcggtagtgtctgcttacaggacatatctctaaaaatagatgactgactggtgaatgggagaacaaatgttaatgaggttcaaataaaaatttaaatattttagcattttaacccagacaataaggctttcatcatataggaactctttattgaaatatttcaagaaaaaagggattatcatttagaagactgattagtcttatttattatgactgaaatgtgcaaacagaatcattgtttcatgaacagaaaacagcagagtttttgactgtcaatgatgttcgaatagaaaatggatcactaaggagataggagattctgttatcgacagtcttcaaaagtaagttgatggccctggaatgaatggagtacaggggattctctaatttgatgacttgttgaactacattatagtcaagatttttctccagtcatgagttggaagattctacaatctggtggtattatagaatggattggccacttgtgcatctgaatttgttatgaatgtgtaagaaaaaagcaattgagaagataccttgaaaataaatgagaacctcctttgtaacctgactttgtcagtcttcttaaagataacattgagttgatgtgtttttaaataagctgctaagagtaatatgtgtttttctgaaccaatattgtggtatttacatttaaggaattgttatagatttatttatttcaagtttccaaaggtatatacctaaacaagagatctaatcatacacatcttcaaagctcattttcttgtatctttgtgatataatttgataaaataacaattttaaacaacttgaatcttggatattagtctcatgagttagatgggctgttatacatatgattatttcataaactctgaaagtgtgaatgttattttactatactaccaatttgggatgttaaactacatcttgagcatttgttgttatagggaaagctcactaactacttttcatggagatcaggctggtttattttattctcttattacctgtgaccatttcatttaaacaaataaaatatttctctgatggaaaaa

SEQ ID NO: 172186 - DNA, 4605 bp, Homo sapiens
  Payload ID: 13851
  Gene Symbol: PCDHGA7
  Gene Name: protocadherin gamma subfamily A, 7
  Uniprot ID: Q9Y5G6
  ENST ID: ENST00000518325
  CDS Start-End: 1-2799
atggcggctcagccgaggggcggggactacagaggattcttcctgctctccatcctcctggggaccccctgggaagcctgggcaggacgtattctctactccgtgtcggaggagacggacaaagggtcctttgtgggagacatcgccaaggacctggggctggagccccgggagctggcggagcgcggagtccgcatcatctccagaggtaggacgcagcttttcgccctgaaccagcgcagcggcagcttggtcactgcgggcaggatagaccgggaagagatctgcgctcagagtgcgcggtgtctggtaaactttaacatcctgatggaagataaaatgaatctttaccctatagacgtggaaataatagatattaatgacaacgttccaagattcttgacggaagaaataaatgtaaaaataatggagaatacagctcctggggttcggtttccgttaagcgaggctggggatccagatgtgggcacgaactccctccagagttaccagctcagccccaatcgccacttctccctggctgtgcaaagtggagacgatgaaactaagtacccggaactggtgctggagcgggtgctggaccgggaggaagagcgggttcaccacctggtcctcacagcctctgatggcggcgacccgccccgatccagcaccgcccacatccaggtgacagtggtggatgtgaatgaccacacgcctgtcttctctctgcctcagtaccaagtaactgtccccgagaatgtgccagtgggtacaagactgctcacggtacatgctatcgacctggacgagggagtcaatggggaagtgacatattcttttcggaaaataactcctaaacttccaaagatgtttcatctgaactcgcttacaggagaaatatcaactttagaaggattagattatgaagaaactgccttctatgaaatggaggttcaggctcaagatggtcctggtagtctgacaaaggcaaaagtactgatcacagttttagatgtaaatgataatgctccagaagtgactatgacgtctttaagtagctcaatccctgaagacacacctcttgggacagtcattgctcttttctacctacaagacagagattctggaaagaatggtgaggtgacctgcaccattccagaaaacctaccttttaaattagaaaaatcaatagataattattatagattggtcacaaccaaaaacttggaccgggaaacactctctttgtataacatcacactgaaagccacagatggtggaactcctcccttgtccagggaaactcacatattcatgcaggtggcagacaccaacgataacccacccaccttcccccactcatcctactcagtctacatcgctgagaacaaccccagaggggcctccattttcttagtgactgcacaggaccacgacagtgaggataatgcccagatcacttattccttggccgaagacaccatccagggggctccagtgtcctcctatgtctccataaactctgacactggagtcctgtacgcgctgcaatcctttgattatgagcagttgagagaactacaactaagagtgactgcacatgacagcggggacccgcctctcagcagcaacatgtcactgagcctgttcgtgctggaccagaatgacaacccgcccgagatcctgtacccggccctccccacagatggttctactggcatggagctggcaccccgctccgcagagcccggctacctggtgaccaaggtggtggcggtggacaaagattcaggccagaacgcctggctgtcatacctcctgcttaaggccagcgagccaggactctttgcggttgggctgtacacgggcgaggtgcgcacggctcgggccctgctggacagagatgccctcaagcagagcctcgtggtggccgtccaggaccacggtcagcctcctctgtcagccaccgtcacactcaccgtggctgtggctgacagcatccccgaagtcttggccgacctgggcagccttgagccctccgacggtccttacaactatgacctcacgttgtacctggtggtggcggtggccacagtctcctgcgtcttcctagccttcgtcctcgtactgctggcgctcaggctgcggcgctggcacaagtcacgcctgctgcaggcttcagaaggtggcttggcgaacgtgcccacctcgcactttgtgggcatggacggggtgcaggctttcctgcagacctattcccatgaggtctccctcaccgcggactctcggaagagtcacctgatcttcccccagcccaactatgtagacatgctcatcagccaggagagctgtgagaaaaatgattctttgctaacatccgtagattttcaggaatgtaaagaaaacctgccaagtattcagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 172187 - DNA, 3262 bp, Homo sapiens
  Payload ID: 13851
  Gene Symbol: PCDHGA7
  Gene Name: protocadherin gamma subfamily A, 7
  Uniprot ID: Q9Y5G6
  ENST ID: ENST00000617050
  CDS Start-End: 162-2615
gacagattgcgataagccctcttccaggctgcactaaactcaagcctctatcctgctggattctgagctccccttcctaagacagaggggtccacccggatacacccgcattctgaagcacttcccgagatcggcgcctaagcaagagaagcaggacgactatggcggctcagccgaggggcggggactacagaggattcttcctgctctccatcctcctggggaccccctgggaagcctgggcaggacgtattctctactccgtgtcggaggagacggacaaagggtcctttgtgggagacatcgccaaggacctggggctggagccccgggagctggcggagcgcggagtccgcatcatctccagaggtaggacgcagcttttcgccctgaaccagcgcagcggcagcttggtcactgcgggcaggatagaccgggaagagatctgcgctcagagtgcgcggtgtctggtaaactttaacatcctgatggaagataaaatgaatctttaccctatagacgtggaaataatagatattaatgacaacgttccaagattcttgacggaagaaataaatgtaaaaataatggagaatacagctcctggggttcggtttccgttaagcgaggctggggatccagatgtgggcacgaactccctccagagttaccagctcagccccaatcgccacttctccctggctgtgcaaagtggagacgatgaaactaagtacccggaactggtgctggagcgggtgctggaccgggaggaagagcgggttcaccacctggtcctcacagcctctgatggcggcgacccgccccgatccagcaccgcccacatccaggtgacagtggtggatgtgaatgaccacacgcctgtcttctctctgcctcagtaccaagtaactgtccccgagaatgtgccagtgggtacaagactgctcacggtacatgctatcgacctggacgagggagtcaatggggaagtgacatattcttttcggaaaataactcctaaacttccaaagatgtttcatctgaactcgcttacaggagaaatatcaactttagaaggattagattatgaagaaactgccttctatgaaatggaggttcaggctcaagatggtcctggtagtctgacaaaggcaaaagtactgatcacagttttagatgtaaatgataatgctccagaagtgactatgacgtctttaagtagctcaatccctgaagacacacctcttgggacagtcattgctcttttctacctacaagacagagattctggaaagaatggtgaggtgacctgcaccattccagaaaacctaccttttaaattagaaaaatcaatagataattattatagattggtcacaaccaaaaacttggaccgggaaacactctctttgtataacatcacactgaaagccacagatggtggaactcctcccttgtccagggaaactcacatattcatgcaggtggcagacaccaacgataacccacccaccttcccccactcatcctactcagtctacatcgctgagaacaaccccagaggggcctccattttcttagtgactgcacaggaccacgacagtgaggataatgcccagatcacttattccttggccgaagacaccatccagggggctccagtgtcctcctatgtctccataaactctgacactggagtcctgtacgcgctgcaatcctttgattatgagcagttgagagaactacaactaagagtgactgcacatgacagcggggacccgcctctcagcagcaacatgtcactgagcctgttcgtgctggaccagaatgacaacccgcccgagatcctgtacccggccctccccacagatggttctactggcatggagctggcaccccgctccgcagagcccggctacctggtgaccaaggtggtggcggtggacaaagattcaggccagaacgcctggctgtcatacctcctgcttaaggccagcgagccaggactctttgcggttgggctgtacacgggcgaggtgcgcacggctcgggccctgctggacagagatgccctcaagcagagcctcgtggtggccgtccaggaccacggtcagcctcctctgtcagccaccgtcacactcaccgtggctgtggctgacagcatccccgaagtcttggccgacctgggcagccttgagccctccgacggtccttacaactatgacctcacgttgtacctggtggtggcggtggccacagtctcctgcgtcttcctagccttcgtcctcgtactgctggcgctcaggctgcggcgctggcacaagtcacgcctgctgcaggcttcagaaggtggcttggcgaacgtgcccacctcgcactttgtgggcatggacggggtgcaggctttcctgcagacctattcccatgaggtctccctcaccgcggactctcggaagagtcacctgatcttcccccagcccaactatgtagacatgctcatcagccaggagagctgtgagaaaaatgattctttgctaacatccgtagattttcaggaatgtaaagaaaacctgccaagtattcaggtgagcccagcccttcctttatttccatgaggaatttatttgcatgatatttctctattattttgcaaaacaaatgttttgaaaatagggatttaaaaaactttatagaggtaaaaatgagtttaccagtttccttcagtggtgacactttaatatagaacacataggatatagtatttctttagtgaaagcctatggacaagattatgaatatgtggactatcacattttataatttccacctactttccaatctatgttccaacctactttcttaactcatatattttatacattggaatgaatcgagtctttcatattgcacaaggttagcaggaataaaacacacctcagctgtcttctcaggattctctttagcattcaaatatgtaaaaggttctgaaagatttcttccatgtgaagatttttttctgtggctgattctgcctccatgtacctcagcttggtggtcctaaaaaatcttgattgcttcttgacctatttacagtataatcatttattaatggggtggtagtagaaggttggatttatgcctaaagaatgaaatgtgtgtgtatcacacttcactaagatctatatcaaagacagacatcaagtctaatgccacactaaaggccatcggacaaaaccaataaaatatgtcaaataaaatgtca

SEQ ID NO: 172188 - DNA, 4605 bp, Homo sapiens
  Payload ID: 13852
  Gene Symbol: PCDHGA8
  Gene Name: protocadherin gamma subfamily A, 8
  Uniprot ID: Q9Y5G5
  ENST ID: ENST00000398604
  CDS Start-End: 1-2799
atggccgctccacagagtcgccccagacgcggcgagctgatcctgctgtgcgcgctgctgggaacgctgtgggaaatcgggaggggacagattcgctactctgtgccagaagagacggacaaaggctccttcgtgggtaatatctccaaggacctggggctggacccccggaagctggcgaagcacggagtccgtatcgtctccagaggtaggacgcagctctttgctctgaacccgcgcagcggcagcttgatcaccgcgggcaggatagatcgggaggagctctgcgctcagagcccgcggtgtctgataaatattaacaccctggttgaggataaaggaaaactctttggggtagaaatagaaataattgatattaacgataataacccaaaattccaggtcgaagatctagaagtaaaaattaacgaaatcgcggttcctggagcacgttatccactcccagaagctgttgacccggatgtgggcgtgaactccctccagagctaccagctcagccccaatcaccacttctccctggacgtgcagactggagacaatggagccataaacccagagctggtgctggagcgcgccctggacagggaggaagaggctgctcaccacctggtcctcacggcctcggatggcggcaagccgcctcgctctagcacagtgcgcatccacgtgacagtgttggatacaaatgacaatgccccggtttttcctcacccgatttaccgagtgaaagtccttgagaacatgcccccaggcacgcggctgcttactgtaacagccagcgacccggatgagggaatcaacggaaaagtggcatacaaattccggaaaattaatgaaaaacaaactccgttattccagcttaatgaaaatactggggaaatatcaatagcaaaaagtctagattatgaagaatgttcattttatgaaatggaaatacaagccgaagatgtgggggcacttctggggaggaccaaattgctcatttcggtggaagatgtaaatgacaatagaccagaagtgatcattacgtctttgtttagcccagtgttagaaaattctcttcccgggacagtaattgccttcttgagtgtgcatgaccaagactctggaaagaatggtcaagttgtctgttacacacgtgataatttaccttttaaattagaaaagtcaataggtaattattatagattagtgacaaggaaatatttggaccgagaaaatgtctctatctacaatatcacagtgatggcctcagatctaggaacaccacctctgtccactgaaactcaaatcgctctgcacgtggcagacattaacgacaaccctcctactttccctcatgcctcctactcagcgtatatcctagagaacaacctgagaggagcctccatcttttccttgactgcacacgaccccgacagccaggagaatgcccaggtcacttactctgtgaccgaggacacgctgcagggggcgcccctgtcctcgtatatctccatcaactctgacaccggtgtcctgtatgcgctgcaatctttcgactatgagcagatccgagacctgcagctactggtaacagccagcgacagcggggacccgcccctcagcagcaacatgtcactgagcctgttcgtgctggaccagaatgacaacgcgcccgagatcctgtaccccgccctccccacagacggttccactggcgtggagctggcgccccgctccgcagagcgtggctacctggtgaccaaggtggtggcggtggacagagactcgggccagaacgcctggctgtcctaccgcctgctcaaggccagcgagccgggactcttctcggtgggtctgcacacgggcgaggtgcgcacggcgcgagccctgctggacagagatgcgctcaagcagagcctcgtggtggccgtccaggaccatggccagccccctctctccgccactgtcacgctcaccgtagccgtggctgacagcatccccgaagtcctgaccgagttgggcagtctgaagccttcggtcgacccgaacgattcgagccttacactctatctcgtggtggcagtggctgccatctcctgtgtcttcctcgcctttgtcgctgtgcttctggggctcaggctgaggcgctggcacaagtcacgcctgctccaggattccggtggcagattggtaggcgtgcctgcctcacattttgtgggtgttgaggaggtacaggctttcctgcagacctattcccaggaagtctccctcaccgccgactcgcggaagagtcacctgatctttccccagcccaactacgcagacatgctcatcagtcaggagggctgtgagaaaaatgattctttgttaacatccgtagattttcatgaatataagaatgaagctgatcatggtcagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 172189 - DNA, 6480 bp, Homo sapiens
  Payload ID: 13852
  Gene Symbol: PCDHGA8
  Gene Name: protocadherin gamma subfamily A, 8
  Uniprot ID: Q9Y5G5
  ENST ID: ENST00000610569
  CDS Start-End: 2658-5120
gaaagacggagtttaatttcctaaaatgtagtgagcagttgagttcaggacaagacatactttgcggtgattcatctggggccttatttccactttgtaattccagtgaattgacttcccatcaggtgagtttcctttaagtataatttaatgctcattgcctacccatttctccatattcacaagaaaatatacatatttgcaggaaaatatataatttttagatgtcatggatcattttaggaaagttgtagtcagttaaaaagctgtcatatcattctacaaaggaggagtaaagtaggagcaattgtgtggcccaacatttgtttgttttttagccaagcttagatttataaagcaatgagggtgtggttttaaccacaaagtgaaagtgttagacagttgttggctctctcctaaaaagtgaatgagatttttcctatacattttccttcttgttgactaatatatgatgaatacttttttcagcttggatataccataaatataaaaataataaagccaaagaatttaagctaaaattcaacacttttcttaactaatttaactggtatggtctccatagtagtccactgttttgtttcctgtgttaacttcccttttgtttcaaaagctcttagaataaggagtcaactggatttttatgtccatggaccccttgtgattatatgcagtgtacgctgtgtgtgcgtgtgtgtgtgtgtgtgtgtgagagagatccttttacttagaaaaaggtctactatgctcattagaagatcaaaagcagattctccttacttgtaacataggagtttcaggattaatctgtattcaagctcattctatatccttcatcaaagaaaagacaatgttttgtgtctgttgtccctctcacacacagccctaatatataatgtgtaactgccttatctgcagccctaaactaatatagctagaggtcttctaatcattctcctacctctaggaaagaaatatagtcttgaaaactgccaatctggtgtgcatacaaaatatatacaaaataccaaggaacattatatgagccttttgctaggtatatctaagcaactgcttcagttaatggccactttacaaattgctgaaagaaggaaacgtctttcgattcttttttttttctttttttttttttgagacagagtctctgtctgttactcaggctgtagtgcagtggcacaatgatagctccctccagcctcaaactcctgggctcaagcattccttctgcatcagcctcctgactagctggaactcaggctcatgccaccagacctggctaatttttctgttttcagtagagaaaatattttctttcactaatttaactggtatggtttccattgtctacccagttttccatatgcataagaaaatatattcacaggaaaatataaagttttcagatttcatgagtggttttaagaaagttttagtcagtgaaaaaactatcataccagtcttcaaaggaagggtgaaataagttcatctgctacgttgcccaggctggtcttgaagggaaacagacttttttgtagtcatacttatcctttggcttcttagtaagtattatatagtcattactttttgcagttttttagatcaaagtgttaatgtaggtaaagttaattttagaatatatgtaaaagtcaagtctgctttaaatttaatcatctctttggtgaaagggatgggatggagctttgctttttatcatatattcatctgtacctttcaagtattcaaatagaaaaatataaacaatgtaaataaaatagcaaaacaatgtaatatctcataaaactgcaatggtaaaagcatttatcctattgaaattccacaatttttatttgaaaatattatcgacatgtaattcaagtggcatttagaagaataatttaaaagcaacaactctatagaaagcttgtaaaatgattaagtagtttaaaccaaataaaacaatttctgagtcagtcatctccagtaggtctattttagtctcaagataaattcatttctggtgacaactgaagttcttagttatttgttagtatatattggagacatttacaataaagcttagagcacaatgggaaatgaaagtatcatgttttttttaagaccaaatgtattgcagaaatgtgagtaatttaatccgatgctacaatctgatcattctgatctaatctgatcatttaataacactaaataaaaccttcatctcacattctttggctgtttcttttaaaatatgggtttacggataaatcaaataaattcaaaacaaagtaataagcaaatgatttttttttctcagtaatctagtagagtattacatttagaagtaatctgtatctcagtgcagtaactatttaggactgtaagcgccgctgttcacctactggaagacaaatgcaaccgaaaacactcagatctcacacctcacgaagacccgcagatgccacaaactaactgctggactgcagcgaaacccgacccctgtttggaggcactccaggtttccggaggattgtcatctccatagctgcggcaagaaactaaataagacccatttatgcacagtgaagattctgagaggattctgcagcaaaacaacaatggccgctccacagagtcgccccagacgcggcgagctgatcctgctgtgcgcgctgctgggaacgctgtgggaaatcgggaggggacagattcgctactctgtgccagaagagacggacaaaggctccttcgtgggtaatatctccaaggacctggggctggacccccggaagctggcgaagcacggagtccgtatcgtctccagaggtaggacgcagctctttgctctgaacccgcgcagcggcagcttgatcaccgcgggcaggatagatcgggaggagctctgcgctcagagcccgcggtgtctgataaatattaacaccctggttgaggataaaggaaaactctttggggtagaaatagaaataattgatattaacgataataacccaaaattccaggtcgaagatctagaagtaaaaattaacgaaatcgcggttcctggagcacgttatccactcccagaagctgttgacccggatgtgggcgtgaactccctccagagctaccagctcagccccaatcaccacttctccctggacgtgcagactggagacaatggagccataaacccagagctggtgctggagcgcgccctggacagggaggaagaggctgctcaccacctggtcctcacggcctcggatggcggcaagccgcctcgctctagcacagtgcgcatccacgtgacagtgttggatacaaatgacaatgccccggtttttcctcacccgatttaccgagtgaaagtccttgagaacatgcccccaggcacgcggctgcttactgtaacagccagcgacccggatgagggaatcaacggaaaagtggcatacaaattccggaaaattaatgaaaaacaaactccgttattccagcttaatgaaaatactggggaaatatcaatagcaaaaagtctagattatgaagaatgttcattttatgaaatggaaatacaagccgaagatgtgggggcacttctggggaggaccaaattgctcatttcggtggaagatgtaaatgacaatagaccagaagtgatcattacgtctttgtttagcccagtgttagaaaattctcttcccgggacagtaattgccttcttgagtgtgcatgaccaagactctggaaagaatggtcaagttgtctgttacacacgtgataatttaccttttaaattagaaaagtcaataggtaattattatagattagtgacaaggaaatatttggaccgagaaaatgtctctatctacaatatcacagtgatggcctcagatctaggaacaccacctctgtccactgaaactcaaatcgctctgcacgtggcagacattaacgacaaccctcctactttccctcatgcctcctactcagcgtatatcctagagaacaacctgagaggagcctccatcttttccttgactgcacacgaccccgacagccaggagaatgcccaggtcacttactctgtgaccgaggacacgctgcagggggcgcccctgtcctcgtatatctccatcaactctgacaccggtgtcctgtatgcgctgcaatctttcgactatgagcagatccgagacctgcagctactggtaacagccagcgacagcggggacccgcccctcagcagcaacatgtcactgagcctgttcgtgctggaccagaatgacaacgcgcccgagatcctgtaccccgccctccccacagacggttccactggcgtggagctggcgccccgctccgcagagcgtggctacctggtgaccaaggtggtggcggtggacagagactcgggccagaacgcctggctgtcctaccgcctgctcaaggccagcgagccgggactcttctcggtgggtctgcacacgggcgaggtgcgcacggcgcgagccctgctggacagagatgcgctcaagcagagcctcgtggtggccgtccaggaccatggccagccccctctctccgccactgtcacgctcaccgtagccgtggctgacagcatccccgaagtcctgaccgagttgggcagtctgaagccttcggtcgacccgaacgattcgagccttacactctatctcgtggtggcagtggctgccatctcctgtgtcttcctcgcctttgtcgctgtgcttctggggctcaggctgaggcgctggcacaagtcacgcctgctccaggattccggtggcagattggtaggcgtgcctgcctcacattttgtgggtgttgaggaggtacaggctttcctgcagacctattcccaggaagtctccctcaccgccgactcgcggaagagtcacctgatctttccccagcccaactacgcagacatgctcatcagtcaggagggctgtgagaaaaatgattctttgttaacatccgtagattttcatgaatataagaatgaagctgatcatggtcaggtgagtttagttctttgcttgcttttaatttccagatgaattttatttggcataaattatgttttgaaaaacattgtgaagatagttgaaaataatttttaaggtgtatcacagagttttgggtttattttggtggtgttactataaaattgaactctaatagtcataggttattgtttcatttgcttttaaacgacttggaaaagattgttcaaccattttaagccttccagtattttattcctattatcactcattcacttaagaagtagctacccgtccatactggtaattttgctattgtttgtgtgtgtgtgtgtgtgtgtgtgtgtgtgtgtgtgtgtgtgtgtgtgtatcccaaactagaacttcagaaaattatcaagaagtctaaagccttgttattagcttagcaaaagtaaaatatatctcagaatttttagggttatgtttagcatttgaacctgtaactaggctcttgtagatttcttcactttaaacctcttttctgagccctgtttctgtaccagtgcccttcaaaactttaatacttcttaccatccttcaaaacatgaacaaactttaaagatggatcttggtgggagatgagactggttactaaatattaagtatgtgagtcagtggtcacctgggctccatgcccatggagacatgaaatctaaagcctagaatgtccattgctcccccaaacaaaaaacaaaagcaaaaacattagatctgaattaaaatgtaattttaaactgttgaaagtgacttttgtaaaatatgtaagaacatatttcaatacaattccaattagctgtttcggttgtgcattgatgtgaagtggtgagaatgttgatattaagaaccaatgtttcaggtacacaagttctaaataagctgatcaattcaattaaagttattcagtcttggctggacacagtgcctcatgtctgaaatcccagcactttgggaggctggggcaggaggaccgcttgagccccgggggtttgaaactgcagtgagctatgatcatgccactgcactccagcctaggtggcagaactagaccctgtctctaaaaaaactattattaggccgggtgcggtggctcacgcctgtaatcccagcactttgggagactgaggtgggtggatcacctgaggtcaggagttcaagatcagcctggcaaacatggtgaaaccccgtctctactaaaaactacaaaaattagccaggcatggtggcatgcgcctgtggtcccagctactcgggaggctgaggcagaagaatcacttgaacccgggaggtggaggttgcagtgagcctcgatcctgtcactgcactccagcctgggcaacagggtgagactccgtctcaaaaaaaaaaaaaacta

SEQ ID NO: 172190 - DNA, 4605 bp, Homo sapiens
  Payload ID: 13853
  Gene Symbol: PCDHGA9
  Gene Name: protocadherin gamma subfamily A, 9
  Uniprot ID: Q9Y5G4
  ENST ID: ENST00000573521
  CDS Start-End: 1-2799
atggcagctccaaccaaatgccagctccgcggaagattagtcctgctatgctcgctcctggggatgctatgggaggccagggccagtcagattcgctactcagtgcctgaagagacagaaaagggctatattgtgggcaacatctccaaggacctggctctggagccccgggagctggcggagcgccgagtccgcatcgtctctagaggtaggacgcagcttttctctctgaacccgcgcagcggcaccttggtcaccgcgggtaggatagaccgggaggagctctgtgctcagagcccgcggtgtctggtgaactttaaagtcctggttgaagacagagtgaaactgtacggaatagaaatagaagtaactgatattaacgacagcgccccaaagttccaggccgaaagtctggaagtaaaaattaacgaaatcgcggttcctggagcacgttatccacttccagaagctattgatccggatgttggcgtgaactccctccagagctaccagctcagccccaatcaccacttctccctgaacgtgcagactggagacaatggagccataaacccagagctggtgctggagcgcgccctggacagggaggaggcaactgcccaccacctggtcctcacggcctcggatggcggcgagccgcgtcgctccagcacagtgcgcatccatgtgacagtgttggatacaaatgataatgccccggtttttgctcaacggatttaccgagttaaagtccttgagaacgtgcccccaggcacctggctgcttactgcaacagccagcgacctggatgagggaatcaacggaaaagtggcatacaaattctggaaaattaatgaaaaacaatctctgctattccagcttaatgaaaatactggggaaatatcaacagcaaaaagtctagattatgaagaatgttcattttatgaaatggaaatacaagctgaagatggtgggggattgaaagggtggacaaaagtgctcatttcggtggaagatgtaaatgacaatagacctgaagtgaccattacatctctgtttagcccagtgagagaagacgcacctcagggaacagtaattcttcttttcaatgctcatgaccgagactccgggaagaatggtcaagttgtctgttctatccaggagaatctatcttttacattagaaaattcagaagaagattattacagattgttgacggcccaaattcttgaccgagaaaaagcctcagaatataatatcacggtgactgcaacagacagaggaactccgcccctgtccacagaaattcacatcaccctgcaagtgactgacatcaatgataatccacctgctttctctcaagcctcctactcagtctacctcccggaaaacaacgccagaggtacttccatcttctccgtgattgcctatgaccctgatagcaatgagaattctagagttatttactccttggcagaggataccatccaagggtctcctctctccacctatgtctctattaactcagacactggtgtgctgtatgctctgtgctcctttgactatgagcagtttagagatttgcaaatgcaggtgacggcaagtgacagtggaagcccaccacttagcagcaatgtgtcattgagactgtttgttttggaccagaatgacaatgccccagaaatcctgtaccctgccctccccactgatggttctactggtgtggagctggcaccccgctctgcagagcctggctacctggtgaccaaggtggtggcagtggacagagactcaggccagaatgcttggctctcctaccgcctattcaaggccagtgagccagggctcttctcggtggggctgcacacaggtgaagtgcgcacagctcgggccctgctagatagagatgcgctcaaacagagccttgtggtggctgtacaggaccatggccagccccctctctcggccactgtcacgctcacagtagccatagctgacagcatcccagacatcctggctgacctgggcagtcttcagatccctgcagacctggaggcctcagaccttaccctctacctcgttgtggctgtggcagtcgtctcctgtgtcttcctcaccttcgttatcacgctgctggccctcaggctgaggcactggcactcctcgcatctgctgcgggctaccagtgatgggttggctggtgtgcccacctcacactttgtgggtgtagatggggttcgagctttcctacagacctattctcaggagttctccctcaccgctgactcaaggaagagtcacctgatcttcccccagcccaactatgcagacacactcatcagccagcagagctgtgagaaaaatgagcctttgtgcgtctctgttgattccaagtttcctatagaagacacccctttggttccgcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 172191 - DNA, 2568 bp, Homo sapiens
  Payload ID: 13853
  Gene Symbol: PCDHGA9
  Gene Name: protocadherin gamma subfamily A, 9
  Uniprot ID: Q9Y5G4
  ENST ID: ENST00000616887
  CDS Start-End: 22-2508
aaattccaaagcgaggcagcaatggcagctccaaccaaatgccagctccgcggaagattagtcctgctatgctcgctcctggggatgctatgggaggccagggccagtcagattcgctactcagtgcctgaagagacagaaaagggctatattgtgggcaacatctccaaggacctggctctggagccccgggagctggcggagcgccgagtccgcatcgtctctagaggtaggacgcagcttttctctctgaacccgcgcagcggcaccttggtcaccgcgggtaggatagaccgggaggagctctgtgctcagagcccgcggtgtctggtgaactttaaagtcctggttgaagacagagtgaaactgtacggaatagaaatagaagtaactgatattaacgacagcgccccaaagttccaggccgaaagtctggaagtaaaaattaacgaaatcgcggttcctggagcacgttatccacttccagaagctattgatccggatgttggcgtgaactccctccagagctaccagctcagccccaatcaccacttctccctgaacgtgcagactggagacaatggagccataaacccagagctggtgctggagcgcgccctggacagggaggaggcaactgcccaccacctggtcctcacggcctcggatggcggcgagccgcgtcgctccagcacagtgcgcatccatgtgacagtgttggatacaaatgataatgccccggtttttgctcaacggatttaccgagttaaagtccttgagaacgtgcccccaggcacctggctgcttactgcaacagccagcgacctggatgagggaatcaacggaaaagtggcatacaaattctggaaaattaatgaaaaacaatctctgctattccagcttaatgaaaatactggggaaatatcaacagcaaaaagtctagattatgaagaatgttcattttatgaaatggaaatacaagctgaagatggtgggggattgaaagggtggacaaaagtgctcatttcggtggaagatgtaaatgacaatagacctgaagtgaccattacatctctgtttagcccagtgagagaagacgcacctcagggaacagtaattcttcttttcaatgctcatgaccgagactccgggaagaatggtcaagttgtctgttctatccaggagaatctatcttttacattagaaaattcagaagaagattattacagattgttgacggcccaaattcttgaccgagaaaaagcctcagaatataatatcacggtgactgcaacagacagaggaactccgcccctgtccacagaaattcacatcaccctgcaagtgactgacatcaatgataatccacctgctttctctcaagcctcctactcagtctacctcccggaaaacaacgccagaggtacttccatcttctccgtgattgcctatgaccctgatagcaatgagaattctagagttatttactccttggcagaggataccatccaagggtctcctctctccacctatgtctctattaactcagacactggtgtgctgtatgctctgtgctcctttgactatgagcagtttagagatttgcaaatgcaggtgacggcaagtgacagtggaagcccaccacttagcagcaatgtgtcattgagactgtttgttttggaccagaatgacaatgccccagaaatcctgtaccctgccctccccactgatggttctactggtgtggagctggcaccccgctctgcagagcctggctacctggtgaccaaggtggtggcagtggacagagactcaggccagaatgcttggctctcctaccgcctattcaaggccagtgagccagggctcttctcggtggggctgcacacaggtgaagtgcgcacagctcgggccctgctagatagagatgcgctcaaacagagccttgtggtggctgtacaggaccatggccagccccctctctcggccactgtcacgctcacagtagccatagctgacagcatcccagacatcctggctgacctgggcagtcttcagatccctgcagacctggaggcctcagaccttaccctctacctcgttgtggctgtggcagtcgtctcctgtgtcttcctcaccttcgttatcacgctgctggccctcaggctgaggcactggcactcctcgcatctgctgcgggctaccagtgatgggttggctggtgtgcccacctcacactttgtgggtgtagatggggttcgagctttcctacagacctattctcaggagttctccctcaccgctgactcaaggaagagtcacctgatcttcccccagcccaactatgcagacacactcatcagccagcagagctgtgagaaaaatgagcctttgtgcgtctctgttgattccaagtttcctatagaagacacccctttggttccggtgagttcattttttttctttctttcttttctttttttgttttttgttttgttttgtttttgagacagagtcttactctgttacccaggctggaatgcagtggtgtgatctcggctcattgca

SEQ ID NO: 172192 - DNA, 4590 bp, Homo sapiens
  Payload ID: 13854
  Gene Symbol: PCDHGB1
  Gene Name: protocadherin gamma subfamily B, 1
  Uniprot ID: Q9Y5G3
  ENST ID: ENST00000523390
  CDS Start-End: 1-2784
atgcagagagccagagaagccgaaatgatgaaaagtcaggtactgtttcccttcctgctgtctttgttctgcggggccatctcccagcagatccgatacacgattccagaggagctagccaacggctcacgggtggggaaacttgccaaggatctggggctcagtgtccgggagttgccaactcgaaaactgcgggttagtgcagaggattatttcaacgttagtttggagagcggggatttgttagtgaacggtaggatagatcgagagaagatttgcggaaggaaacttgagtgtgcactagaattcgaaacggtcgctgaaaacccaatgaatgttttccacgtggttgttgtaatccaagatattaatgacaatgcaccacgtttcgttgcaaaaggcattgacttagaaatttgtgagtcagccttacccggggtaaaattctctctggattctgctcaagatgcagatgtggaaggcaattcactgaagttatacaccatcaaccccaatcaatacttctctctgtcaacgaaggaaagtcctgatggaagtaaatatccggtattactgctggaaaaacctctagacagggaacatcagagctctcatcgcttaatcctgactgccatggatggcggggacccgcctctaagcggcaccacccatatctggatccgagttacggatgccaatgataatgctcccgtgtttagccaggaggtatacagggttagcctccaagaaaacgtaccgtggggaacctccgtgctgcgggtgatggccacagaccaggatgagggcattaatgcagagatcacctatgccttcctcaattccccaataagtaccagcctcttcaatctcaatccaaatactggcgacatcacaaccaatggcacattggattttgaagagacaagtagatatgtgttgagtgtggaagctaaggatggaggagtacacacagctcactgtaatgttcaaatagaaattgttgacgagaatgacaatgccccagaggtgacattcatgtccttctctaaccagattccagaggattcagaccttggaactgtaatagccctcataaaagtgcgagacaaggattctgggcaaaatggcatggtgacatgctatactcaggaagaagttcctttcaaattagaatccacctcgaagaattattacaagctggtgattgctggagccctaaaccgggagcagacagcagactacaacgtcacaatcatagccaccgacaagggcaaaccagccctttcctccaggacaagcatcaccctgcacatctccgacatcaacgacaatgcacctgttttccatcaggcctcctatgtggtccacgtgtctgagaacaacccacctggcgcctccattgcacaagtaagcgcctccgacccggatttgggacccaacggcagagtctcctactctattctggccagtgacctggagccgcgggagctgttgtcctacgtgtccgtgagcccgcagagcggggtggtgttcgcgcagcgcgccttcgaccacgagcagctgcgcgccttcgagctcacactgcaggccagggaccagggctcccccgcgctcagcgccaacgtgagcctgcgcgtgttggtgggcgacctcaatgacaatgcgccacgggtgctgtaccccgcgctggggcctgatggctccgccctcttcgatatggtgccacgcgccgcagagcccggctacctggtgaccaaggtggtggcggtggacgcagactcaggacacaacgcttggctgtcctaccacgtgctgcaggccagcgagcccgggctcttcagcctggggttgcgcacgggtgaggtgcgcacagcgcgtgccttgggcgacagggacgcggcccgccagcgcctgctggtcgctgtgcgtgatggaggacagccgccactctccgccaccgccacgctgcacctaatcttcgcggatagcctgcaagaggtattgccagacctcagcgaccgccctgagccctctgacccccagacggaactgcagttttacctggttgtggccttggccttgatctcagtgctctttctcctcgcggtgattctagcgatcgccctgcgcctgcgacgttcctccagcctcgacactgagggctgctttcaaaccggtctctgctccaagtctgggcccggggttcctcccaaccacagcgaggggactttgccctattcctacaatctatgtattgcctctcattctgcaaagacagagtttaattctctcaacctgacaccggaaatggctccccctcaggatctgctgtgtgatgatccttctatggttgtatgtgccagtaatgaagatcacaaaatcgcttatgacccttctttgtcttcgcaccaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 172193 - DNA, 2592 bp, Homo sapiens
  Payload ID: 13854
  Gene Symbol: PCDHGB1
  Gene Name: protocadherin gamma subfamily B, 1
  Uniprot ID: Q9Y5G3
  ENST ID: ENST00000611598
  CDS Start-End: 160-2592
ttcctgctttgtccggtgcactgagcacagacgctgctcctgttcaccctcgagcgcctaactaataagtcctaagctcaaatcacagaagtccagggtgctgccatttctttttgaaaaacatcccagaggaaagaagctccgcggagagttcctgaaatgcagagagccagagaagccgaaatgatgaaaagtcaggtactgtttcccttcctgctgtctttgttctgcggggccatctcccagcagatccgatacacgattccagaggagctagccaacggctcacgggtggggaaacttgccaaggatctggggctcagtgtccgggagttgccaactcgaaaactgcgggttagtgcagaggattatttcaacgttagtttggagagcggggatttgttagtgaacggtaggatagatcgagagaagatttgcggaaggaaacttgagtgtgcactagaattcgaaacggtcgctgaaaacccaatgaatgttttccacgtggttgttgtaatccaagatattaatgacaatgcaccacgtttcgttgcaaaaggcattgacttagaaatttgtgagtcagccttacccggggtaaaattctctctggattctgctcaagatgcagatgtggaaggcaattcactgaagttatacaccatcaaccccaatcaatacttctctctgtcaacgaaggaaagtcctgatggaagtaaatatccggtattactgctggaaaaacctctagacagggaacatcagagctctcatcgcttaatcctgactgccatggatggcggggacccgcctctaagcggcaccacccatatctggatccgagttacggatgccaatgataatgctcccgtgtttagccaggaggtatacagggttagcctccaagaaaacgtaccgtggggaacctccgtgctgcgggtgatggccacagaccaggatgagggcattaatgcagagatcacctatgccttcctcaattccccaataagtaccagcctcttcaatctcaatccaaatactggcgacatcacaaccaatggcacattggattttgaagagacaagtagatatgtgttgagtgtggaagctaaggatggaggagtacacacagctcactgtaatgttcaaatagaaattgttgacgagaatgacaatgccccagaggtgacattcatgtccttctctaaccagattccagaggattcagaccttggaactgtaatagccctcataaaagtgcgagacaaggattctgggcaaaatggcatggtgacatgctatactcaggaagaagttcctttcaaattagaatccacctcgaagaattattacaagctggtgattgctggagccctaaaccgggagcagacagcagactacaacgtcacaatcatagccaccgacaagggcaaaccagccctttcctccaggacaagcatcaccctgcacatctccgacatcaacgacaatgcacctgttttccatcaggcctcctatgtggtccacgtgtctgagaacaacccacctggcgcctccattgcacaagtaagcgcctccgacccggatttgggacccaacggcagagtctcctactctattctggccagtgacctggagccgcgggagctgttgtcctacgtgtccgtgagcccgcagagcggggtggtgttcgcgcagcgcgccttcgaccacgagcagctgcgcgccttcgagctcacactgcaggccagggaccagggctcccccgcgctcagcgccaacgtgagcctgcgcgtgttggtgggcgacctcaatgacaatgcgccacgggtgctgtaccccgcgctggggcctgatggctccgccctcttcgatatggtgccacgcgccgcagagcccggctacctggtgaccaaggtggtggcggtggacgcagactcaggacacaacgcttggctgtcctaccacgtgctgcaggccagcgagcccgggctcttcagcctggggttgcgcacgggtgaggtgcgcacagcgcgtgccttgggcgacagggacgcggcccgccagcgcctgctggtcgctgtgcgtgatggaggacagccgccactctccgccaccgccacgctgcacctaatcttcgcggatagcctgcaagaggtattgccagacctcagcgaccgccctgagccctctgacccccagacggaactgcagttttacctggttgtggccttggccttgatctcagtgctctttctcctcgcggtgattctagcgatcgccctgcgcctgcgacgttcctccagcctcgacactgagggctgctttcaaaccggtctctgctccaagtctgggcccggggttcctcccaaccacagcgaggggactttgccctattcctacaatctatgtattgcctctcattctgcaaagacagagtttaattctctcaacctgacaccggaaatggctccccctcaggatctgctgtgtgatgatccttctatggttgtatgtgccagtaatgaagatcacaaaatcgcttatgacccttctttgtcttcgcacgtgagtttctgcaaatctagttaa

SEQ ID NO: 172194 - DNA, 4602 bp, Homo sapiens
  Payload ID: 13855
  Gene Symbol: PCDHGB2
  Gene Name: protocadherin gamma subfamily B, 2
  Uniprot ID: Q9Y5G2
  ENST ID: ENST00000522605
  CDS Start-End: 1-2796
atgaaagcgagctcagggaggtgcgggctggtgcggtggctgcaggtactgttgcccttcctgttgtctttgttccccggggctctcccagtccagatccgctattcaattccagaggagctggccaaaaactcggtcgtaggaaacctcgccaaggatctggggctcagcgtccgggacttgccagcccggaagctgcgggttagcgcggagaaggaatatttcacagtaaacccagaaagcggagacttacttgtgagtgacagaatagaccgagaacagatatgcgggaagcagcctctgtgtgttctggatttcgatactgtcgctgaaaatccactaaatattttctacatagcagtaattgtgcaggatataaatgataataccccgctattcaaacagactaagattaatttaaaaattggcgaatccactaagccaggtacaacatttccacttgacccagccctggattcagatgttggtcctaactcactacaaagataccaccttaatgacaacgagtactttgatctcgctgagaaacagactccagatggtcgtaaatatcctgagttgattctaaaacactctctggacagagaagagcacagtttacatcaattggtcctcacagctgtggatggcggagacccacctcaaagtggcacgacccaaatccgaatcaaagtcacggatgccaacgataaccctccagtgttcagccaggacgtgtacagggtcaccctgagggaggacgtgccgccgggcttctttgtgcttcaagtgacagccaccgaccgggatgaaggcataaacgcagagatcacctactcctttcataatgtggacgaacaagtgaaacactttttcaacttaaatgaaaaaacaggagaaatcacgacaaaggatgatttggattttgagattgcaagtagttacactctgagtatcgaagcaaaagatcctggagatctagcagcccactgcagtatccaagttgaaattcttgatgacaacgattgtgcacctgaagttattgtgacttcagtatctactcccctaccggaggattcgccaccaggaacagtgatcgccttgataaaaacgagagacagagactctggagaaaatggagaagtttactgccaagtgttgggaaatgccaagtttattttgaaatcttcctcaaagaactattacaaactagtgacagacggcgctctggaccgggaggagatcccagaatacaatctcaccatcacagccaccgacgggggcaagccgcccctctcctccagcataattgtcaccctgcacatctccgacgtcaacgataatgccccagttttccaacagacttcctacatggttcacgtggcagagaacaatcctcctggcgcctctatcgctcaaatcagtgcctctgaccctgacttgggccccagtggccaagtttcctactccatcgtagcgagcgacctgaagccgcgggagattttatcctacgtgtccgtgagcgcgcagagcggggtggtgttcgcgcagcgcgccttcgatcatgagcagctgcgcgccttcgagctcacactgcaggcccgcgaccagggctcgcccgcgctcagcgccaacgtgagcctgcgcgtgttagtgggcgacctcaatgacaatgcgccacgggtgctgtaccccgcgctggggcctgatggctccgccctcttcgatatggtgccacgcgccgcagagcccggctacctggtgaccaaggtggtggcggtggacgcagactcaggacacaacgcttggctgtcctaccacgtgctgcaggccagcgagcccgggctcttcagcctggggttgcgcacgggtgaggtgcgcacagcgcgtgccttgggcgacagggacgcggcccgccagcgcctgctggtcgctgtgcgtgatggaggacagccgccactctccgctacggccacgctgcacctaatcttcgcggatagcctgcaagaggtattgccagacctcagcgaccgccgggagccctctgacccccaggcaaaactgcagttttacctggttgtggccttggccttgatctcagtgctcttcttcctcgcggtgattctggcaatctccctgcgcctgcgactctcttccaggtcagatgcttgggactgttttcagcctggtctcagctccaagcctggacctggggttctccccaattacagtgagggtacattgccctattcctacaacctgtgtgttgcctcacaatcagccaagacagagttcaattttctgaacataaccccggaattggttcccgcgcaagatctcgtctgtgacaatgcctcttgggaacaaaatacaaatcatggagccgctggggtcccttttgcctcagatactattttgaagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 172195 - DNA, 2588 bp, Homo sapiens
  Payload ID: 13855
  Gene Symbol: PCDHGB2
  Gene Name: protocadherin gamma subfamily B, 2
  Uniprot ID: Q9Y5G2
  ENST ID: ENST00000622527
  CDS Start-End: 95-2530
aaaacaaaagcaggaaaagtgaccttagcccggattctgccatccccggaaggcttattcctcctatgggcaaaggagcaaagggagccagaagatgaaagcgagctcagggaggtgcgggctggtgcggtggctgcaggtactgttgcccttcctgttgtctttgttccccggggctctcccagtccagatccgctattcaattccagaggagctggccaaaaactcggtcgtaggaaacctcgccaaggatctggggctcagcgtccgggacttgccagcccggaagctgcgggttagcgcggagaaggaatatttcacagtaaacccagaaagcggagacttacttgtgagtgacagaatagaccgagaacagatatgcgggaagcagcctctgtgtgttctggatttcgatactgtcgctgaaaatccactaaatattttctacatagcagtaattgtgcaggatataaatgataataccccgctattcaaacagactaagattaatttaaaaattggcgaatccactaagccaggtacaacatttccacttgacccagccctggattcagatgttggtcctaactcactacaaagataccaccttaatgacaacgagtactttgatctcgctgagaaacagactccagatggtcgtaaatatcctgagttgattctaaaacactctctggacagagaagagcacagtttacatcaattggtcctcacagctgtggatggcggagacccacctcaaagtggcacgacccaaatccgaatcaaagtcacggatgccaacgataaccctccagtgttcagccaggacgtgtacagggtcaccctgagggaggacgtgccgccgggcttctttgtgcttcaagtgacagccaccgaccgggatgaaggcataaacgcagagatcacctactcctttcataatgtggacgaacaagtgaaacactttttcaacttaaatgaaaaaacaggagaaatcacgacaaaggatgatttggattttgagattgcaagtagttacactctgagtatcgaagcaaaagatcctggagatctagcagcccactgcagtatccaagttgaaattcttgatgacaacgattgtgcacctgaagttattgtgacttcagtatctactcccctaccggaggattcgccaccaggaacagtgatcgccttgataaaaacgagagacagagactctggagaaaatggagaagtttactgccaagtgttgggaaatgccaagtttattttgaaatcttcctcaaagaactattacaaactagtgacagacggcgctctggaccgggaggagatcccagaatacaatctcaccatcacagccaccgacgggggcaagccgcccctctcctccagcataattgtcaccctgcacatctccgacgtcaacgataatgccccagttttccaacagacttcctacatggttcacgtggcagagaacaatcctcctggcgcctctatcgctcaaatcagtgcctctgaccctgacttgggccccagtggccaagtttcctactccatcgtagcgagcgacctgaagccgcgggagattttatcctacgtgtccgtgagcgcgcagagcggggtggtgttcgcgcagcgcgccttcgatcatgagcagctgcgcgccttcgagctcacactgcaggcccgcgaccagggctcgcccgcgctcagcgccaacgtgagcctgcgcgtgttagtgggcgacctcaatgacaatgcgccacgggtgctgtaccccgcgctggggcctgatggctccgccctcttcgatatggtgccacgcgccgcagagcccggctacctggtgaccaaggtggtggcggtggacgcagactcaggacacaacgcttggctgtcctaccacgtgctgcaggccagcgagcccgggctcttcagcctggggttgcgcacgggtgaggtgcgcacagcgcgtgccttgggcgacagggacgcggcccgccagcgcctgctggtcgctgtgcgtgatggaggacagccgccactctccgctacggccacgctgcacctaatcttcgcggatagcctgcaagaggtattgccagacctcagcgaccgccgggagccctctgacccccaggcaaaactgcagttttacctggttgtggccttggccttgatctcagtgctcttcttcctcgcggtgattctggcaatctccctgcgcctgcgactctcttccaggtcagatgcttgggactgttttcagcctggtctcagctccaagcctggacctggggttctccccaattacagtgagggtacattgccctattcctacaacctgtgtgttgcctcacaatcagccaagacagagttcaattttctgaacataaccccggaattggttcccgcgcaagatctcgtctgtgacaatgcctcttgggaacaaaatacaaatcatggagccgctggggtcccttttgcctcagatactattttgaaggtgagctttaattaatttattttcacttctggttttattgtttcacctaatttgggtaggaagttccactgcg

SEQ ID NO: 172196 - DNA, 4727 bp, Homo sapiens
  Payload ID: 13856
  Gene Symbol: PCDHGB3
  Gene Name: protocadherin gamma subfamily B, 3
  Uniprot ID: Q9Y5G1
  ENST ID: ENST00000576222
  CDS Start-End: 132-2921
cagcggagacacccattagagaacccaagcacaaagacaaagcaaatagttggtcctgctcggagaactcttgggattatttaaagatctcctctcctcggatttagaaaggcaaaggcgcagagagcgggatgggaaatagctccggatggaggggcccagcagggcagaggcgaatgctatttctcttcctgctctctttgttagaccaggctctctccgaaccgatccgctacgctattcccgaggagctggacaggggctcgctggtagggaacctcgccaaggacctggggtttggcgtgggggatttacctactaggaacctgcgggttattgcagagaagaaattctttaccgtgagccccgaaaatgggaacttacttgtgagcgaccgtatagaccgagaggagatttgtggcaagaagtcgacgtgtgttctggaatttgaaatggttgctgaaaagcctttaaacttttttcatgtaactgtgctgatccaggatattaacgacaacccaccgacctttagccaaaatatcactgagctggaaatcagcgaactggctctcactggagccacatttgccctggaatctgcgcaagatcctgatgtaggtgtcaattcgctgcagcagtactacctcagccctgatccgcacttctctttgattcagaaggagaacctggatggcagtaggtacccagagctagtactgaaagcacccctggacagggaagagcagccacatcaccacctggtcctcacagctgtggatgggggcgagccctccagaagctgtaccacccagatcagggtaattgtcgcagatgcaaatgataaccccccagtatttactcaggacatgtacagggtcaatgttgcagagaacctgcccgctggctcctccgtattaaaagtgatggccattgacatggatgagggcatcaatgccgaaatcatctatgccttcatcaatattggcaaggaagtgagacaactgttcaagctggacagtaaaacgggggaactcaccactattggagaactggactttgaagagagagatagctacacaattggggtggaagcaaaggatggtggacatcacactgcatattgtaaagtacagatagatatttcagatgaaaatgacaatgccccggagataaccctggcttctgaatcccaacatatacaagaagatgctgagctggggactgccgttgccctgatcaaaacacatgatctagattctggatttaatggagaaatcctatgccaactaaaaggaaacttcccctttaaaatcgttcaagataccaaaaacacatacaggttggtgacagatggagccctggaccgggagcagatcccagaatacaatgtgacgatcacagctaccgacaaaggcaatccaccgctctcctccagcaagaccatcactctgcacatccttgatgtcaacgacaacgttcccgttttccaccaggcctcctacaccgtgcatgtagctgagaacaatccgcctggagcctccattgcgcatgtcagagcctcggatcccgacttgggacctaatggccttgtctcctactacatcgtggccagtgacctggagccgcgggagctgtcgtcctacgtgtccgtgagcgcgcggagcggggtggtgttcgcgcagcgagccttcgaccacgagcagctgcgtgccttcgagctcactctgcaggcccgcgaccagggctcgcctacgctcagcgccaacgtgagcctgcgcgtgttggtggacgaccgcaacgacaatgcaccgctggtgctgtacccagctctggggcccgaaggctctgcgctcttcgatatggtgccgcgctctgcagagcctggctacctggtgaccaaggtggtggcggtggacgcagactcgggatacaacgcctggctgtcctaccacattgtgcaggccagcgagcccgggctgttcagcctgggcctgcgcacgggtgaggtgcgcacggcgcgtaccttgggcgacagggaggccgcccgccagcgcctgctggtcactgtgcgtgatggaggacagcagcctctttcagccaccgtcatgctgcacctaatcttcgcagatagcttgcaagagatacaacctgaccttagcgaccgccccactccctctgaccctcaggcggagctacagtttcacctagtagtggcgttggccttgatctcagtgctcttcctcctcgcggtgattctggcaatctccctgcgcctgcgatgctcctccagacccgccactgagggctactttcagcctggtgtctgcttcaagactgtacctggagttctccccacctacagcgaaaggactttgccttattcctacaatccgtgtgctgcctcacattcctcaaacaccgagtttaaatttctcaatataaaggctgaaaatgctgcaccacaagatcttctatgtgatgaagcctcttggtttgaaagtaatgacaatccagaaatgccttctaattcaggcaatttgcaaaagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 172197 - DNA, 2445 bp, Homo sapiens
  Payload ID: 13856
  Gene Symbol: PCDHGB3
  Gene Name: protocadherin gamma subfamily B, 3
  ENST ID: ENST00000618934
  CDS Start-End: 1-2445
atgggaaatagctccggatggaggggcccagcagggcagaggcgaatgctatttctcttcctgctctctttgttagaccaggctctctccgaaccgatccgctacgctattcccgaggagctggacaggggctcgctggtagggaacctcgccaaggacctggggtttggcgtgggggatttacctactaggaacctgcgggttattgcagagaagaaattctttaccgtgagccccgaaaatgggaacttacttgtgagcgaccgtatagaccgagaggagatttgtggcaagaagtcgacgtgtgttctggaatttgaaatggttgctgaaaagcctttaaacttttttcatgtaactgtgctgatccaggatattaacgacaacccaccgacctttagccaaaatatcactgagctggaaatcagcgaactggctctcactggagccacatttgccctggaatctgcgcaagatcctgatgtaggtgtcaattcgctgcagcagtactacctcagccctgatccgcacttctctttgattcagaaggagaacctggatggcagtaggtacccagagctagtactgaaagcacccctggacagggaagagcagccacatcaccacctggtcctcacagctgtggatgggggcgagccctccagaagctgtaccacccagatcagggtaattgtcgcagatgcaaatgataaccccccagtatttactcaggacatgtacagggtcaatgttgcagagaacctgcccgctggctcctccgtattaaaagtgatggccattgacatggatgagggcatcaatgccgaaatcatctatgccttcatcaatattggcaaggaagtgagacaactgttcaagctggacagtaaaacgggggaactcaccactattggagaactggactttgaagagagagatagctacacaattggggtggaagcaaaggatggtggacatcacactgcatattgtaaagtacagatagatatttcagatgaaaatgacaatgccccggagataaccctggcttctgaatcccaacatatacaagaagatgctgagctggggactgccgttgccctgatcaaaacacatgatctagattctggatttaatggagaaatcctatgccaactaaaaggaaacttcccctttaaaatcgttcaagataccaaaaacacatacaggttggtgacagatggagccctggaccgggagcagatcccagaatacaatgtgacgatcacagctaccgacaaaggcaatccaccgctctcctccagcaagaccatcactctgcacatccttgatgtcaacgacaacgttcccgttttccaccaggcctcctacaccgtgcatgtagctgagaacaatccgcctggagcctccattgcgcatgtcagagcctcggatcccgacttgggacctaatggccttgtctcctactacatcgtggccagtgacctggagccgcgggagctgtcgtcctacgtgtccgtgagcgcgcggagcggggtggtgttcgcgcagcgagccttcgaccacgagcagctgcgtgccttcgagctcactctgcaggcccgcgaccagggctcgcctacgctcagcgccaacgtgagcctgcgcgtgttggtggacgaccgcaacgacaatgcaccgctggtgctgtacccagctctggggcccgaaggctctgcgctcttcgatatggtgccgcgctctgcagagcctggctacctggtgaccaaggtggtggcggtggacgcagactcgggatacaacgcctggctgtcctaccacattgtgcaggccagcgagcccgggctgttcagcctgggcctgcgcacgggtgaggtgcgcacggcgcgtaccttgggcgacagggaggccgcccgccagcgcctgctggtcactgtgcgtgatggaggacagcagcctctttcagccaccgtcatgctgcacctaatcttcgcagatagcttgcaagagatacaacctgaccttagcgaccgccccactccctctgaccctcaggcggagctacagtttcacctagtagtggcgttggccttgatctcagtgctcttcctcctcgcggtgattctggcaatctccctgcgcctgcgatgctcctccagacccgccactgagggctactttcagcctggtgtctgcttcaagactgtacctggagttctccccacctacagcgaaaggactttgccttattcctacaatccgtgtgctgcctcacattcctcaaacaccgagtttaaatttctcaatataaaggctgaaaatgctgcaccacaagatcttctatgtgatgaagcctcttggtttgaaagtaatgacaatccagaaatgccttctaattcaggcaatttgcaaaaggtgagtttcttcaaacctttccttccataa

SEQ ID NO: 172198 - DNA, 4578 bp, Homo sapiens
  Payload ID: 13857
  Gene Symbol: PCDHGB4
  Gene Name: protocadherin gamma subfamily B, 4
  Uniprot ID: Q9UN71
  ENST ID: ENST00000519479
  CDS Start-End: 1-2772
atggggagcggcgccggggagctgggccgggctgagaggctgccagtgctctttctcttcctgctgtctttgttctgcccggcgctctgtgagcagatccgctacaggattcccgaggaaatgcccaagggctccgtagtggggaacctcgccacggacctggggttcagcgtccaggagttaccgactcgaaaactgcgcgtcagttcggagaagccttacttcaccgtgagcgcagagagcggggagttgcttgtgagcagcaggctagacagggaggagatatgcgggaagaagccagcttgtgctctggaatttgaggctgttgctgaaaatccactgaacttttatcacgtgaatgtggagatcgaggacattaatgaccacacgccaaaattcacgcaaaattcctttgagctgcaaataagtgagtctgcacagcctggcacacgatttatattaggatctgcccatgatgcggatattggtagcaacacactgcagaattaccaactcagtcccagtgatcatttctcactgataaataaagagaaatcagatggcagtaaataccctgagatggtattgaagacacctttggacagagaaaagcagaaatcctaccacttgactttgactgccttggactttggagctccacccctaagcagcactgcacagatacacgttctagtgactgatgccaatgataatgctccagtgttcagtcaagacgtatacagggtgagcctttcagaaaacgtgtacccggggaccacggtgctacaggtgactgccacggaccaggatgagggtgtcaatgccgagattactttctctttcagtgaagctagccagatcacccaatttgacctgaactctaacaccggggaaattactgttttaaatacattagattttgaagaagtcaaagaatattccatagttttggaagcaagggacggtggaggaatgattgcgcaatgcacagtggaggtagaagtcatagatgaaaatgacaacgccccagaagtgatattccagtctctacccaacctaattatggaggacgccgagctgggaacacatattgctttgctcaaagtccgtgacaaggattccagacacaatggagaagtgacttgtaaattggaaggtgatgttccatttaaaatattaacttcttcaagaaacacgtataaattagtgacagatgctgttctagaccgcgagcagaatccagagtacaatataaccgttacggcaacagatcggggcaagcctcccctctcctccagttccagcatcaccctgcacattggtgatgtaaatgacaacgctccggttttctcacagtcttcctatatagtccacgtggccgagaacaacccgcctggagcctctatttcacaagtcagggcttctgatccggacttggggcccaacggccaagtctcttactgcatcatggccagtgacctggagcagcgggagctgtcatcctacgtgtccataagcgcggagagcggggtggtgttcgcgcagcgcgccttcgaccacgagcagctgcgcgccttcgaactcacactgcaggcccgcgaccagggctcgccagcgctcagcgcgaacgtgagcctgcgcgtgttagtggacgaccgcaacgacaatgcgccacgggtgctgtaccccgcgctgggtcccgacggctctgcgctcttcgatatggtgccgcacgctgcagagcctggctacttggtgaccaaggtagtggcggtggacgcagactcaggacacaacgcctggctgtcctaccacgtgctgcaggctagcgagcccgggctcttcagcctggggctgcgcacgggcgaagtgcgcacagcgcgtgccttaggcgacagggacgccgtccgccagcgccttctggtcgccgtgcgtgacggtggacagccaccactctcggccactgccacgttgcacctggtcttcgccgacagcttgcaggaggtgctgccggatatcactgaccgccccgacccctctgacctccaggctgagctgcagttttacctagtggtggccttggccttgatctcagtgctcttcctcgtggccatgattctggccattgccttgcgcctgcgacgctcctccagccccgcctcctggagctgcttccagcctggtctctgtgttaaatccgaatccgtggttccccccaactacagcgaggggactttgccttattcctacaatctatgtgttgcacatacaggaaagacggagtttaatttcctaaaatgtagtgagcagttgagttcaggacaagacatactttgcggtgattcatctggggccttatttccactttgtaattccagtgaattgacttcccatcagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 172199 - DNA, 4725 bp, Homo sapiens
  Payload ID: 13857
  Gene Symbol: PCDHGB4
  Gene Name: protocadherin gamma subfamily B, 4
  Uniprot ID: Q9UN71
  ENST ID: ENST00000615384
  CDS Start-End: 188-2599
agggcagccccagctcagactccccagcgccagcctttacaccgcttcctcctcggaaaaagaagaattttttcttgaactggaactgcaactaaagtccgttcggagatccaaaaatctgcaatacagaggttatttgtaacccggcgtctccaggctggtgagcaagctgaggagagcaagagggatggggagcggcgccggggagctgggccgggctgagaggctgccagtgctctttctcttcctgctgtctttgttctgcccggcgctctgtgagcagatccgctacaggattcccgaggaaatgcccaagggctccgtagtggggaacctcgccacggacctggggttcagcgtccaggagttaccgactcgaaaactgcgcgtcagttcggagaagccttacttcaccgtgagcgcagagagcggggagttgcttgtgagcagcaggctagacagggaggagatatgcgggaagaagccagcttgtgctctggaatttgaggctgttgctgaaaatccactgaacttttatcacgtgaatgtggagatcgaggacattaatgaccacacgccaaaattcacgcaaaattcctttgagctgcaaataagtgagtctgcacagcctggcacacgatttatattaggatctgcccatgatgcggatattggtagcaacacactgcagaattaccaactcagtcccagtgatcatttctcactgataaataaagagaaatcagatggcagtaaataccctgagatggtattgaagacacctttggacagagaaaagcagaaatcctaccacttgactttgactgccttggactttggagctccacccctaagcagcactgcacagatacacgttctagtgactgatgccaatgataatgctccagtgttcagtcaagacgtatacagggtgagcctttcagaaaacgtgtacccggggaccacggtgctacaggtgactgccacggaccaggatgagggtgtcaatgccgagattactttctctttcagtgaagctagccagatcacccaatttgacctgaactctaacaccggggaaattactgttttaaatacattagattttgaagaagtcaaagaatattccatagttttggaagcaagggacggtggaggaatgattgcgcaatgcacagtggaggtagaagtcatagatgaaaatgacaacgccccagaagtgatattccagtctctacccaacctaattatggaggacgccgagctgggaacacatattgctttgctcaaagtccgtgacaaggattccagacacaatggagaagtgacttgtaaattggaaggtgatgttccatttaaaatattaacttcttcaagaaacacgtataaattagtgacagatgctgttctagaccgcgagcagaatccagagtacaatataaccgttacggcaacagatcggggcaagcctcccctctcctccagttccagcatcaccctgcacattggtgatgtaaatgacaacgctccggttttctcacagtcttcctatatagtccacgtggccgagaacaacccgcctggagcctctatttcacaagtcagggcttctgatccggacttggggcccaacggccaagtctcttactgcatcatggccagtgacctggagcagcgggagctgtcatcctacgtgtccataagcgcggagagcggggtggtgttcgcgcagcgcgccttcgaccacgagcagctgcgcgccttcgaactcacactgcaggcccgcgaccagggctcgccagcgctcagcgcgaacgtgagcctgcgcgtgttagtggacgaccgcaacgacaatgcgccacgggtgctgtaccccgcgctgggtcccgacggctctgcgctcttcgatatggtgccgcacgctgcagagcctggctacttggtgaccaaggtagtggcggtggacgcagactcaggacacaacgcctggctgtcctaccacgtgctgcaggctagcgagcccgggctcttcagcctggggctgcgcacgggcgaagtgcgcacagcgcgtgccttaggcgacagggacgccgtccgccagcgccttctggtcgccgtgcgtgacggtggacagccaccactctcggccactgccacgttgcacctggtcttcgccgacagcttgcaggaggtgctgccggatatcactgaccgccccgacccctctgacctccaggctgagctgcagttttacctagtggtggccttggccttgatctcagtgctcttcctcgtggccatgattctggccattgccttgcgcctgcgacgctcctccagccccgcctcctggagctgcttccagcctggtctctgtgttaaatccgaatccgtggttccccccaactacagcgaggggactttgccttattcctacaatctatgtgttgcacatacaggaaagacggagtttaatttcctaaaatgtagtgagcagttgagttcaggacaagacatactttgcggtgattcatctggggccttatttccactttgtaattccagtgaattgacttcccatcaggtgagtttcctttaagtataatttaatgctcattgcctacccatttctccatattcacaagaaaatatacatatttgcaggaaaatatataatttttagatgtcatggatcattttaggaaagttgtagtcagttaaaaagctgtcatatcattctacaaaggaggagtaaagtaggagcaattgtgtggcccaacatttgtttgttttttagccaagcttagatttataaagcaatgagggtgtggttttaaccacaaagtgaaagtgttagacagttgttggctctctcctaaaaagtgaatgagatttttcctatacattttccttcttgttgactaatatatgatgaatacttttttcagcttggatataccataaatataaaaataataaagccaaagaatttaagctaaaattcaacacttttcttaactaatttaactggtatggtctccatagtagtccactgttttgtttcctgtgttaacttcccttttgtttcaaaagctcttagaataaggagtcaactggatttttatgtccatggaccccttgtgattatatgcagtgtacgctgtgtgtgcgtgtgtgtgtgtgtgtgtgtgagagagatccttttacttagaaaaaggtctactatgctcattagaagatcaaaagcagattctccttacttgtaacataggagtttcaggattaatctgtattcaagctcattctatatccttcatcaaagaaaagacaatgttttgtgtctgttgtccctctcacacacagccctaatatataatgtgtaactgccttatctgcagccctaaactaatatagctagaggtcttctaatcattctcctacctctaggaaagaaatatagtcttgaaaactgccaatctggtgtgcatacaaaatatatacaaaataccaaggaacattatatgagccttttgctaggtatatctaagcaactgcttcagttaatggccactttacaaattgctgaaagaaggaaacgtctttcgattcttttttttttctttttttttttttgagacagagtctctgtctgttactcaggctgtagtgcagtggcacaatgatagctccctccagcctcaaactcctgggctcaagcattccttctgcatcagcctcctgactagctggaactcaggctcatgccaccagacctggctaatttttctgttttcagtagagaaaatattttctttcactaatttaactggtatggtttccattgtctacccagttttccatatgcataagaaaatatattcacaggaaaatataaagttttcagatttcatgagtggttttaagaaagttttagtcagtgaaaaaactatcataccagtcttcaaaggaagggtgaaataagttcatctgctacgttgcccaggctggtcttgaagggaaacagacttttttgtagtcatacttatcctttggcttcttagtaagtattatatagtcattactttttgcagttttttagatcaaagtgttaatgtaggtaaagttaattttagaatatatgtaaaagtcaagtctgctttaaatttaatcatctctttggtgaaagggatgggatggagctttgctttttatcatatattcatctgtacctttcaagtattcaaatagaaaaatataaacaatgtaaataaaatagcaaaacaatgtaatatctcataaaactgcaatggtaaaagcatttatcctattgaaattccacaatttttatttgaaaatattatcgacatgtaattcaagtggcatttagaagaataatttaaaagcaacaactctatagaaagcttgtaaaatgattaagtagtttaaaccaaataaaacaatttctgagtcagtcatctccagtaggtctattttagtctcaagataaattcatttctggtgacaactgaagttcttagttatttgttagtatatattggagacatttacaataaagcttagagcacaatgggaaatgaaagtatcatgttttttttaagaccaaatgtattgcagaaatgtgagtaatttaatccgatgctacaatctgatcattctgatctaatctgatcatttaataacactaaataaaaccttcatctcaca

SEQ ID NO: 172200 - DNA, 4578 bp, Homo sapiens
  Payload ID: 13858
  Gene Symbol: PCDHGB5
  Gene Name: protocadherin gamma subfamily B, 5
  Uniprot ID: Q9Y5G0
  ENST ID: ENST00000617380
  CDS Start-End: 1-2772
atggggagcggcgccggggagctgggccgggctgagaggctgccagtgctctttctcttcctgctgtctttgttctgcccggcgctctgtgagcagatccgctacaggattcccgaggaaatgcccaagggctccgtagtggggaacctcgccacggacctggggttcagcgtccaggagttaccgactcgaaaactgcgcgtcagttcggagaagccttacttcaccgtgagcgcagagagcggggagttgcttgtgagcagcaggctagacagggaggagatatgcgggaagaagccagcttgtgctctggaatttgaggctgttgctgaaaatccactgaacttttatcacgtgaatgtggagatcgaggacattaatgaccacacgccaaaattcacgcaaaattcctttgagctgcaaataagtgagtctgcacagcctggcacaagatttatactagaagtagcagaagatgcagatattggcttaaactctctgcagaagtataaactctctcttaacccaagtttctcattaataattaaggagaaacaggatggtagtaaatacccggaactggcactggagaaaaccttagaccgggaacaacagagttaccatcgtttagtcctgactgccttggacggtggacatccacccctaagcggcaccactgagctccggatccaggtaaccgacgccaatgataatcccccggtattcaaccgagacgtgtacagagtcagccttcgggaaaacgtgccaccaggcaccactgtgttgcaagtgtcagccactgaccaagacgagggcatcaactcagaaattacttattccttctacagaaccgggcaaatctttagtctgaattcaaagagcggagaaattaccactcaaaagaaactggattttgaagagaccaaggaatattcaatggttgtagaagggagggatggtggtggactggttgcacaatgtacagttgaaattaatattcaagatgaaaatgacaatagcccagaagttacattccattctctacttgaaatgattctggaaaacgcggtgcctggaacactaattgctttgatcaaaatacatgaccaagattctggggaaaatggggaggttaattgtcaattacaaggcgaagtcccttttaagattatctcttcatccaaaaattcgtataagttggtaacagatggaaccctagaccgagagcaaaccccggagtacaatgtcaccatcacagccacagacaggggcaagccgcccctctcctccagcataagcgtcatcctacatatcagagacgtcaacgataacgctccggttttccaccaggcgtcctacttagtcagtgtacccgaaaacaaccctcctggggcctccatcgcgcaagtctgcgcctcggacctggacttggggttgaacggccaagtctcctactctatcatggccagcgacctagagcctctggcactggcctcttacgtgtccatgagcgcgcaaagtggggtggtgttcgcgcagcgcgcctttgactacgagcagctgcgcaccttcgaactcacactacaggcccgcgaccagggctcgcctgcgctcagcgcaaacgtgagcctgcgcgtgttggtgggcgaccgaaacgacaacgcaccgcgggtgctgtaccccgcgctgggtcccgacggctctgcgctcttcgatatggtgccgcgcgctgcagagcccggctacctggtgaccaaggtagtggccgtggacgcagactcaggacacaacgcctggctgtcctaccacgtgctgcaggctagcgagcccgggctcttcagcctggggctgcgcacaggagaggtgcgcacagcgcgtgccttgggcgacagggacgcggcccgccagcgcctgctggttgctgtgcgtgatggtggacagccgccactctccgccaccgccacgctgcacttggtctttgctgacagcttgcaggaggtgctgccggatatcactgaccgccctgtaccctctgacccccaggctgagctgcagttttacctagtggtggccttggccttgatctcagtgctcttcctcctggccgtgattctggccgttgccttgcgcctgcgacgctcctccagccctgccgcctggagctgcttccaacctggtctctgtgtcaagtctggacctgtggttccccccaactacagtcaggggactttgccttattcctacaacctatgtgttgcacatacaggaaagacggagtttaatttcctaaaatgtagtgagcaattgagttcaggacaagacatactttgtggtgattcatctggggccttatttccactttgtaattccagcgagtcgacttcccatcctgagttgcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 172201 - DNA, 2670 bp, Homo sapiens
  Payload ID: 13858
  Gene Symbol: PCDHGB5
  Gene Name: protocadherin gamma subfamily B, 5
  Uniprot ID: Q9Y5G0
  ENST ID: ENST00000621169
  CDS Start-End: 142-2598
gcttcctcctcggaaaaagaatcgtttcctaaactggaactggaactaaagcccgttcggagatccaaaaatctacaatacagaggttatttgtaacctggcgtctccaggctggtgagcaagctgaggagagcaagagggatggggagcggcgccggggagctgggccgggctgagaggctgccagtgctctttctcttcctgctgtctttgttctgcccggcgctctgtgagcagatccgctacaggattcccgaggaaatgcccaagggctccgtagtggggaacctcgccacggacctggggttcagcgtccaggagttaccgactcgaaaactgcgcgtcagttcggagaagccttacttcaccgtgagcgcagagagcggggagttgcttgtgagcagcaggctagacagggaggagatatgcgggaagaagccagcttgtgctctggaatttgaggctgttgctgaaaatccactgaacttttatcacgtgaatgtggagatcgaggacattaatgaccacacgccaaaattcacgcaaaattcctttgagctgcaaataagtgagtctgcacagcctggcacaagatttatactagaagtagcagaagatgcagatattggcttaaactctctgcagaagtataaactctctcttaacccaagtttctcattaataattaaggagaaacaggatggtagtaaatacccggaactggcactggagaaaaccttagaccgggaacaacagagttaccatcgtttagtcctgactgccttggacggtggacatccacccctaagcggcaccactgagctccggatccaggtaaccgacgccaatgataatcccccggtattcaaccgagacgtgtacagagtcagccttcgggaaaacgtgccaccaggcaccactgtgttgcaagtgtcagccactgaccaagacgagggcatcaactcagaaattacttattccttctacagaaccgggcaaatctttagtctgaattcaaagagcggagaaattaccactcaaaagaaactggattttgaagagaccaaggaatattcaatggttgtagaagggagggatggtggtggactggttgcacaatgtacagttgaaattaatattcaagatgaaaatgacaatagcccagaagttacattccattctctacttgaaatgattctggaaaacgcggtgcctggaacactaattgctttgatcaaaatacatgaccaagattctggggaaaatggggaggttaattgtcaattacaaggcgaagtcccttttaagattatctcttcatccaaaaattcgtataagttggtaacagatggaaccctagaccgagagcaaaccccggagtacaatgtcaccatcacagccacagacaggggcaagccgcccctctcctccagcataagcgtcatcctacatatcagagacgtcaacgataacgctccggttttccaccaggcgtcctacttagtcagtgtacccgaaaacaaccctcctggggcctccatcgcgcaagtctgcgcctcggacctggacttggggttgaacggccaagtctcctactctatcatggccagcgacctagagcctctggcactggcctcttacgtgtccatgagcgcgcaaagtggggtggtgttcgcgcagcgcgcctttgactacgagcagctgcgcaccttcgaactcacactacaggcccgcgaccagggctcgcctgcgctcagcgcaaacgtgagcctgcgcgtgttggtgggcgaccgaaacgacaacgcaccgcgggtgctgtaccccgcgctgggtcccgacggctctgcgctcttcgatatggtgccgcgcgctgcagagcccggctacctggtgaccaaggtagtggccgtggacgcagactcaggacacaacgcctggctgtcctaccacgtgctgcaggctagcgagcccgggctcttcagcctggggctgcgcacaggagaggtgcgcacagcgcgtgccttgggcgacagggacgcggcccgccagcgcctgctggttgctgtgcgtgatggtggacagccgccactctccgccaccgccacgctgcacttggtctttgctgacagcttgcaggaggtgctgccggatatcactgaccgccctgtaccctctgacccccaggctgagctgcagttttacctagtggtggccttggccttgatctcagtgctcttcctcctggccgtgattctggccgttgccttgcgcctgcgacgctcctccagccctgccgcctggagctgcttccaacctggtctctgtgtcaagtctggacctgtggttccccccaactacagtcaggggactttgccttattcctacaacctatgtgttgcacatacaggaaagacggagtttaatttcctaaaatgtagtgagcaattgagttcaggacaagacatactttgtggtgattcatctggggccttatttccactttgtaattccagcgagtcgacttcccatcctgagttggtgagtttcatttatgtctattctttttcattacccacccaattttctgtatttacatgaaactatcgtacattttcaagtccaatgagttgtcttagggaagtcagagctgctcagaaagctgtcctacca

SEQ ID NO: 172202 - DNA, 4599 bp, Homo sapiens
  Payload ID: 13859
  Gene Symbol: PCDHGB6
  Gene Name: protocadherin gamma subfamily B, 6
  Uniprot ID: Q9Y5F9
  ENST ID: ENST00000520790
  CDS Start-End: 1-2793
atgggagggagctgcgcgcagaggcgccgggccggcccgcggcaggtgctatttcctttgctgctgcctttgttctaccccaccctgagtgagccgatccgctactcgattccggaggagctggccaagggctcggtggtggggaacctcgctaaggatctagggctcagtgtcctggatgtgtcggctcgcaagctgcgagtgagcgcggagaagctgcacttcagcgtagacgcggagagcggggacttacttgtgaagaaccgaatagaccgtgagcaaatatgcaaagagagaagaagatgtgagttgcaattggaagctgtggtggaaaatcctttaaatatttttcatgtcattgtggtgattgaggatgttaatgaccacgcccctcaatttgataaaaaggaaatacatttagaaattttcgaatctgcatccgctggtacacgactatcgcttgaccctgccacggatcctgatataaacataaactcaattaaagattataagataaactctaatccttatttttcattaatggttagagttaattccgatggtggcaaatacccagagttatctctggagaaactcctagaccgggaagaacagagatctcatagcttgatattgactgccttggacggaggggacccaccaagaagtgccaccgctcacatagaaatttctgtcaaggataccaatgataaccccccggttttcagcagagacgaatatagaattagtcttagtgaaaatctgccccctgggtcccctgtgttgcaagtgacagccactgaccaggatgagggggtcaatgctgagataaactactacttccgaagcactgcccagagcacaaaacatatgttctcattggatgagaaaacaggtatgattaagaataaccagtcatttgattttgaagatgtagaaaggtacaccatggaagtggaagcgaaggacggaggtggtctctctacccagtgtaaagtaatcatagaaatccttgatgaaaacgacaacagcccagaaataatcatcacttctctctctgatcagattttggagaattcacctccaggaatggttgttgccctcttcaaaacacgggatctggatttcggaggaaatggagaagtcaggtgtaatatagaaacagacattccattcaagatttattcttcttccaataactactacaaactggtgacagatggagccctggaccgagagcagacaccagaatacaatgtcaccatcgtagccactgacaggggcaagccgcctctttcttccagtagaagcatcaccttgtatgtcgctgacatcaacgacaacgccccagttttcgaccagacgtcctacgtggtccacgtggccgagaacaacccgccaggagcctccattgcgcaagtgagcgcctctgacccggatttggggctcaatggccacatctcctactctatagtggcgagtgacctagagcccctggcggtgtcgtcatacgtgtcagtgagcgcgcagagcggggtggtgttcgcgcagcgcgcctttgatcacgagcagctgcgcgccttcgcgctcacgctgcaggcccgcgaccacggctcgcccacgctcagcgccaacgtgagcctgcgcgtgttggtgggagaccgcaatgacaacgcaccgcgggtgctgtacccagctctgggtcctgacggctccgcgttcttcgatatggtacctcgctctgcagagcccggctacctagtgactaaggtggtagcggtggacgccgactcgggacacaacgcctggctgtcctaccacgtgctgcaggccagtgagcccggactcttcagcctggggctgcgcactggggaggtgcgcacggctcgagccttaggcgacagggacgcagcccgccagcgcctgctggtcgctgtgcgtgacggtggacagccgccactctctgccaccgccacgcttcatctggtcttcgcagacaacttgcaagagatactgccagacctcagcgaccgccctgtactctctgacccccaggctgaactgcagttttacctggtggtggccttggccttaatctcagtgctcttcctcctcgccgtgattctggccattgccttgcgcctgcgacgctctctcagccctgctacttgggactgcttccatcctggtctctgtgtcaagtctggacctgtagttccccccaactacagtgaggggactttgccttattcttataatctgtgcattgcacatacgggtacaaaagagtttaatttcctaaaatgcagtgtgcccctacattccaatgaagacatggtttgcagtgtttctcctggagccttaattccacctcatggtggggaggatttgacttcacatcctgagactctgacttcgcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 172203 - DNA, 4601 bp, Homo sapiens
  Payload ID: 13859
  Gene Symbol: PCDHGB6
  Gene Name: protocadherin gamma subfamily B, 6
  Uniprot ID: Q9Y5F9
  ENST ID: ENST00000616430
  CDS Start-End: 183-2645
agaaagaagaaaaccagctcccacacagagcctcccggctgcgcagacctttcccagcacagcggattgccagctccgagacccgggactcctcctgtcctgggccgaatgctcttttagcgcggtagagtgcactttctccaactggaaaagcggggacccagcgagaacccgagcgaacgatgggagggagctgcgcgcagaggcgccgggccggcccgcggcaggtgctatttcctttgctgctgcctttgttctaccccaccctgagtgagccgatccgctactcgattccggaggagctggccaagggctcggtggtggggaacctcgctaaggatctagggctcagtgtcctggatgtgtcggctcgcaagctgcgagtgagcgcggagaagctgcacttcagcgtagacgcggagagcggggacttacttgtgaagaaccgaatagaccgtgagcaaatatgcaaagagagaagaagatgtgagttgcaattggaagctgtggtggaaaatcctttaaatatttttcatgtcattgtggtgattgaggatgttaatgaccacgcccctcaatttgataaaaaggaaatacatttagaaattttcgaatctgcatccgctggtacacgactatcgcttgaccctgccacggatcctgatataaacataaactcaattaaagattataagataaactctaatccttatttttcattaatggttagagttaattccgatggtggcaaatacccagagttatctctggagaaactcctagaccgggaagaacagagatctcatagcttgatattgactgccttggacggaggggacccaccaagaagtgccaccgctcacatagaaatttctgtcaaggataccaatgataaccccccggttttcagcagagacgaatatagaattagtcttagtgaaaatctgccccctgggtcccctgtgttgcaagtgacagccactgaccaggatgagggggtcaatgctgagataaactactacttccgaagcactgcccagagcacaaaacatatgttctcattggatgagaaaacaggtatgattaagaataaccagtcatttgattttgaagatgtagaaaggtacaccatggaagtggaagcgaaggacggaggtggtctctctacccagtgtaaagtaatcatagaaatccttgatgaaaacgacaacagcccagaaataatcatcacttctctctctgatcagattttggagaattcacctccaggaatggttgttgccctcttcaaaacacgggatctggatttcggaggaaatggagaagtcaggtgtaatatagaaacagacattccattcaagatttattcttcttccaataactactacaaactggtgacagatggagccctggaccgagagcagacaccagaatacaatgtcaccatcgtagccactgacaggggcaagccgcctctttcttccagtagaagcatcaccttgtatgtcgctgacatcaacgacaacgccccagttttcgaccagacgtcctacgtggtccacgtggccgagaacaacccgccaggagcctccattgcgcaagtgagcgcctctgacccggatttggggctcaatggccacatctcctactctatagtggcgagtgacctagagcccctggcggtgtcgtcatacgtgtcagtgagcgcgcagagcggggtggtgttcgcgcagcgcgcctttgatcacgagcagctgcgcgccttcgcgctcacgctgcaggcccgcgaccacggctcgcccacgctcagcgccaacgtgagcctgcgcgtgttggtgggagaccgcaatgacaacgcaccgcgggtgctgtacccagctctgggtcctgacggctccgcgttcttcgatatggtacctcgctctgcagagcccggctacctagtgactaaggtggtagcggtggacgccgactcgggacacaacgcctggctgtcctaccacgtgctgcaggccagtgagcccggactcttcagcctggggctgcgcactggggaggtgcgcacggctcgagccttaggcgacagggacgcagcccgccagcgcctgctggtcgctgtgcgtgacggtggacagccgccactctctgccaccgccacgcttcatctggtcttcgcagacaacttgcaagagatactgccagacctcagcgaccgccctgtactctctgacccccaggctgaactgcagttttacctggtggtggccttggccttaatctcagtgctcttcctcctcgccgtgattctggccattgccttgcgcctgcgacgctctctcagccctgctacttgggactgcttccatcctggtctctgtgtcaagtctggacctgtagttccccccaactacagtgaggggactttgccttattcttataatctgtgcattgcacatacgggtacaaaagagtttaatttcctaaaatgcagtgtgcccctacattccaatgaagacatggtttgcagtgtttctcctggagccttaattccacctcatggtggggaggatttgacttcacatcctgagactctgacttcggtgagtttctcttttttgtgtgtgatttatctaatagtctactagtttctcatattttaggcatactactttattttcatatctagaatcatatgtttaaaatccatagctttttacaatattttctcaatgttttttcaattatagttttcactatgtatttggttcataagttgctctatctttttgtaaaataatgtcaccagactgaagatattttgtctttgtcttttttttttttttttttttttgagatggagtctcgcactgttgcctaggctggagtgcagtggcgtgatctctgctcactgcaacctccgccttctgggttcaagcgattctcctgcctcagcctcccaagtagctgggattactggtgcccctcaccacagctaaattttttgtatttttagtagacatggggtttcactatgtcgaccaggctgttcagaaactcctgtcctcgtgatcctcccaccttggcctctcaaagtgctgggattacaggcgtgagccacaatattttgtcaagttctgactatcgaacagaagcagtggtcttggcatctaagaaaacaaacaagtaacctatctattcaaatttgcgaagacttagtgaatttacgatatcttatttatatatttttaaagcctaaaaatattcagaagacaggcccagtggctcacacctataatcacagcactttgataggctgaatcggaaagtatcacttgagcccaagaattgagaccagcctgggcaatatagggagaccccccatctctactaaaacaacaacaacaaaaaaaaacattagcagagtgtggtagcattcccctgtggtcccagctacttgggaggctgagctgggtggattgcttggtcctgggaggtcaaggttgcagtgagccctgatcttgccactgcactccagcctgggcgacagagtgcgaccctgtctctaaaataaataaataaatatgcaggcagggccaagtgtgctgtaatcccagcactttgggaggtggaggtggagaatctcttgagcgcaggaatttgagaccagcctgggcaacacagggagactccatcgctacagaacatttaaaaattagcagggtgtggtggcacatgcctgtggtctcagctactctggtggctgtggtgggagaatcgcttgagcccaggaagtctaggctgcagtgagctgtctaggtgacagagtgagaccctgtctcaaaaaaaaaagacatttctaagaaataaatgaaatactattgcctttgcactcagtctctgtctctgattctctgatagaagatttttgaagaaaaaagataaaatctttgaagagttctatacttggaaggcatagtgacataaacacttctgaacatcctgttctctgtgtgaaagaagtgaacttctataccctttgcatttgagggaacaattgctactgggttgatgggcacacacagttgaagatatgtgaaccactggactttggcctctgatacaaactgcctaagagaagagattatttatactggtattaatgctctgatgaaaacaggtcatttgacataaacacttacttgttaaaaacctatatcactacatctaactttgttttctaaaacttttagtacttcaaattctacgtatttcttttctcattacaatgcaaacagtttaatttgcaactgtaatatatgttcattttagtttgtgattacctgcttaatcatttaaataggtccatttaacttgtatccctgtaagataaagtatgttttacacaaaaaggttaattaaggctcagtaaaactattctagaagagtactttaaaaacctcttacacaatcctaagctaaataagtttaatgaattaagtagttacaattataaagcttcagagtgaattatctcatgagtttatttaatataatctttgtatgaatgtatactaaataaaattggcctattcaaatcacaa

SEQ ID NO: 172204 - DNA, 4765 bp, Homo sapiens
  Payload ID: 13860
  Gene Symbol: PCDHGB7
  Gene Name: protocadherin gamma subfamily B, 7
  Uniprot ID: Q9Y5F8
  ENST ID: ENST00000398594
  CDS Start-End: 170-2959
ccagctcccacacagaggctcccggctgcgcagaccttgcccagcacaccagattgccagctccgagacccgggactcctcctgtcctgggccgaatgctcttttagcgcggtagagtgcactttctccaactggaaaagcggggacccagcgagaacccgagcgaacgatgggagggagctgcgcgcagaggcgccgggccggcccgcggcaggtactatttcctttgctgctgcctttgttctaccccacgctgtgtgagccgatccgctactcgattccggaggagctggccaagggctcggtggtggggaacctcgctaaggatctagggcttagtgtcctggatgtgtcggctcgcgagctgcgagtgagcgcggagaagctgcacttcagcgtagacgcgcagagcggggacttacttgtgaaggaccgaatagaccgtgagcaaatatgcaaagagagaagaagatgtgagttgcaattggaagctgtggtggaaaatcctttaaatatttttcatgtcattgtggtgattgaggatgttaatgaccacgcccctcaattccggaaagatgaaataaacttagaaatcagtgaatccgtcagcctggggatgggaacaattcttgagtctgcagaagatcctgatattagtatgaattcgctgagcaaataccaactaagtcctaacgagtatttctcattggtggagaaagacaatcctgatggtggcaaatatccagaattagtattgcagaagactctggaccgagaaacgcagagcgctcaccacttggtactgaccgccttagatggtggggaccctccccgaagcggtactgctcagataagaatcctggtaatagatgccaatgacaaccccccagtgttcagccaggacgtgtacagggttagccttcgggaagacgtgcctccaggcacctccatcctgagagtgaaggccactgaccaggacgagggcatcaactcagagatcacttattccttctttggtgtggctgacaaagctcagcacgtgttctctctggattacactacaggaaacattctaactcagcagcctttggattttgaagaagtagaaagatatacgataaacatagaagcaaaagaccgaggatctctctcaacacggtgtaaagtaattgtagaagttgtagacgaaaacgacaacagcccagaaataatcatcacgtcactctctgatcagattatggaggattcccctccaggagtggttgttgccctcttcaaaacacgggaccaagactcaggggaaaatggggaagtcaggtgtagcttaagtagaggtgttccatttaagattcattcttcttctaataattactacaagctagtaacagatgaggccctggatcgggagcagaccccagagtacaacgtcaccatcgcagccacagacaggggcaagcctccgttatcctccagcaaaaccataaccctgcacattactgacgtcaatgacaacgcgccggttttcggacagtcagcctacctggtccacgtgccagaaaacaaccagccgggtgcctccatagcgcaagtcagtgcctctgacccagacttcgggctcaacggccgtgtctcctactctctcattgccagcgacctggagtcacgaacgctgtcgtcctacgtgtccgtgagcgcgcagagcggggtggtgttcgcgcagcgcgccttcgaccacgagcagctgcgcaccttcgagctcacgctgcaggcccgcgaccagggctcgcccgcgctcagcgccaatgtgagcctgcgcgtgttggtgggcgaccgtaacgacaacgcaccgcgggtgctgtaccctgcgctgggtcccgacggctccgcgctcttcgacacagtgccgcgggccgcgcagccaggctacctggtgaccaaggtggtggccgtggacgcggactcggggcacaatgcctggctgtcctaccacgtggtgcaggccagtgagcccgggctcttcagcctggggctgcgaacaggcgaggtgcgcatggtgcgtgctttgggtgacaaggactcggtccgccagcgcctgctagtcgctgtaagagatggaggacagccacccctttcagccactgccacgctgcacctggtgttcgcagatagcttgcaagaggtactgccggatttcagcgaccatcccacaccctctgactcccaggctgagatgcagttttacctggtggtggccttggccttgatttctgtgctctttctcctcgcggtgattctagctattgctctacgcctgcgacagtctttcagccctactgcaggagactgctttgagtcagttctctgctccaagtccggacctgtgggtccccccaactacagtgagggaacgttgccctatgcctataatttttgtgtgcctggggatcaaatgaatccagaatttaattttttcacatctgttgatcattgtccagccacacaagataacctcaacaaagatagcatgctactggctagcattttaactcccagcgttgaagcagataagaagattcttaaacagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 172205 - DNA, 2785 bp, Homo sapiens
  Payload ID: 13860
  Gene Symbol: PCDHGB7
  Gene Name: protocadherin gamma subfamily B, 7
  Uniprot ID: Q9Y5F8
  ENST ID: ENST00000612073
  CDS Start-End: 216-2642
gcctctagcctgggattccctgcgcagccaacaacagaaaagaaaaccagctcccacacagaggctcccggctgcgcagaccttgcccagcacaccagattgccagctccgagacccgggactcctcctgtcctgggccgaatgctcttttagcgcggtagagtgcactttctccaactggaaaagcggggacccagcgagaacccgagcgaacgatgggagggagctgcgcgcagaggcgccgggccggcccgcggcaggtactatttcctttgctgctgcctttgttctaccccacgctgtgtgagccgatccgctactcgattccggaggagctggccaagggctcggtggtggggaacctcgctaaggatctagggcttagtgtcctggatgtgtcggctcgcgagctgcgagtgagcgcggagaagctgcacttcagcgtagacgcgcagagcggggacttacttgtgaaggaccgaatagaccgtgagcaaatatgcaaagagagaagaagatgtgagttgcaattggaagctgtggtggaaaatcctttaaatatttttcatgtcattgtggtgattgaggatgttaatgaccacgcccctcaattccggaaagatgaaataaacttagaaatcagtgaatccgtcagcctggggatgggaacaattcttgagtctgcagaagatcctgatattagtatgaattcgctgagcaaataccaactaagtcctaacgagtatttctcattggtggagaaagacaatcctgatggtggcaaatatccagaattagtattgcagaagactctggaccgagaaacgcagagcgctcaccacttggtactgaccgccttagatggtggggaccctccccgaagcggtactgctcagataagaatcctggtaatagatgccaatgacaaccccccagtgttcagccaggacgtgtacagggttagccttcgggaagacgtgcctccaggcacctccatcctgagagtgaaggccactgaccaggacgagggcatcaactcagagatcacttattccttctttggtgtggctgacaaagctcagcacgtgttctctctggattacactacaggaaacattctaactcagcagcctttggattttgaagaagtagaaagatatacgataaacatagaagcaaaagaccgaggatctctctcaacacggtgtaaagtaattgtagaagttgtagacgaaaacgacaacagcccagaaataatcatcacgtcactctctgatcagattatggaggattcccctccaggagtggttgttgccctcttcaaaacacgggaccaagactcaggggaaaatggggaagtcaggtgtagcttaagtagaggtgttccatttaagattcattcttcttctaataattactacaagctagtaacagatgaggccctggatcgggagcagaccccagagtacaacgtcaccatcgcagccacagacaggggcaagcctccgttatcctccagcaaaaccataaccctgcacattactgacgtcaatgacaacgcgccggttttcggacagtcagcctacctggtccacgtgccagaaaacaaccagccgggtgcctccatagcgcaagtcagtgcctctgacccagacttcgggctcaacggccgtgtctcctactctctcattgccagcgacctggagtcacgaacgctgtcgtcctacgtgtccgtgagcgcgcagagcggggtggtgttcgcgcagcgcgccttcgaccacgagcagctgcgcaccttcgagctcacgctgcaggcccgcgaccagggctcgcccgcgctcagcgccaatgtgagcctgcgcgtgttggtgggcgaccgtaacgacaacgcaccgcgggtgctgtaccctgcgctgggtcccgacggctccgcgctcttcgacacagtgccgcgggccgcgcagccaggctacctggtgaccaaggtggtggccgtggacgcggactcggggcacaatgcctggctgtcctaccacgtggtgcaggccagtgagcccgggctcttcagcctggggctgcgaacaggcgaggtgcgcatggtgcgtgctttgggtgacaaggactcggtccgccagcgcctgctagtcgctgtaagagatggaggacagccacccctttcagccactgccacgctgcacctggtgttcgcagatagcttgcaagaggtactgccggatttcagcgaccatcccacaccctctgactcccaggctgagatgcagttttacctggtggtggccttggccttgatttctgtgctctttctcctcgcggtgattctagctattgctctacgcctgcgacagtctttcagccctactgcaggagactgctttgagtcagttctctgctccaagtccggacctgtgggtccccccaactacagtgagggaacgttgccctatgcctataatttttgtgtgcctggggatcaaatgaatccagaatttaattttttcacatctgttgatcattgtccagccacacaagataacctcaacaaagatagcatgctactggctagcattttaactcccagcgttgaagcagataagaagattcttaaacaggtaagtatttaaaaatgtatttaatcctttttatattacaatatgccaatatattccaatatagtggtattattttaagattctagataacttcttcatagagttcgcaaaatataggtcaaatttatggttatcattattaaaacaaaagttta

SEQ ID NO: 172206 - DNA, 4725 bp, Homo sapiens
  Payload ID: 13861
  Gene Symbol: PCDHGC3
  Gene Name: protocadherin gamma subfamily C, 3
  Uniprot ID: Q9UN70
  ENST ID: ENST00000308177
  CDS Start-End: 115-2919
agaaagccatgtcggactcggcgcccagcgcccaagcgctaacccgctgaaagtttctcagcgaaatctcagggacgatctggaccccgctgagaggaactgcttttgagtgagatggtcccagaggcctggaggagcggactggtaagcaccgggagggtagtgggagttttgcttctgcttggtgccttgaacaaggcttccacggtcattcactatgagatcccggaggaaagagagaagggtttcgctgtgggcaacgtggtcgcgaaccttggtttggatctcggtagcctctcagcccgcaggttccgggtggtgtctggagctagccgaagattctttgaggtgaaccgggagaccggagagatgtttgtgaacgaccgtctggatcgagaggagctgtgtgggacactgccctcttgcactgtaactctggagttggtagtggagaacccgctggagctgttcagcgtggaagtggtgatccaggacatcaacgacaacaatcctgctttccctacccaggaaatgaaattggagattagcgaggccgtggctccggggacgcgctttccgctcgagagcgcgcacgatcccgatgtgggaagcaactctttacaaacctatgagctgagccgaaatgaatactttgcgcttcgcgtgcagacgcgggaggacagcaccaagtacgcggagctggtgttggagcgcgccctggaccgagaacgggagcctagtctccagttagtgctgacggcgttggacggagggaccccagctctctccgccagcctgcctattcacatcaaggtgctggacgcgaatgacaatgcgcctgtcttcaaccagtccttgtaccgggcgcgcgtcctggaggatgcaccctccggcacgcgcgtggtacaagtccttgcaacggatctggatgaaggccccaacggtgaaattatttactccttcggcagccacaaccgcgccggcgtgcggcaactattcgccttagaccttgtaaccgggatgctgacaatcaagggtcggctggacttcgaggacaccaaactccatgagatttacatccaggccaaagacaagggcgccaatcccgaaggagcacattgcaaagtgttggtggaggttgtggatgtgaatgacaacgccccggagatcacagtcacctccgtgtacagcccagtacccgaggatgcccctctggggactgtcatcgctttgctcagtgtgactgacctggatgctggcgagaacgggctggtgacctgcgaagttccaccgggtctccctttcagccttacttcttccctcaagaattacttcactttgaaaaccagtgcagacctggatcgggagactgtgccagaatacaacctcagcatcaccgcccgagacgccggaaccccttccctctcagcccttacaatagtgcgtgttcaagtgtccgacatcaatgacaaccctccacaatcttctcaatcttcctacgacgtttacattgaagaaaacaacctccccggggctccaatactaaacctaagtgtctgggaccccgacgccccgcagaatgctcggctttctttctttctcttggagcaaggagctgaaaccgggctagtgggtcgctatttcacaataaatcgtgacaatggcatagtgtcatccttagtgcccctagactatgaggatcggcgggaatttgaattaacagctcatatcagcgatgggggcaccccggtcctagccaccaacatcagcgtgaacatatttgtcactgatcgcaatgacaatgccccccaggtcctatatcctcggccaggtgggagctcggtggagatgctgcctcgaggtacctcagctggccacctagtgtcacgggtggtaggctgggacgcggatgcagggcacaatgcctggctctcctacagtctcttgggatcccctaaccagagcctttttgccatagggctgcacactggtcaaatcagtactgcccgtccagtccaagacacagattcacccaggcagactctcacggtcttgatcaaagacaatggggagccttcgctctccaccactgctaccctcactgtgtcagtaaccgaggactctcctgaagcccgagccgagttcccctctggctctgccccccgggagcagaaaaaaaatctcaccttttatctacttctttctctaatcctggtttctgtggggtttgtggtcacagtgttcggagtaatcatattcaaagtttacaagtggaagcagtctagagacctataccgagccccggtgagctcactgtaccgaacaccagggccctccttgcacgcggacgccgtgcggggaggcctgatgtcgccgcacctttaccatcaggtgtatctcaccacggactcccgccgcagcgacccgctgctgaagaaacctggtgcagccagtccactggccagccgccagaacacgctgcggagctgtgatccggtgttctataggcaggtgttgggtgcagagagcgcccctcccggacagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 172207 - DNA, 2849 bp, Homo sapiens
  Payload ID: 13861
  Gene Symbol: PCDHGC3
  Gene Name: protocadherin gamma subfamily C, 3
  Uniprot ID: Q9UN70
  ENST ID: ENST00000611950
  CDS Start-End: 171-2762
ctgcgccccgggatgaggcagagactgaacagccggcgagcaaatcaacggcatccagaaagccatgtcggactcggcgcccagcgcccaagcgctaacccgctgaaagtttctcagcgaaatctcagggacgatctggaccccgctgagaggaactgcttttgagtgagatggtcccagaggcctggaggagcggactggtaagcaccgggagggtagtgggagttttgcttctgcttggtgccttgaacaaggcttccacggtcattcactatgagatcccggaggaaagagagaagggtttcgctgtgggcaacgtggtcgcgaaccttggtttggatctcggtagcctctcagcccgcaggttccgggtggtgtctggagctagccgaagattctttgaggtgaaccgggagaccggagagatgtttgtgaacgaccgtctggatcgagaggagctgtgtgggacactgccctcttgcactgtaactctggagttggtagtggagaacccgctggagctgttcagcgtggaagtggtgatccaggacatcaacgacaacaatcctgctttccctacccaggaaatgaaattggagattagcgaggccgtggctccggggacgcgctttccgctcgagagcgcgcacgatcccgatgtgggaagcaactctttacaaacctatgagctgagccgaaatgaatactttgcgcttcgcgtgcagacgcgggaggacagcaccaagtacgcggagctggtgttggagcgcgccctggaccgagaacgggagcctagtctccagttagtgctgacggcgttggacggagggaccccagctctctccgccagcctgcctattcacatcaaggtgctggacgcgaatgacaatgcgcctgtcttcaaccagtccttgtaccgggcgcgcgtcctggaggatgcaccctccggcacgcgcgtggtacaagtccttgcaacggatctggatgaaggccccaacggtgaaattatttactccttcggcagccacaaccgcgccggcgtgcggcaactattcgccttagaccttgtaaccgggatgctgacaatcaagggtcggctggacttcgaggacaccaaactccatgagatttacatccaggccaaagacaagggcgccaatcccgaaggagcacattgcaaagtgttggtggaggttgtggatgtgaatgacaacgccccggagatcacagtcacctccgtgtacagcccagtacccgaggatgcccctctggggactgtcatcgctttgctcagtgtgactgacctggatgctggcgagaacgggctggtgacctgcgaagttccaccgggtctccctttcagccttacttcttccctcaagaattacttcactttgaaaaccagtgcagacctggatcgggagactgtgccagaatacaacctcagcatcaccgcccgagacgccggaaccccttccctctcagcccttacaatagtgcgtgttcaagtgtccgacatcaatgacaaccctccacaatcttctcaatcttcctacgacgtttacattgaagaaaacaacctccccggggctccaatactaaacctaagtgtctgggaccccgacgccccgcagaatgctcggctttctttctttctcttggagcaaggagctgaaaccgggctagtgggtcgctatttcacaataaatcgtgacaatggcatagtgtcatccttagtgcccctagactatgaggatcggcgggaatttgaattaacagctcatatcagcgatgggggcaccccggtcctagccaccaacatcagcgtgaacatatttgtcactgatcgcaatgacaatgccccccaggtcctatatcctcggccaggtgggagctcggtggagatgctgcctcgaggtacctcagctggccacctagtgtcacgggtggtaggctgggacgcggatgcagggcacaatgcctggctctcctacagtctcttgggatcccctaaccagagcctttttgccatagggctgcacactggtcaaatcagtactgcccgtccagtccaagacacagattcacccaggcagactctcacggtcttgatcaaagacaatggggagccttcgctctccaccactgctaccctcactgtgtcagtaaccgaggactctcctgaagcccgagccgagttcccctctggctctgccccccgggagcagaaaaaaaatctcaccttttatctacttctttctctaatcctggtttctgtggggtttgtggtcacagtgttcggagtaatcatattcaaagtttacaagtggaagcagtctagagacctataccgagccccggtgagctcactgtaccgaacaccagggccctccttgcacgcggacgccgtgcggggaggcctgatgtcgccgcacctttaccatcaggtgtatctcaccacggactcccgccgcagcgacccgctgctgaagaaacctggtgcagccagtccactggccagccgccagaacacgctgcggagctgtgatccggtgttctataggcaggtgttgggtgcagagagcgcccctcccggacaggtaaggtttagcaagtcatgcttgaccctgttagtgcttttttattcctacatcatattgaggaaggaatggagctgtttttttagtgatgaagatgttttcctggtgatgcattcacactttcaactggcccttcctagatcaaagttagtgcctttgtgagatggtggcctgccagagtgtggtttgtggtcccatttcagggggaagatacttgactcatctgtggacctaattcacatcctcagc

SEQ ID NO: 172208 - DNA, 731 bp, Homo sapiens
  Payload ID: 13861
  Gene Symbol: PCDHGC3
  Gene Name: protocadherin gamma subfamily C, 3
  ENST ID: ENST00000617222
  CDS Start-End: 117-674
ccagaaagccatgtcggactcggcgcccagcgcccaagcgctaacccgctgaaagtttctcagcgaaatctcagggacgatctggaccccgctgagaggaactgcttttgagtgagatggtcccagaggcctggaggagcggactggtgtatctcaccacggactcccgccgcagcgacccgctgctgaagaaacctggtgcagccagtccactggccagccgccagaacacgctgcggagctgtgatccggtgttctataggcaggtgttgggtgcagagagcgcccctcccggacagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctc

SEQ ID NO: 172209 - DNA, 2346 bp, Homo sapiens
  Payload ID: 13861
  Gene Symbol: PCDHGC3
  Gene Name: protocadherin gamma subfamily C, 3
  ENST ID: ENST00000617641
  CDS Start-End: 138-542
cggcgagcaaatcaacggcatccagaaagccatgtcggactcggcgcccagcgcccaagcgctaacccgctgaaagtttctcagcgaaatctcagggacgatctggaccccgctgagaggaactgcttttgagtgagatggtcccagaggcctggaggagcggactgcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagc

SEQ ID NO: 172210 - DNA, 845 bp, Homo sapiens
  Payload ID: 13861
  Gene Symbol: PCDHGC3
  Gene Name: protocadherin gamma subfamily C, 3
  ENST ID: ENST00000621008
  CDS Start-End: 119-845
atccagaaagccatgtcggactcggcgcccagcgcccaagcgctaacccgctgaaagtttctcagcgaaatctcagggacgatctggaccccgctgagaggaactgcttttgagtgagatggtcccagaggcctggaggagcggactggaaatgaaattggagattagcgaggccgtggctccggggacgcgctttccgctcgagagcgcgcacgatcccgatgtgggaagcaactctttacaaacctatgagctgagccgaaatgaatactttgcgcttcgcgtgcagacgcgggaggacagcaccaagtacgcggagctggtgttggagcgcgccctggaccgagaacgggagcctagtctccagttagtgctgacggcgttggacggagggaccccagctctctccgccagcctgcctattcacatcaaggtgctggacgcgaatgacaatgcgcctgtcttcaaccagtccttgtaccgggcgcgcgtcctggaggatgcaccctccggcacgcgcgtggtacaagtccttgcaacggatctggatgaaggccccaacggtgaaattatttactccttcggcagccacaaccgcgccggcgtgcggcaactattcgccttagaccttgtaaccgggatgctgacaatcaagggtcggctggacttcgaggacaccaaactccatgagatttacatccaggccaaagacaagggcgccaatcccgaaggagcacattgcaaagtgttggtggaggttgtggatgtgaatgacaacgccccggagatcacagtcacctccgtgtacagcccagtacccgaggatgcccctctggggactgtca

SEQ ID NO: 172211 - DNA, 4623 bp, Homo sapiens
  Payload ID: 13862
  Gene Symbol: PCDHGC4
  Gene Name: protocadherin gamma subfamily C, 4
  Uniprot ID: Q9Y5F7
  ENST ID: ENST00000306593
  CDS Start-End: 1-2817
atgctccgcaaggtgagaagctggacagaaatctggcggtgggctacccttttgttcctcttttaccacctgggttacgtttgtgggcagatccgctacccggtcccagaggagtcacaggaagggacttttgtagggaatgtcgctcaagatttcctgctggatacggacagtctgtcagctcgcaggctgcaggtcgctggagaggtgaaccaaagacacttccgtgtggatttggacagcggagccctgctcatcaagaacccaatcgaccgagaggcactgtgtgggctcagtgccagctgcatcgtgcccctggagtttgtcaccgaaggtcctttggaaatgtaccgagcagaggtagagatcgtagatgtgaatgatcacgccccccgttttccgcggcagcagctggacttggaaattggggaggcagctcctccaggacagcgtttcccgttggaaaaggctcaggatgcagatgtggggagcaattcgattagcagctataggctgagctccaatgaacactttgcactggatgtgaagaagcgcagcgacggcagcctggtcccagagctgctcctggagaagcctttggatcgagagaagcaatcggactaccgcctggtgctgactgctgtcgatggagggaacccgccgagatctggcaccgcagagctccgggtatccgtgctggacgtaaacgacaacgccccagccttccagcaatccagctacaggattagtgtgttggagagcgcaccagcgggcatggtgctcatccagctcaatgcctcagacccggacctgggtcccagtggtaacgtcaccttttatttcagtggtcatacccctgatcgtgtaagaaacctctttagcctgcaccccactactggaaagcttactcttttggggcccctagactttgagagtgagaattactatgaatttgatgtgcgggctcgcgatgggggttctccagccatggagcaacattgcagccttcgagtggatctgctggacgtaaatgacaatgccccttacatcacagtgacctcagagcttggaaccctccccgagagtgcagaacctggcactgtggtggcacttatcagtgtgcaggatccagactcagggtcaaacggagatgtgagcctccgcattcctgaccacttgccatttgccctcaagtctgccttcaggaaccagttctccctggtgactgctggacccttggatcgagaggccaaatctagctatgacatcatggtcactgcttctgatgctgggaaccctcctctcagtacccacagaactattttcctcaatatttcagatgtgaatgataatccaccctctttctttcagaggtcacatgaggtgtttgttcctgagaacaatcgcccaggggacctgctttgctcccttgcagcctctgacccagactctggcttgaatgcgcttatctcctactcactcctggagcccaggaatcgagatgtatcagcttcctctttcatctctctgaacccccagacaggagctgttcatgctactcgatcctttgactatgagcaaacccagacactgcagtttgaggtgcaggcccgggatcggggcaacccaccccttagcagcactgtaacagttcgtctatttgtgctggacctcaatgacaatgctccagctgtgctccgtcctcgggcccggcctggttccttatgtccccaagcactgcctccatcagttggtgctggccacctaatcacaaaggtgactgctgtggacttggattcaggttacaatgcttgggtttcctatcagctcctggaggccccagatcccagcctgtttgcagtctctcgatatgctggggaggtgcggacggctgttcctatcccagctgacctcccaccacagaagctggtcattgtggtaaaggatagtggtagtccaccactctctacctctgttactctcttagtgtccttagaggaagacactcatccagttgtcccagatcttcgagaatcttcagctccaagggaaggagaatctcgtctaaccctctacttggctgtgtccctagtggcaatttgctttgtctcctttggctcattcgtggcactactctctaagtgtcttcgtggggcagcctgtggagtcacatgctttcctgctggcacctgtgcctgtctcaccagatctcgaaggagggaggggcttcccccttccaatgggatcctccgaatccagctagggtcagatgaccctatcaagtttgttgatgtgggaggccactctcatggctgtacacccttggcttctgcacccactcggagtgatagcttcatgatggtgaagtcacccagtgcacctatggcaggggagcctgttcgcccaagctgcccaccctctgatcttctctatgggctagagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 172212 - DNA, 581 bp, Homo sapiens
  Payload ID: 13862
  Gene Symbol: PCDHGC4
  Gene Name: protocadherin gamma subfamily C, 4
  ENST ID: ENST00000610539
  CDS Start-End: 333-581
agagctggcgcggggaaagggagataggtgtctccagctgctgtggctgtttggggcgggtcggcttcatccgcgtctcaggagcaagtagagaattagcgggcggcagcaatgctccgcaagggaatgtcgctcaagatttcctgctggatacggacagtctgtcagctcgcaggctgcaggtcgctggagaggtgaaccaaagacacttccgtgtggatttggacagcggagccctgctcatcaagaacccaatcgaccgagaggcactgtgtgggctcagtgccagctgcatcgtgcccctggagtttgtcaccgaaggtcctttggaaatgtaccgagcagaggtagagatcgtagatgtgaatgatcacgccccccgttttccgcggcagcagctggacttggaaattggggaggcagctcctccaggacagcgtttcccgttggaaaaggctcaggatgcagatgtggggagcaattcgattagcagctataggctgagctccaatgaacactttgcactggatgtgaagaagcgcagcgacggcagcctggtcccagagctgctcctggagaag

SEQ ID NO: 172213 - DNA, 812 bp, Homo sapiens
  Payload ID: 13862
  Gene Symbol: PCDHGC4
  Gene Name: protocadherin gamma subfamily C, 4
  ENST ID: ENST00000618371
  CDS Start-End: 103-489
gcggggaaagggagataggtgtctccagctgctgtggctgtttggggcgggtcggcttcatccgcgtctcaggagcaagtagagaattagcgggcggcagcaatgctccgcaagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttcca

SEQ ID NO: 172214 - DNA, 2793 bp, Homo sapiens
  Payload ID: 13862
  Gene Symbol: PCDHGC4
  Gene Name: protocadherin gamma subfamily C, 4
  Uniprot ID: Q9Y5F7
  ENST ID: ENST00000617094
  CDS Start-End: 178-2793
agacaaatctaccccgccaccagcaaaaacggcgcgtaacccttgcggcgccggccgaaccgcgccagagctggcgcggggaaagggagataggtgtctccagctgctgtggctgtttggggcgggtcggcttcatccgcgtctcaggagcaagtagagaattagcgggcggcagcaatgctccgcaaggtgagaagctggacagaaatctggcggtgggctacccttttgttcctcttttaccacctgggttacgtttgtgggcagatccgctacccggtcccagaggagtcacaggaagggacttttgtagggaatgtcgctcaagatttcctgctggatacggacagtctgtcagctcgcaggctgcaggtcgctggagaggtgaaccaaagacacttccgtgtggatttggacagcggagccctgctcatcaagaacccaatcgaccgagaggcactgtgtgggctcagtgccagctgcatcgtgcccctggagtttgtcaccgaaggtcctttggaaatgtaccgagcagaggtagagatcgtagatgtgaatgatcacgccccccgttttccgcggcagcagctggacttggaaattggggaggcagctcctccaggacagcgtttcccgttggaaaaggctcaggatgcagatgtggggagcaattcgattagcagctataggctgagctccaatgaacactttgcactggatgtgaagaagcgcagcgacggcagcctggtcccagagctgctcctggagaagcctttggatcgagagaagcaatcggactaccgcctggtgctgactgctgtcgatggagggaacccgccgagatctggcaccgcagagctccgggtatccgtgctggacgtaaacgacaacgccccagccttccagcaatccagctacaggattagtgtgttggagagcgcaccagcgggcatggtgctcatccagctcaatgcctcagacccggacctgggtcccagtggtaacgtcaccttttatttcagtggtcatacccctgatcgtgtaagaaacctctttagcctgcaccccactactggaaagcttactcttttggggcccctagactttgagagtgagaattactatgaatttgatgtgcgggctcgcgatgggggttctccagccatggagcaacattgcagccttcgagtggatctgctggacgtaaatgacaatgccccttacatcacagtgacctcagagcttggaaccctccccgagagtgcagaacctggcactgtggtggcacttatcagtgtgcaggatccagactcagggtcaaacggagatgtgagcctccgcattcctgaccacttgccatttgccctcaagtctgccttcaggaaccagttctccctggtgactgctggacccttggatcgagaggccaaatctagctatgacatcatggtcactgcttctgatgctgggaaccctcctctcagtacccacagaactattttcctcaatatttcagatgtgaatgataatccaccctctttctttcagaggtcacatgaggtgtttgttcctgagaacaatcgcccaggggacctgctttgctcccttgcagcctctgacccagactctggcttgaatgcgcttatctcctactcactcctggagcccaggaatcgagatgtatcagcttcctctttcatctctctgaacccccagacaggagctgttcatgctactcgatcctttgactatgagcaaacccagacactgcagtttgaggtgcaggcccgggatcggggcaacccaccccttagcagcactgtaacagttcgtctatttgtgctggacctcaatgacaatgctccagctgtgctccgtcctcgggcccggcctggttccttatgtccccaagcactgcctccatcagttggtgctggccacctaatcacaaaggtgactgctgtggacttggattcaggttacaatgcttgggtttcctatcagctcctggaggccccagatcccagcctgtttgcagtctctcgatatgctggggaggtgcggacggctgttcctatcccagctgacctcccaccacagaagctggtcattgtggtaaaggatagtggtagtccaccactctctacctctgttactctcttagtgtccttagaggaagacactcatccagttgtcccagatcttcgagaatcttcagctccaagggaaggagaatctcgtctaaccctctacttggctgtgtccctagtggcaatttgctttgtctcctttggctcattcgtggcactactctctaagtgtcttcgtggggcagcctgtggagtcacatgctttcctgctggcacctgtgcctgtctcaccagatctcgaaggagggaggggcttcccccttccaatgggatcctccgaatccagctagggtcagatgaccctatcaagtttgttgatgtgggaggccactctcatggctgtacacccttggcttctgcacccactcggagtgatagcttcatgatggtgaagtcacccagtgcacctatggcaggggagcctgttcgcccaagctgcccaccctctgatcttctctatgggctagaggtgagacctttgcaggctcaacaaatgcttgagggttattctgatccaggcatatggctaggccatgtcctagagagtactggcctctcagtaagtgcccatagtgatgtcaccatttttgtaagaggtaactatgtggtagacgctgtgctttgtaactgtttcgtgaattaa

SEQ ID NO: 172215 - DNA, 4761 bp, Homo sapiens
  Payload ID: 13863
  Gene Symbol: PCDHGC5
  Gene Name: protocadherin gamma subfamily C, 5
  Uniprot ID: Q9Y5F6
  ENST ID: ENST00000252087
  CDS Start-End: 121-2955
agcagtttttaagaggctggaaggagacataagagacttcagctgctgcattccaagccctgggtctaccttggagacaggacagcacagacttactctccacaaagggacttctgggtcatggggcccaagacactcccacagctcgctgggaaatggcaagtgctgtgcatgttgtccttgtgctgctggggctgggtgtctgggcagcttcgttactcagtggtggaggagtctgagccggggacgctggtggggaatgttgctcaggatctgggcttaaagatgacagatctgttgagccggcggctgcaattgggctctgaggagaatgggcgctatttttccctgagcttgatgagtggtgccctggcagtgaatcaaaagattgaccgagaaagcctatgtggagccagcaccagctgcctgctgccagtgcaggtggtgactgaacaccccctggagctaatccgtgtagaggtagagatcctggatctcaatgacaactctcctagctttgccacccctgagcgagagatgcgcatctcagaatcagcagcatctggggcacgattcccactggacagtgcccaggatccggatgtgggcaccaatactgtgagcttttacactctaagccccaacagccacttctctctgaatgtgaagaccctaaaagatgggaagccattcccagagctggtgctagagcagcagctggatcgtgaagcccaggcaagacatcagctggtgcttactgctgtggatggggggaccccagcccgctcagggaccacccttatctctgtcatcgtgctggacatcaatgataatgctccaaccttccaatcctcagttctacgtgtgggaatcccagagaatgcacccattggtactctgctgctccgcctcaatgccactgatccagacgagggcaccaacggccaactagactattcttttggagaccacacatctgaggcagtgcggaacctctttggcctagaccctagcagtggggcaatccatgtgttgggtcccatagactttgaggagtcacgtttctatgaaattcatgcaagagcccgtgaccagggacagcctgccatggagggccactgtgtgattcaagtggatgtgggggatgtcaatgacaatgccccagaggtgctattggcctctttggccaaccctgtcctagagagcacaccagtgggcacagtagtggggttgtttaatgtgcgagaccgggactcaggtagaaatggtgaagtgagccttgatatctctccggacctgccatttcagattaagccttctgagaaccactactcgctgctaaccagccagcctttggaccgggaggccacatcccactatatcatcgagctgctggccagcgatgctggttcaccttccctacacaaacatctcaccatcaggctcaacatttcagatgtcaatgacaatgcaccccgcttcaaccagcagctttacactgcttacatcctagaaaaccggcctccgggctcccttctttgcactgtggctgcctcagatccagacactggggataatgcccgcctcacctactccattgtaggaaatcaggttcagggagccccagcctcctcctttgtgtatgtcaacccagaggatggacggatctttgcccagcgtacctttgactatgaattgctgcagatgctgcagattgtggtgggggttcgagactccggctctcccccattgcatgccaacacatctctgcatgtgtttgtcctagacgagaatgataatgccccagctgtgctgcacccacggccagactgggaacactcagccccccagcgtctccctcgctctgctcctcctggctccttggtcaccaaggtgacagccgtggatgctgatgcaggccacaatgcgtggctctcctactcactgttgccacagtccacagccccaggactgttcctcgtgtctacacacactggtgaggtgcgcacagcccgggccttactggaggatgactctgacacccagcaggtggtggtcctggtgagggacaatggtgacccttcactctcctccacagccacagtgctgctggttctggaggatgaggaccctgaggaaatgcccaaatccagtgacttcctcatacaccctcctgagcgttcagaccttaccctttacctcattgtggctctagcgaccgtcagtctcttatccctagtcaccttcacctttctgtcagcgaagtgccttcagggaaacgcagacggggacgggggtggagggcagtgctgcaggcgccaggactcaccctccccggacttctataagcagtccagccccaacctgcaggtgagctcggacggcacgctcaagtacatggaggtgacgctgcggcccacagactcgcagagccactgctacaggacgtgcttttcaccggcctcggacggcagtgacttcacttttctaagacccctcagcgttcagcagcccacagctctggcgctggagcctgacgccatccggtcccgctctaatacgctgcgggagcggagccagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 172216 - DNA, 2763 bp, Homo sapiens
  Payload ID: 13863
  Gene Symbol: PCDHGC5
  Gene Name: protocadherin gamma subfamily C, 5
  Uniprot ID: Q9Y5F6
  ENST ID: ENST00000610789
  CDS Start-End: 75-2711
tgcattccaagccctgggtctaccttggagacaggacagcacagacttactctccacaaagggacttctgggtcatggggcccaagacactcccacagctcgctgggaaatggcaagtgctgtgcatgttgtccttgtgctgctggggctgggtgtctgggcagcttcgttactcagtggtggaggagtctgagccggggacgctggtggggaatgttgctcaggatctgggcttaaagatgacagatctgttgagccggcggctgcaattgggctctgaggagaatgggcgctatttttccctgagcttgatgagtggtgccctggcagtgaatcaaaagattgaccgagaaagcctatgtggagccagcaccagctgcctgctgccagtgcaggtggtgactgaacaccccctggagctaatccgtgtagaggtagagatcctggatctcaatgacaactctcctagctttgccacccctgagcgagagatgcgcatctcagaatcagcagcatctggggcacgattcccactggacagtgcccaggatccggatgtgggcaccaatactgtgagcttttacactctaagccccaacagccacttctctctgaatgtgaagaccctaaaagatgggaagccattcccagagctggtgctagagcagcagctggatcgtgaagcccaggcaagacatcagctggtgcttactgctgtggatggggggaccccagcccgctcagggaccacccttatctctgtcatcgtgctggacatcaatgataatgctccaaccttccaatcctcagttctacgtgtgggaatcccagagaatgcacccattggtactctgctgctccgcctcaatgccactgatccagacgagggcaccaacggccaactagactattcttttggagaccacacatctgaggcagtgcggaacctctttggcctagaccctagcagtggggcaatccatgtgttgggtcccatagactttgaggagtcacgtttctatgaaattcatgcaagagcccgtgaccagggacagcctgccatggagggccactgtgtgattcaagtggatgtgggggatgtcaatgacaatgccccagaggtgctattggcctctttggccaaccctgtcctagagagcacaccagtgggcacagtagtggggttgtttaatgtgcgagaccgggactcaggtagaaatggtgaagtgagccttgatatctctccggacctgccatttcagattaagccttctgagaaccactactcgctgctaaccagccagcctttggaccgggaggccacatcccactatatcatcgagctgctggccagcgatgctggttcaccttccctacacaaacatctcaccatcaggctcaacatttcagatgtcaatgacaatgcaccccgcttcaaccagcagctttacactgcttacatcctagaaaaccggcctccgggctcccttctttgcactgtggctgcctcagatccagacactggggataatgcccgcctcacctactccattgtaggaaatcaggttcagggagccccagcctcctcctttgtgtatgtcaacccagaggatggacggatctttgcccagcgtacctttgactatgaattgctgcagatgctgcagattgtggtgggggttcgagactccggctctcccccattgcatgccaacacatctctgcatgtgtttgtcctagacgagaatgataatgccccagctgtgctgcacccacggccagactgggaacactcagccccccagcgtctccctcgctctgctcctcctggctccttggtcaccaaggtgacagccgtggatgctgatgcaggccacaatgcgtggctctcctactcactgttgccacagtccacagccccaggactgttcctcgtgtctacacacactggtgaggtgcgcacagcccgggccttactggaggatgactctgacacccagcaggtggtggtcctggtgagggacaatggtgacccttcactctcctccacagccacagtgctgctggttctggaggatgaggaccctgaggaaatgcccaaatccagtgacttcctcatacaccctcctgagcgttcagaccttaccctttacctcattgtggctctagcgaccgtcagtctcttatccctagtcaccttcacctttctgtcagcgaagtgccttcagggaaacgcagacggggacgggggtggagggcagtgctgcaggcgccaggactcaccctccccggacttctataagcagtccagccccaacctgcaggtgagctcggacggcacgctcaagtacatggaggtgacgctgcggcccacagactcgcagagccactgctacaggacgtgcttttcaccggcctcggacggcagtgacttcacttttctaagacccctcagcgttcagcagcccacagctctggcgctggagcctgacgccatccggtcccgctctaatacgctgcgggagcggagccaggtgaggggctcggcgccgccccgggcgacccctgggggcggcactggagaagccgcccgtcctcataagggattgaacttgcatccactcctctccggccggcttggtcgctggctgcgctccacccgattctcgggatcattggaccgtttgcgcgaaaccagagtggccgattaagggatggggctccgagcaccgggggtggtggcgactgtgggcgaggggaggt

SEQ ID NO: 172217 - DNA, 6347 bp, Homo sapiens
  Payload ID: 13864
  Gene Symbol:
  Gene Name: Protocadherin-20  [Source:UniProtKB/Swiss-Prot
  Acc:Q8N6Y1]
  Uniprot ID: Q8N6Y1
  ENST ID: ENST00000409186
  CDS Start-End: 2107-4962
ataaaatattgcatattgacagcaatatcccagtggctgatttattgataatatctttgaccatttgaattttttttcctattatatataaggaaatacaaactaggtaacaggaagaaatgagaaaaggtagagagagacaatagtgaagactggtggacattggactacaaaagattactgcaggattcttctatgatgctgattacagctttatcttatcaagctttggcattgaagaccatgtgaattcatctccaaccctgggagtgaaataagaactttcttttttgcttctgaaattttaagctctatacggaaacactttttacttaatctgcatgacatcagagaaagggaacaatttgaccaaagaaagaagaaaaagtggattagcagatctcatggactgagagtctccagatggtaggaggtccattcagcagaaatacaaatgagaatacgatgtttctaatgtatttaatttggagaaaaacattttcacattttttcaataagcaaagttaatcacattacattttacctttggtaaaagaatattaattaaattgattatgctcacactagagaacaatataacatatcatagtcaaataacgtttatgtttatattcattattacaagcattaaaaagaaataaatagtgttggcagatattacttaagcaggcagagtctcctatatctggaaatttatcatttatactgctagagttaaggatattttaatagtatttaattaactaaaatttaagagattactgctttcagccatttaaaaattattaattgaacgttgactacctgcttggtctgtgtttaccattatccattaagagcttgttatttaattggggaaatccaagtcaagatacagtaaatacgcaagaaacttatcaaatatttgaataaaaataatggcacccatattttatggtgtatttatagtattgttcctgaaaaaataagaaaaactattaatatccccctccaaaaacacatggaagaaatttcccatttttaaaaattattaatattctcatctaataaatgctatttggaactatcatattggaaataaataaaatacctttaatccaataatgatatcattgaagaaatgagtaccctcatatagttacagtgctattataaataactaaaatttctggaggtatttgttttacatataccagaaagtcttaaaattttacattccagttaaaacatatattcaatatttagtaattcatgctaaattatcataaatatttccaaagatgtcgataaaataagcctcactgaaaatatatttatataaaatattgaacaagtaaaatgttcatatccacattacaaactgatatgaggaaattctattctgtccaaaaatgatacagaatacgtaaagacatgcaaaatgattataacataataaaacataaattagatgatttttaaaatctctaagttcagtaaaaatccagagaaatcaaactgaatgtggataaaggcaccaaaaagtggaatgaataaagtcacgtacatcggactgtgaagaaaaatcatgttttggaaaagctgtccacacaatacaagaatttttaatcgaagaaaaattcactggcaaagaagccactactgcctctaaaataagaccacaaggcaaacacccagagacatttgagcctccaactaggaaactagcagaagctctaccactgcccacagcaaagattcaaaattgggcaacctgtggacttggcatctgactggtgcggcaaggaaggaggctggtaggtaagcgctactgtgcccaaccccgagctgcctcttcgcagtcttcaggagcaagtcccccattccagctcctctggcagagtatggagttacctgcgtccggggcaggaaaccatgaatgtgcccttctgccctcttgcctttctgccactctttgagttcccgtccttaattgaagagccagtgactattggctgaagttcccccagcgatttgcatgaaccgagagggagtgtcttctgccgccctcccttcaagagcgctctgactgcagcctcccagggaatgcgcggccgagggaatgcgcgcagctcacaggccctgggagtgagctggtgcccggcgacctggcacccgcgcctggatatggggcgtctacatcgtcccaggagcagcaccagctacaggaacctgccgcatctgtttctgtttttcctcttcgtgggacccttcagctgcctcgggagttacagccgggccaccgagcttctgtacagcctaaacgagggactacccgcgggggtgctcatcggcagcctggccgaggacctgcggctgctgcccaggtctgcagggaggccggacccgcagtcgcagctgccagagcgcaccggtgctgagtggaacccccctctctccttcagcctggcctcccggggactgagtggccagtacgtgaccctagacaaccgctctggggagctgcacacttcagctcaggagatcgacagggaggccctgtgtgttgaagggggtggagggactgcgtggagcggcagcgtttccatctcctcctctccttctgactcttgtcttttgctgctggatgtgcttgtcctgcctcaggaatacttcaggtttgtgaaggtgaagatcgccatcagagacatcaatgacaacgccccgcagttccctgtttcccagatctcggtgtgggtcccggaaaatgcacctgtaaacacccgactggccatagagcatcctgctgtggacccagatgtaggcattaatggggtacagacctatcgcttactggactaccatggtatgttcaccctggacgtggaggagaatgagaatggggagcgcaccccctacctaattgtcatgggtgctttggacagggaaacccaggaccagtatgtgagcatcatcatagctgaggatggtgggtctccaccacttttgggcagtgccactctcaccattggcatcagtgacattaatgacaattgccctctcttcacagactcacaaatcaatgtcactgtgtatgggaatgctacagtgggcaccccaattgcagctgtccaggctgtggataaagacttggggaccaatgctcaaattacttattcttacagtcagaaagttccacaagcatctaaggatttatttcacctggatgaaaacactggagtcattaaacttttcagtaagattggaggaagtgttctggagtcccacaagctcaccatccttgctaatggaccaggctgcatccctgctgtaatcactgctcttgtgtccattattaaagttattttcagaccccctgaaattgtccctcgttacatagcaaacgagatagatggtgtggtttatctgaaagaactggaacccgttaacactcccattgcgtttttcaccataagagatccagaaggtaaatacaaggttaactgctacctggatggtgaagggccgtttaggttatcaccttacaaaccatacaataatgaatatttactagagaccacaaaacctatggactatgagctacagcagttctatgaagtagctgtggtggcttggaactctgagggatttcatgtcaaaagggtcattaaagtgcaacttttagatgacaatgataatgctccaattttccttcaacccttaatagaactaaccatcgaagagaacaactcacccaatgcctttttgactaagctgtatgctacagatgccgacagcgaggagagaggccaagtttcatattttctgggacctgatgctccatcatatttttccttagacagtgtcacaggaattctgacagtttctactcagctggaccgagaagagaaagaaaagtacagatacactgtcagagctgttgactgtgggaagccacccagagaatcagtagccactgtggccctcacagtgttggataaaaatgacaacagtcctcggtttatcaacaaggacttcagcttttttgtgcctgaaaactttccaggctatggtgagattggagtaattagtgtaacagatgctgacgctggacgaaatggatgggtcgccctctctgtggtgaaccagagtgatatttttgtcatagatacaggaaagggtatgctgagggctaaagtctctttggacagagagcagcaaagctcctatactttgtgggttgaagctgttgatgggggtgagcctgccctctcctctacagcaaaaatcacaattctccttctagatatcaatgacaaccctcctcttgttttgtttcctcagtctaatatgtcttatctgttagtactgccttctactctgccaggctccccggttacagaagtctatgctgtcgacaaagacacaggcatgaatgctgtcatagcttacagcatcatagggagaagaggtcctaggcctgagtccttcaggattgaccctaaaactggcaacattactttggaagaggcattgctgcagacagattatgggctccatcgcttactggtgaaagtgagtgatcatggttatcccgagcctctccactccacagtcatggtgaacctatttgtcaatgacactgtcagtaatgagagttacattgagagtcttttaagaaaagaaccagagattaatatagaggagaaagaaccacaaatctcaatagaaccgactcataggaaggtagaatctgtgtcttgtatgcccaccttagtagctctgtctgtaataagcttgggttccatcacactggtcacagggatgggcatatacatctgtttaaggaaaggggaaaagcatcccagggaagatgaaaatttggaagtacagattccactgaaaggaaaaattgacttgcatatgcgagagagaaagccaatggatatttctaatatttgatatttcatggtggaataacacagagaaatgttttaactgactttggatcttcatcacctaaaaaagagtgtgttgatggcagttccaatgaaggacaactaatttataacttgttctatattgtaaatagctgtttacaggtttttaaatttaaattcagaggttataaaatgtgtacagcatttttaagtgaaaattagtactaacagctataggacttgtatttaaaaaaaaaaaaaaagcttggacatggtttgcagctttcatacaccaagcagatgattgataaaacctgggagtaaggtaagaaaaatggaacaaatttttatctaaaaattcctgtcaccacaagagggcatcagctgctcctttgcaggaaactggggtattgtacttggcagttgtacatgaaattaatgaaagagtatattttaaatatattgtttttaacattaaacaaatatgaaattaaagtaaattaaatttcaccctatttaaacatatgataaaaaaagaaatgcacttgtaaacagaatgtttattacctcataagtgcatatatagtgtgaaagagaaggcattaaaaagaagtgcaattcctttttagcaaggataaaatcattgccttgtgttacagattcagcctgctgaagagtattccactttctgtgtactcgaattgctttctgtttgctttaccactgcacttgttattattacaagggaaatagatttatacatacatatatatattcttcattacaggaaatgtaactagatattgtgcccaagaaaaacagccagaagcaaagaaatgcttcaatctttagttgcttcataggcattcatgacattttagtgctttcacaacttgttggtcgtactttatacttgggttatatattagacttttataggcttgaaatcatccatcacataagaaaatagaaatcatattaaaagtgaattcttctagaggcttgtgtacactactggttgttttagttgggccttttatatgaaagttatactgtacttatctttttgttgttgtttaggtttgttgactaccatttctggcttcctttctttggttttggattaaatccaacagtttatttgtaagccctgcagcagatttctttgataatttagcttttactgaatctcttgcaatgaagaaagctatttcatcagtgatttatcactttcaattcattgtgtgagctggaaatattattttatatgagagctatagcaaaataatctgtataaacaaggaatgtgttagcttaaactggatcattttactttttggcatcatgcatctgtactgtaccaaaagtgtttatatgtctgcaaattaaaggtatatattttcataa

SEQ ID NO: 172218 - DNA, 6845 bp, Homo sapiens
  Payload ID: 13865
  Gene Symbol: PCDH15
  Gene Name: protocadherin-related 15
  Uniprot ID: Q96QU1
  ENST ID: ENST00000320301
  CDS Start-End: 396-6263
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaattcttttccttctctaccattttcaacaaagcaggggaaataactcagtctcagaagacaggaaacatcaacaagttgtgatgcccttttcttccaatactattgaggctcacaagtcagctcatgtagacggatcacttaagagcaacaaactgaagtctgcaagaaaattcacatttctatctgatgaggatgacttaagtgcccataatcccctttataaggaaaacataagtcaagtatcaacaaattcagacatttcacagagaacagattttgtagacccattttcacccaaaatacaagccaagagtaagtctctgaggggcccaagagaaaagattcagaggctgtggagtcagtcagtcagcttacccaggaggctgatgaggaaagttccaaatagaccagagatcatagatctgcagcagtggcaaggcaccaggcagaaagctgaaaatgaaaacactggaatctgtacaaacaaaagaggtagcagcaatccattgcttacaactgaagaggcaaatttgacagagaaagaggaaataaggcaaggtgaaacactgatgatagaaggaacagaacagttgaaatctctctcttcagactcttcattttgctttcccaggcctcacttctcattctccactttgccaactgtttcaagaactgtggaactcaaatcagaacctaatgtcatcagttctcctgctgagtgttccttggaactttctccttcaaggccttgtgttttacattcttcactctctaggagagagacacctatttgtatgttacctattgaaaccgaaagaaatatttttgaaaattttgcccatccaccaaacatctctccttctgcctgtccccttccccctcctcctcctatttctcctccttctcctcctcctgctcctgctcctcttgctcctcctcctgacatttctcctttttctcttttttgtcctcctccctctcctccttctatccctcttcctcttcctcctcctacattttttccactttccgtttcaacgtctggtcccccaacaccacctcttctacctccatttccaactcctcttcctccaccacctccttctattccttgccctccacctccttcagcttcatttctgtccacagagtgtgtctgtataacaggtgttaaatgcacgaccaacttgatgcctgccgagaaaattaagtcctctatgacacagctatcaacaacgacagtgtgtaaaacagaccctcagagagaaccaaaaggcatcctcagacacgttaaaaacttagcagaacttgaaaaatcagtagctaacatgtacagtcaaatagaaaaaaactatctacgcacaaatgtttcagaacttcaaactatgtgcccttcagaagtaacaaatatggaaatcacatctgaacaaaacaaggggagtttgaacaatattgtcgagggaactgaaaaacaatctcacagtcaatctacttcactgtaatgttgcttttcttattttagtcgggcaaacctcttgttgatcatagtcttcaagttgaacatcaaatttgaacgtcaaagaagactctattattttaccccaaattcaatgaaatgcagttttttttctcgtttttaatttaaaaagatattaacctcatcactactaactcactcatataatagatttaccttactttttaaaaactacaaagtagcataatttgttctacatttatttgaaaagtaagtaattttaatctcttttttagtgggaatatgtgggcatgaaaattagatacccaacttaaaccaaaggcatgtctatcatgtggatgcagtaacatttacatttagtttttgatcgtagttttatatgaatgttccaagaaaaaagcagactgttacaaataagttaaaactgatatgattgataggttctgttttttcttgaagcctatgtatttggtaagaagaaatactaccgaagtaaaatataatgtacctagattgtaggagatgacagacataaggtatttcaaaataaatctcaggtgctataacatgtagtcatctgttttct

SEQ ID NO: 172219 - DNA, 7017 bp, Homo sapiens
  Payload ID: 13865
  Gene Symbol: PCDH15
  Gene Name: protocadherin-related 15
  ENST ID: ENST00000361849
  CDS Start-End: 396-6269
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataatcttttccttctctaccattttcaacaaagcaggggaaataactcagtctcagaagacaggaaacatcaacaagttgtgatgcccttttcttccaatactattgaggctcacaagtcagctcatgtagacggatcacttaagagcaacaaactgaagtctgcaagaaaattcacatttctatctgatgaggatgacttaagtgcccataatcccctttataaggaaaacataagtcaagtatcaacaaattcagacatttcacagagaacagattttgtagacccattttcacccaaaatacaagccaagagtaagtctctgaggggcccaagagaaaagattcagaggctgtggagtcagtcagtcagcttacccaggaggctgatgaggaaagttccaaatagaccagagatcatagatctgcagcagtggcaaggcaccaggcagaaagctgaaaatgaaaacactggaatctgtacaaacaaaagaggtagcagcaatccattgcttacaactgaagaggcaaatttgacagagaaagaggaaataaggcaaggtgaaacactgatgatagaaggaacagaacagttgaaatctctctcttcagactcttcattttgctttcccaggcctcacttctcattctccactttgccaactgtttcaagaactgtggaactcaaatcagaacctaatgtcatcagttctcctgctgagtgttccttggaactttctccttcaaggccttgtgttttacattcttcactctctaggagagagacacctatttgtatgttacctattgaaaccgaaagaaatatttttgaaaattttgcccatccaccaaacatctctccttctgcctgtccccttccccctcctcctcctatttctcctccttctcctcctcctgctcctgctcctcttgctcctcctcctgacatttctcctttttctcttttttgtcctcctccctctcctccttctatccctcttcctcttcctcctcctacattttttccactttccgtttcaacgtctggtcccccaacaccacctcttctacctccatttccaactcctcttcctccaccacctccttctattccttgccctccacctccttcagcttcatttctgtccacagagtgtgtctgtataacaggtgttaaatgcacgaccaacttgatgcctgccgagaaaattaagtcctctatgacacagctatcaacaacgacagtgtgtaaaacagaccctcagagagaaccaaaaggcatcctcagacacgttaaaaacttagcagaacttgaaaaatcagtagctaacatgtacagtcaaatagaaaaaaactatctacgcacaaatgtttcagaacttcaaactatgtgcccttcagaagtaacaaatatggaaatcacatctgaacaaaacaaggggagtttgaacaatattgtcgagggaactgaaaaacaatctcacagtcaatctacttcactgtaatgttgcttttcttattttagtcgggcaaacctcttgttgatcatagtcttcaagttgaacatcaaatttgaacgtcaaagaagactctattattttaccccaaattcaatgaaatgcagttttttttctcgtttttaatttaaaaagatattaacctcatcactactaactcactcatataatagatttaccttactttttaaaaactacaaagtagcataatttgttctacatttatttgaaaagtaagtaattttaatctcttttttagtgggaatatgtgggcatgaaaattagatacccaacttaaaccaaaggcatgtctatcatgtggatgcagtaacatttacatttagtttttgatcgtagttttatatgaatgttccaagaaaaaagcagactgttacaaataagttaaaactgatatgattgataggttctgttttttcttgaagcctatgtatttggtaagaagaaatactaccgaagtaaaatataatgtacctagattgtaggagatgacagacataaggtatttcaaaataaatctcaggtgctataacatgtagtcatctgttttctgataagaacatcttttactctgacttgcttttatcttagtagtatgcttatggatttagtagtatgcttatggatttgataaatcttatactttttcagttgctgtcttattctctttatttctcattgtgctttcccttcccttctttataatgaaaataaatct
